United States Patent 7,868,149 (PLANT GENOME SEQUENCE AND USES THEREOF) - sequence listing, part 82

SEQ ID NO: 43618 - DNA, 17546 bp, Oryza sativa
tcttcggtgcacactcaaaacagtaagtgatgaaagggatgtcttgtggcaggaaacgaagcagctgcgaaaaactatcagcgccttgcaaaatgatgttgcttcattaaagcagaagatgaaatctcttgatgaagacatactgcttaaggagggtgaaatactgcttaaagagggtgagatttcgatactacgtgacagtatcggcaggccatctgacatcatctgcagccctcggccatcgaagctgttcgaatcggagtaaatttgcatagaagtagctgtagaatcttgcatttttcaaacagctttactttccccccattttacacaggagatcatttacttgtgaatatggaataccgaatagggcgtttgctgctttctagatttcttgtataccaatgcaatatgtgttgcattatctagtaagagacacgagtactcgacggatgacatgctcagaggcacctccgatcatagctatgtcaaatctagtcctctattatgttaattgccacctttcttttttgggaatacaaacacctcgacaatgtttatgttactggtgctgcacatacaaattttgattgatcggcagatcaggtcacctgggtactttgcacgtcattttcttgagtatccagtgcaatggttcatcatatcctcgcacattttgtaagtacccagtttaatagtgcaccatatcctcgtcatccttacgaaactagtagcaggtcagtgctaacgctacggtgatatttagtaagcatgcataaaaaatttatatatgtcaacatccatgctaatttaattattattataactatcacaaacttgggcagcttttagttgtgtagttcaattctcaatcaagtgggagcaatttctttagccataaacaaacatcacttaatgtttttctattgcttcatcaataatcgtcatttgtatcagagtatatgatgaaaaaaaattgtatttaagatatttgaataaacaaattaaatcctctaatggaataacatttggctgagaagaagaaaaatatttacaggttacaccgcagcagaagaaatcattaaagttgctagaattatgtcacaatagaccaatacataactgttgtgaaatacaacacattatttgttgcaaaaatatgtattacaaaccttatatgtaatgcaaagcgggaaactatcgtaggatcaaaaatgaacatctgagatgtatccagttcatcctgagtaaaacttttaatcctaataaaacctttgctcatggttaaaactgggagcaaaagtttactcagggtgacgtgaaccaaacattcaatttttaattctacggtagttttcaggtttacattatatatagggtttgcactacaaagtttttcttatttgttaggcagcttcaattgatgccaacattggtgaccttagctgagggcattgatatttattttccaacctgtagcattccatctattttgctctgaaatctaacatgaaaagcatgtgctgcccaaaaacctaataaatggctcataggggtttcaaaaaatgcgaaatgcaaataaagcaatatttttttactaatcaagatgtaacagtggttagctgcctgctgcaaagaataaacatattcctttacactcatctattcaaatattgcaggaacatcaaaaagctactacatatttatttgtacaaaatgattattgtgcagtaagaagaatgaatgaacagtggatatagaattatatagaataggcagattgtgaataaaatttgcagaggacattggtctgctccatttatgcggtaagaaaccaaaacgtcagtttgtctaaaaggataaaccacaaattggtgagcattatatggtttctgacacttgtattgacgataaaattaccttgtaggcttgtactgggcattgatggtgctgctttactcgtgatattatccacagcggacaaagtgatagaagcaaccttgtagctgctagccaaaagtgtgaacatatgagcccaagcagcctattatatattgattaacatgaatactgctcaacattagattatgaggcgcgtttgcgcacacccaaggaatctgacttctcaaattatcaaacaaaaagagcatacagggacaattacggattaaaatattacattcaattatggtttcaaattatatgatatagtgacatcaactcatctaaaaactatctaccccaatttttaggatcagacttcacctcactaaataactttgtgccatacatatgcataaaacgataagagaatatctataagattggctggttgcaataagacaactcttgatcagccgacctctttgttgaatgactgagcaacagagagcagcctcttctttgtttagtcatgaatgcacattttgatcagttagtgtgaggttcaggcaagtcgtactgaaaatcaggcgttactataatgaacattttataagtttggacgatatcccttcgtattaatatttagtttgaactaagatgataatttatgtaaattctgctatacaattcaattctacagatgtagttcttgtttttaacacaatgtagcatgttaggattgtactatatattcttcgctttccagcctagatatctgcagaaccctgaacatctagagtggagagcttaaatagtgatgaagttttggcaaagcagcagagccatttcctgcttggacctggattcagcatgcaggatctccagtaccatcttatcggggttgatccaatacctttcctgcacgttcatctacatgaaatccagcagaggaaccaaagtttcagtgttcagagaaacagtaagtcagaaagcaacgatagatccgctacaaacctattaacctttctgaaataactgaaaaaaaggatatttccctgcatatatgagcctgtgctcttgtagagattatggtgcttggcagcagagctcctttgggaaggacatgcataatgtatcaggattacccggtcgctagccttccaaggttatccaccgcccacttcgccacagcctttctcgaccgtgagtgatcaagagggaggagataaacaggcgcagcgtcacaattaatgggcgaagagaagctgtggacggcccagccaggagggcagcagctaaacggtagggcccctctcatgccgtggccatcgctgcagagctctcatgccatggcaaagaggcaaggatcgccaaccgctagaacgggatgtggccctggcgctggcggcagagggacccggggccggggacgcatcctcggcgacagagcagccggatcctctcggtagcggtctacggacgcttcctcagcagtagaagacctcgcaggcgtgcgagaacgtcgaccgcgcacgagtgaagagatcaggtgatcgacgaggccgttggcaccaggtgcggaagccgactgctcgcgcttcaggattccgaaattcgaggaaggggatcgacagattgagatggtggcaggatttcgggagtgaggcgcgcgcgttgatgggaaagaaatcacgcgattacggcagcctcggctgtacactactgaggtggacgcgatgatcgttagatcgggcactgaggaatactgtcagctggatttgatgaatgagtaatgtaggtgtaagagtgagttgataaattatagggtagatgaattataggtgtaagagtgagttcatttatctagatttttctgtaatgtgactatctatatcagctagacagtatttagacaaaattcaatcaaatttagtacgggatgtgacccatcaatctggacaggttcactggtttgttttttatgggatggagggagtatacatttgttttactgtttttatttttttgttttttatgagatttctacgtaatatcactacagcaacaaaattagaaatcaatccaatacaaatatactcaccaatcaaaaccaagaggatgcgttgttcatttgtcagaaccaataaaaataaacatacgaggtgttttggagatcgatcaacaaaatggtagtgcgatatttttcagggaaaaaaaacacatggtggcattggaccatacatgcacgtatatcacaaaccatttctacagtctttctctctcttaatataaaaccagcagaagctggcttaggcttcaaaaaaaaaatcacaaaccaatgttgttttgaaggctacagttaaggcctacaacaattgcatatatggcttgaaacacaggcttgtaaactgtggaaatctcccagaatcatcaagcctgtaggatacctggctgcaaataataataacaatcacatgaacgcatgtggcagctattttaaaatacataaggctgtttagtaacagcaatgctcaactctaaatcatgtgatgggccttaaattaggatctccatccaatctatagatctgccttcctgagatcttcctcatcatgcttgtagagtaactaaagaaaccagtcactggggagctatacggacaggtctgtgaggctttggcgctaaaatgtgtgcaagcgacaaaatgtcaaatttcttcacaacgcagaggattaaaatgaatgattggaccaatgatccgaggccaatccactttattgatcccacaagatcagtaaatgattctcaatcttacactataatttgtggtaacaacggggtgactttaaaatgatatcatattgattgcacaagtattccaagcaaatatcttaagataccaactgttcttcacatgtaaatgcagtgtgaagaacagagtttttcctctggtccttaggagagaggagttattttaagtgctaattgggagatagaggtattctaactcttgattaacactttgggtgcatgtacttgcaaatatctcatggaccagaaaaaaagagagcatattctaccatagaacctacatgagaattctatgcagagcaataattctagacaatggagaagaagaaatacagggaaaagaacataccatttggattcccttgctcgtagaaatttctaaaaagagccactgcctcctccgccatgatcccaccagtacatttgtaaccttttggcccgggaatttcctccctagcaagagacaaacagtttgaagttggagtgccataaacaactaacagagttcagaattaatgatgtaaagaactcaataaacaactaacagagttcaggattaatgatgtaaagaactcaataactatgttgtacgtgcaagaaaatgaaaatattaagcatgtgcaagtttgcaaaaatcatgatattgaattgaaatgttagggtaatgggcaactaatgaagcactaaaagcaacatgttatcatgagtaaacagctttctgctgcttgttgcattgctccctcaccctgacagttcagcagaagaactctgatgcaatgacatgattgatccacatcctccaaatttatcgttagcacaaccaaagtacacctcccttattcctgtcaaaagaatgaacatgttaaaaagcataaatccatatgctcttacatatttttaacacaataaagataaaacatctcagaccaagtatcgacaacgccattgcgcacattatgcaaggctcacatgtgacataaaggtcgcatcttgcaaacttctccgcgacctgtggctgatcaagtcccatgccctgccactccctaagcaggatatcaattgcttccatctcagcatgccttgtagccttagaatcggtacaggcacaatcaaattacagctttaatctaagagcaaaaaaaaatcttttacatgtaaatgcagttggtatcaattacaggttttcttttacacctgtacaaaatttttactcctgctctatttaatgaaattggcatgtttaatgctggttcgttcaaaagaaataataataataataataataataataataataataataataataataataataataataataataataataataataataataataataataataataataataataataataataataataataataataataataataataataataataataataataataataataatctaagagcaaaaatattcctaaccgaagatgtaagagcatgcatacattccgggtggcatttgtcttgttgctaccggatgaaatcaccttcccatcctccacaatcacacatctaccaagacagaataacaaaaaaaagtagagccagcagcagttaggagttactagcagttagcacagcaagaaccaaggatgaactcctatgtatgaaacgaagcaggggtataccctacagggacctcaaggttgtccaacgcaaacttggcctgcaaaaacgatccagaattcagcgccagaaacaccgtagcagcgtaaaacgtgttcttcccagcaaatcaagctggagatttcagccatacctgctcgagcgcgagctccataaactccgccgccgccgccgccatcgcccggtctggtaagggaacttccggcgtgcgtggtgagtgcactggggtgcagcgagcggcggcgggttcaggcgagcggcggcgcgatcgggttcaggtcgaggtgggttaggtttcttttccttctccttttcaggccgtgggccgagagacttgtggcccatttatttacctcgcaagtttagtttcgcttcatcctgtccagtctctgacggtagccggaggaggcagcccgccgccgtgtcctcttctcctcgcggctgcggaggagatgagcggcggcgcgaggagggtgctcgaggcgtggaggctcggggtggtgaggtacggcgacgccctcgggctccaggagaggctcgtcaccgaccggagggccggccggggtccccgacctcgtgctgtcgctgcagcacccgccgacctacaccctcggcaagcggcgcaccgaccacaacctgctcctgccggaggccgacctcagggcgctcggcgccgacatccaccgcacggagcgcggcggcgacgtcaccttccacgggccgcggcaggccgtgctctacccgatcctctcgctccgggccatcggcctcggcgcgcggaggtacgtggaggggctcgagtccgccatgatcgaggtggcggcgctgtacggcgtccaggcgtgcccgggtgccgccggcgagaccggcgtgtgggtcggggacaggaagattggcgccatcggggtcaggatctcgtcagggtttacttgccatggtctggccttcaacatcgatcctgatttgggtttcttcgagcacattgtgccctgcggtatcgccgacaaggaggtcacctctctgcggcgagaggcggcggtggagctccctcccgacgaggtgatccatgatcagctcgtgcagagcttagcaagaacattctgcttcagcgatgtggaattcaaggatgaatccgagtgcgccgacatggtttgcttagctgcagataagcaatcctgattgttttactatgtatactgaacttagagttcttcagaacgtcttgccgtcaagtctggaaatgacattaggaaattttcgtctggttttgttcattgcgaatgaaggtgacctccattttggagcataaatgaagaataaatgatgctgtaagctttgtctctcatttgataccttgcccctcttttggtctgttttcgtgagatcgaaggcatttggacaaagccttatttgctttggaatacttgaaggtcaaacaaagaaaagaaccatgagcgtaagtcatgtgtacgtttacacccatttcatctataaacacagacttattggcgttcgtcaacttatctgtttccgttcaaattactcgtcgttctagcatttaaaatttgtgtcgaatacttgtcattctcacattccaaagcacttttagagatgtctttccattcttactctcataaatataaccttactagtactagtactctcataagaaattcaatgtttgctttcggaaagatgattaggatgtaattaatgaaagtagcaatgtaatttgacacgtcttctagtttaatgtgagatttgctagaaggacaagtaaattgaaacggagggagtacaatatattgtcttggaaattggagaaatgtagttttctctggcatgttgaaggcagcttgtattttgttaatgaatggagcatacatggtctcaagctaaattgggacctacacttaaaaatccaagttactccgaaaaaggcattgaatttgtcttcaaagaagctattaatattatattcttcataccataaatatcttggcaagcttatttggggccattctgcagatatctatgatggtttgagagatctgtccaatgttgtttccttcttcatcatcctagaggacatctcagtcattgcttctgaaggtacatttatgatattgtctctgtgtaaataatgagagaatttgcaggaatggactctggaatgtaaattagcactggtatttcaattcaactaagaaattcatggtgacatgcaaggaaaacctctcatactctttgagggtgtagaggaaaaaacatgtgtatcatattagctctttgaaataaaataaactgtcttccattaattcatttacaaaaaatggaagaatctgatagaaccaaatcttcctgcatctactgtctcttcaggaatcgtaccagctgaaaatgcatcctgacattcggtgctgcaagattggagctcagtgcaggacggcttttgttctacaacaccaaccccccaagaataggcttccgaatgccgtggaagaggctgattcttgttctctgaaggtgtgctacgccgtgctgcgcttgaagaaggtgagctggcattggtcattggttcttgagccccagatgattcaaagcagatggagactgccttcccagatgcagtctgcagctggaactctgaggggctaagaggaagaaaagcactattacatgtatgctcattgtagtaggtgactgagtacaatggtggatcactataatctttctgctgaatctgcttcgttgctgggcaattcatgttatctttataggtgcatctgtagtagtatctgcaatgagacaggcgagacaacagtttgagtgaaatgaacaagaaaagggttcagttttctacgactatttgttgcaacacatctctttgtggtcgatttgggtgggtagaatgagaagagcatctaagtatcatcacagaaaggtgtctaactgataaatttcttattgtttgcaggagaggacaaggttgacaagaatgaacagatgcccactctttccagaagatatacagatgcagataccagaaatgaggaaatatactgcaaatatatcatctttcatccgaacctggggaaattacagttgtttatcttcttctcgccgtacttcctccactggtggccgtcgttgtgcggcgcaaaggtatccaccttcctcatgcgcttctctttcctgcaagtttttttcagaaacatatcaacttctactccaattgaatcccccctgcactatcatcaccactctcttataaagatcaaaaaccaaaagaccagtaatagtttttagctaccttgagccatggcctagatggtgtgattgatgcggactcggcacaggagacattgtttccagagagaaagaaagagagagacacacccggagagagaaatgctagggtgagcctgaaactgaaggccaagggagccttaattcagaagcgtaccaaactagggcacccctttttagcttaaaacatcaaagagctccataattgaggcccttatcaccatataaaaaccaccaccgctctctaagctgaagaccaaaaacgatgcaaagattatcttctcctctccccgtatcgctgtcacgtgctcccgcgcaccgacggggcgacttgagaaatttctttgcagcttcttcaaaggccccggacacacataggagctacaagtggcctcaaaatgatgtgtcaccccgtttttttaaggactaagcactgtcatcgatctagcaacttggggcgattaaatggttaattaattgctttgattggaactcgggcaaattgattatataatcggccggaccagttcacaaatcttggccagaatggaagcctgccccggtgcgttggtgattgcttagataattgattaattataaactagttggacttgacctgattctttcctttgcctcacaaagccagaggcaggaatcgtctcgttgcttggggagggagattagctgatacctaacgcatatcgatggtttttttaaagacctgcacatgctgcaggacaagttgaggcagcaaggaatctcccgcttttcgcctaatttaggacccggaaaatgatctcaccagtgatgtactgtgctttgcctccaataggggtcttagttaaaaggggcgcgtggcaactgggcggatgcattgcccggccactggggatatttttgtagagattggcagtacagacgttatgtgcatcacgatgatagcggccagttgatgaatgcatcacgatgatagcagccagttgatgcatcaagtggcactgcaagcctgaagcagtaaatgtgcttttttttttggtagtaaaattgcaagtgaaaatgctgatggcaatgcaccatgaatatactatagccaggatagattgatagtagatcataaatttgatagataaatagatagatagatagatagatagatagatagatagatagatagatggatggatggatggatcataaatactagtacgtggtcaatgaattcagagagaaggaaacacgtactcacataaggatgagatagtttattgtgctgttgctgaataagacctgcttagctgagctctgacttttacccatctccaaaaattcagaactatacatctccagttctccacctttttttatatatggagtggttactccccacgtcctcctcttggaacttaactatttacaaacactatgaggaccgagagaaaaaccagtggcattttctaattgactccttctagaaacaggacaggtaacgacttgctattggtccatagcaagataggagaagggggatgcatgctattgacatccagatcttggcttattcattgacctgcatatagtatgctactagtaaattgcccgctaatttagttggttacagactaaaatatgttgtcacaatcctgatgaacagaaataaataagggtaaaagtgtggtcacaatgaactacacgattaacaagtaggagccaagtgatagaaaattgtatggttgtggctccgcgatgccatcggcaaaataaacaagagaaatgcagaagaaggcacagctgccgtgccgctggggcgtccgtgttcatatactttcaaatctcatgagatttcatagataatgatcttaaatatatccagttcaaaatatagttgggaaatgatcagttctatactatttcttttcgatgaagtactctttagggattaagaaaaggaatcattacgagtagctctcaggcaatgcattatttggcatgtgcatgagaggcactagaacctaacattgaatatttggatttttcttgaacaatcttccatccgattataatagtactagttaattagagtccttggagaaaatattgcaccgtcagccgccgcactagggccaaatgcaaaaaaactattgagtagtccatgaaatgtaggtagacaaatagcgccaagctacacattttatagctttttttctttcttatgactcgcattaagcttgtgaagaatggtttatgtgcgggtcatgaccaaatttcaataaatctgttggccaatgcaagtctttagttatgtggaggcacctttttattcattggtctttattaaaactgaccgcacttgcagtcaaaacaaggctgcattatctgcactataaaaccaagattaggtagtggaaaccggcaaggctggtcatcaccaattagaaatcaacgttaaatatacatggtcattgtcttacgttagaaatacagccgttcagtaagacaaaaccacccttagcaaacaaacacaaaatcaccctattaaacaaacacaaatttagaaagaagaacacggttaattaatgcatgtgcggcttgatctacaccaagagacgatcgggtacttgccattgcacatgaccgacgacattgccgggaccttgtgagtgcgtgcgatggtgtgagtggtgtttaaatgcgcttcaaatataaacacagcattcgttcataatccaacaatctaaaatttatcaatagttaaagtttaaacacaccgttgagttgagttgataatttctaaagagtaaaatacacaaagagtccttagatttaatacctgtatatatgtgtcatatagatttataaatttaaaaattatatgtttatacttctaaacttggtaccaacattagtccaaaatccaacgtggtgtgccacacggacgctgacatggcaccttccccaatcctacacccatagacaaagtggggctgtcctgcaaaagtttccccttttgttttctttttcacgcttgtttttttccctcttcttcctctaatatggtgccatcatcctcatgcctcgctggtctaggccaccttgagttcgatgacacaagctcaaggaaggatcagtagggcgagaaggtgcccggtggtaggctttgcttagatggatatggataaagttgacccagtggtgggtgcgaccaagctcgaggtgacaggagtggctgagtcagaactggtgaatgatcttgcttgggcagggtggccagaagtggtaacacggcataaggacaccacgtggctaaaccaaaggctaggtgagaaggattggctctagcgagtttcgggagtcaattggccgagaaggttttagaaaaatgatgtactagacacggggattccaataataccttcaatttgttgggaggtggagtgaacacgacggatttaaggacttaagcattggtagtagaactagggtttccaccctggctcatcctccgacagcaattgaggcggcaaagggtagggtggctcctgagaggttgaagaggaggtggaggtggtgctcgaagaggaggtggaggtggtgctcctatgtattggtgataactagagaggagtcacaaagagagatgaaagtggaggagcagagcggcggtagcagtggtagagctcaagcaaaggagctcgactagtgatagctagagccgaggcttagcctatgctggattgcttgcacttagggagggtgagctcacccgtagctgcagccattgagcttgacatggacgtcgttgtgtgctcaagctaccacattaagcctaaacctaaggaagcggagaaaagaagagagagagaaagagaatgaaaaagaaatttcattagtggggttcacttgtcacaatttagggatgccatgccagcatttatgtggcatgccatgtcaatttttggaccagctttaagctgtgtttagttcctgaaaaaagttggaagtttggaaaaaaaagttgaaagttttggatgtgatgtggtgtgatggaaagttggaagttgggggtgaactaaacacggccttaatacatttagtaaggtctggtttagttcccaactttttcttcaaacttctaacttttccatcagatcaaaacttttctatacacacaaacttccaacttttccatcacatcgtttcaatttcaatcaaacttccaattttggcgtgaactaaacacaccctaaaatttcaatcaaacttttaattttggcgtgaactaaacacaccctaaatgtgtatcttttaagtttatggccatacacgaaatgcgtatcttttaagttagaaatctaaatgtgtatcttttaagtttatggccatacaagttttaggaccgctactcatttaaagcagtggtatgagcttgatttcatatagtaggaaaatagaaaatcatatatgtcgcaaatgaaaaatggaaaatcatattggacaagtttgaacggttctagaagctatcctggtaagataatctgggaaatatggcctcgaggaacaccgaatacagctgtgctgtttcctgttggcgcccacagatcggtggcacaaacgcagccggaaagtgcttgttgctagctcgcgtgtcaacaactcgcaagcttttgtagctagcgggttagttgtgcgcagttatgtgtgccgtcacctcatctaaagtttactgcagttcgtctcaagcccttccagatttatcattatgaaactaaggtaacttcgtcgaaatgcttagctcgcctctgcatatgcttgaatgtaaaaaccttttggagagcagttagcaagatcaagcgatgcatcttatccttccctctatgtttgttatactgttctttagaactcagtcagttggactaatctttcttaattctggcaatatttttatgtgacaactccagttcaattcaaatgctctaactagctcttccatcccaaagtggaaacagtaaacccttttaaaaagaccacgcagtggcgtgtggagcccaaaccggtgccagagtttcatacatatggtctggccttgtttacgagagtttttaacagctacagctaatcttttgcttaattgctcgcaaaaaatgtgcagatctgacctcccgttcgtttctgctttgaattgagagtaaaagcgggcacgtaaaatgagaaagctattaatgtatgattttaattactacaaacttaaaaatgggtatatttgacattttaaagcaatttttatatataattgttttttttgcacgaaacgcgccgttaagttgtttgaaaagcatgctaacgaaaactaaggtaaaatcttaatcttaatcttaatgagaaaagaacactttgataggtgtagtgtaggatacttcctgtgtatcatattataagtcatttgactttttttaagtcaaactttgttaagtttgaccaagtttatagaaaaaaaatagcatataaaatatcaaattagttttattaaatctaatattgaatatattgtgataacatgtttgttttttttttgaaaatactactatatttttctataaagttgaccaaacttaaagaaatttaactaaaaaaagtcaaacgaataatatgaaacggagggagtaaaaaataaacttagtagccaaaaagccgtggaacccctcgaaactttttgcattgatagacggattgtacaaaataggtaacttcattttaggtctcttaattttgtcgtcgagtctaaaatttgtccctaaaccaaaaaatcagatataacgggtttctcaatttacaaaacaggatcacccgagatcctaagcagtattatacccggttttagctgacgtggcaagttggatcagcgtgggacccacaagtcagtcacttgcactttctttctcctatctctcaccccttctcccctctcttctcctttcttcccaatcccctctagggtgacggctaacggtgcgacgagcggtagggagaagggcagtcgccggtggggagaaggggcagcgcacaacggacgatgggaaaggagctggcaatggtgaggtcacaggcgctctcgtcagggttcaagtttgagccgagcgaccagatgctcatggagctcttcctcttgccgtacctacgcgacggcaagctcctggtcccagcctcgtctttgtgaaggacgaccgcctgaggggcctaccgccactgccgtggatgctcctcgaccaccatggccaggcgacgaggccaaggccaacttcatcgggccgatggatggcgaaggggcccgataggtgtgcatgcgctccgtcgccgatggcggcaagtgggtgaagcataagtcaagcgggatgaccaccttcccaaacagccactacaagtcgccgtcgacgccgcacgtggtgcctctccagctagtgtacactgcgaccttcagcctcgccctgcacgactcgaacatcgagggtttcgcggtgagccgatcgtggtcggccttggagaggtgaaatgaggtggcgagaatgcccatcaccagcaccgatgctgacggggtcgtcccctactactccgatgatggcagtagcaatggcgcatcggcggtctagtattcagccttagagaggtgaaacaaggtggcaagagtgcctgtcactggcgatgctgtcacggtcgtcccctactgcttctccgacgacgacaacagcagtggcacgtcagcgatctggtacttagccttggagaggtgaaacgcagcagcaagagcgcccaccactggcaccgatgccgccgtggtcgtcccttgttgctcctccgacaacggtagcaacagtggcacgtcagcgatttggagaagggaagggagcgagaagtgaggggagaaggggagagagagtgaggagaaagaaaagtgccagtgattgacatctggggcccatatgggtcgtacgctgactcaacttgccacgtcaaactgaaaccggttataatattgtctagggtctcaggcgatccggttttataaattgaggaacccattatatctgccatttcggttagggccaattttagactcggcgacaaattaagagacctaggttgaacttattcctccaaaatatgcccgtctagcgttagagcccatcgctcaaacgacttcgtagcccaaaactactagttgggccacgacaatggttcagccctgcggtggcccgtccttgctcgacccaacatttcgacggcgtgcggagcgcgcctctccaagtcgaagggccaagaatctcccagcaatgcacgccgccgccgcgggaagcagcctgcgggcgggcggcgctgcaccgtgtgcgcgtccgccgcgcggtggaacgagccgtggaatcccgtgctgcccgtccgtgggccggcacacatctgcgtgtcgcgtgacacaaccgatccaccaccaggaggaggccagcccgccggcagaaacacgcaacagagttcgcgcatagattttcatcaaaagttgacaaagatctgcataacgataaatctttgaattatgacataaaagatgactatttttttttcttattacatctttttatattgaatcaaaatcgaagctaatatacgtgtgtcccaaaaagtgcaggatctctactggactacttctatgctgttcaccgcggctccaaagagtccagtactctacggggagcagatacagcatatcatggaggaatgtactacgctttcattcgagtacatctcagtcaccggaatactcatccttgagcacgagaatacaatcttcactttaaacaactatcgatcggttggggggatcctctagagtcgacc

SEQ ID NO: 43619 - DNA, 5032 bp, Oryza sativa
  unsure (1)..(5032): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgggtgtcaggtttcgggctcgggccaaccccgcacctccctcgggcgtgcagggttggccgggggctacaacatatgcatattcttttttctcttacatctgtatttcaataaaagcagtttcaatttcctaaaggctgtatctgtgctgttttttccttttgaagaatcttgacttgaaataggtcactcgtgctcaatcctgccctcgggggctcgggtcggctaaaatcgccgaacggagcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggactagaacttgggcacgagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcaccggcctcgacgtcactgtcgtctgcaccaccggcattgccctcctcgtcggagttgggggcgaacgcaagccgaggggccgagccctcgaagctgtcgacgatatggtcggcggcatcccagacctgcgcgcgcgcgcggtcctcggtcccaggagggaactcatccagcgccatccatggggagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccacgcctcgagctcagcggcccgttggttcagtacggccctctcggcgcgggcaccttccagattgcggcgcgcctgctcctcctgcgctgcctcgcggagggacaggctgactgccagctgttgcgccgcggcctcggccccctcgagagctcgctcccgctcggtgagcacgtcctcgcggaggcggagcgtgaactcttcttcggcgcaggcagcctcgtgcgccgccagcgttgcttcccggatggtgacagcggcctcgcggtccgccagatccctctccacgacgcaggcgcgctcttccagcgccatggcacgtgcctcaagggcctcttcacgctgccgggacgccgcttcggtctccgccgcccgctgttctcgggcagcgtcagcgtcaagcaccccctgggcggcgtcgagcttcttccttagctccgcctcccagctcccgtattgaaggcggagggtgtcctgcgcctcgttcatcacggtggtggcaatgagggcagccccccgctcctcctccacttccttggcgatctccgccagcaccttcttacgggtttcaagctccgagacgtaccggcggtgagccttacggcccacctccaccatggcctccaccgagcgtcgcccctcttcgacacgcgcccacgcggcgtcgagctctgcccgctctgcctgcaggacctccacctgggcacttaacccatccaacaccgtggtgtttgcggcggccaaggcctgcagaagaggctctgcgttcagtggggcgatagaaggcgtggggaagagccgccttggagaggatgccacgcggctcgggccgccaatggaagtgccggactcggggatgtcccccggacccggttggtcctgagcgtcgcccgagggagtgggcccaagcgacgcgcccgcagcctcgtcgccagctgccccagaagttgtcgcctgagcgtcgcccgagggagtgggcccaagcgacgcgcccgcggcctcgtcgtgagctgcctcggaagtcgccatcgcctcgtcctggagaaatccgacttcctcccgagcggcttccccggcctggcgggcccgggcggcctcctcctgagcagtttcctcggcctggcgagcccgggcggcctcctcggcttcccgtaggcgatccgcggcctctcgccggtcagattcccgcctgagggcctctgcggccgccggatcctcggcctcagactggccggacttggaatggcgggagggatgcgatgggatctcgctgaaacaaaagaaaaaaccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttgcggggccgcttcttcttgcgctccccctcgggctgcgatgttggcgcggccccctccgggcgcctgctgctggcacgcgccgccccgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgtggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccggaggctggctcggaagtcggaggcgcgcctcgtcggcgaggggagtgtagaaccagtcgctcttccagtcgtcccacttcttgcggagggcgcaggggatgtagcggttcagcaccggcccccatggctggaagtagcagccaccgactaccgatggcggcgacaccgactgcacggtgaagaaccaccggaacagccgaagagatgggcgcaccccaatgaacatctcgcacaaatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcggcagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcagcgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcccattcacccgcttgcggcgcatgaggtggatatgcggttgtggcagtcgagatagatcatatcgtgcgcgcgttaattacgctcgccgaccgaagcgacgttaccatatctccagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgaggggg

SEQ ID NO: 43620 - DNA, 22722 bp, Oryza sativa
acctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcatccccagctggagctagcgtgttacctcccagagatggcacgttagtcctagtcagatatatgccaggcttcatcctaaccattacaggcaagatgttgtgtgaagaagggcgagcatgtaggttgctaagctgacacgtggtggacaagaatgaccgacgtgactggtctgataccggtcatgtcgtcagcagacagccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaagagagaaatggtgcatgtggtatccccttaagatataaaaggaggaccttgcccactgagatgagggacgagactggacttttccagattagaaacccagaacaagggagaggctggctcatactttgtagctcctttatacacagatctcccaaaacacaggagtagggtattacgcttctcagcggcccgaacctgtatacatcgcccgtgtcttgtgtgtttccggtctcgcgagccttccacatacagagagcttagaatctctccctgagtccccggccgaaccggcaaaggggggcctgcgcggtctcccggtgaggagccccacgctccgtcaactagattatagaaaatatatgggaaaataaggactgcgccggggctcaggggcagcgccgccggccgcgccgccgcctgccgggaggacgagcggaaaccgcggtgatgcggtgatccgtcgggggctcgggagagatgcggtgcctgcgtcgggggctcgggggccgcgccgccgcctgccgggaggaggagcagaaaccgtggtgatgcgtcgggggcgagatgcgttgcgtcgagccaccgattccgccatacttgatgagacagagaaatcataccattccaaaattacctctaatctatattaacatattactaatctatccgtttaagataaacggccaagattaattctatttgtagtagaatactgcaagtatattgcatcggagtgcctctatcttctattatagttcttttttcaggatggtctgaatgagcaaactgagactaggagtagtgaactttaatttaggacaataagcttgatgaggttgatatactgcaatggcagagcagtacctagagtcattatggcagagtagtaccaagagtcattatgcagcatactgttctgtgtgagtttaagacaaactttggggttttctaccgtagtcagaaaatagaacttgaactttgttgaaatgaactgctgtgtgtttggtgcaacgattattaaaatgaacattgttaacatgatcacgacacctccattcccatgtgcacaactacggtacaacacctaataaaatgttgacgactataaaattatttgcatttctcataaaaattcatatcagtaaacgcgtcatcgatcttattttcttatcattatgcatctaatatattttgctagcattcatttaaatataaagaagtaataatcaaagtgcattcacagcatgtcaatttccaaagaactagagaatagagcaagtaataaggtattgaccaaggccaacttgaataaagcagttattaatatttatatagccttaggtttttcttgtcctattgtatacaatgtggactacatgaatgctctttcccttgtcccttgatccaaaaggtcagtaattcttgcttcaaggacattttatcagatggatcatgaactattttatttataatgtaggtacaagagttgatcaagctgaggaggacgcagaagccgccggtagaaagggtgtgacatagatgcctgtccggatgcgaatattgtcggctcagtagtttgttggctgattggagtttaaggagtactgttgctgggcatatacgagtataattttgtgagcagaaacttatcagctagttgcgttaattgttgctcgaggagggttgatgaatccatctataaagtagaaagtaatatatatatgctgatttatttatgtatcttggcttacctttgcgtccactgtgtactctgaaactgtcgagtttttgggcataggtgtggcaatgattgtttgctttgagttaacacaaaagtcgagtgatccaactctttcggacagtttggcttgaggagtgagatgatgagttcaccacttgcttcttgttgagttgtttggttcgaggaattggatggatttttccattaccacctcattcctcaatgcacaaacccaacgctgagccttcaaggcagcagaatgacaagcagtccaactgtccaactccacggcaacaactcctcagaatcgccatgtatgtgctgttctacaggagaatgatctctttggcttaaatttgtctcaaaagtcttaaaatgcatgtcagcttttaatcggtcaacatataaatgaggttaaactgggtgtttttacttaccggcagcgtacgtgtaacttcgcgtctttacgaaatttggcttattaagggttagaaatttggcatgttaagggttagcatgtctagagtatcgactaatcttaaattgcaaatgaatgattagcatttgtagttggggatttacaaatcagacttgtcaacgcgaaactacgacatatgacgtcctagggtttgtcctagagcgcatagccccttaggcttagctcacggcacaattacaatattcaaatacccaaatcagactcggaatacacaattacaattacaatattcaaatacccaaatgaagtacgtggatgaatttgcagattcccagcagctcatgaggaattttgacatgggagcaaaaccatctagaagtaaactccataagctttctaacatgtattaaaataaaaagtaaattacacccacgatataataacttggcaggtgggtgcgatatggtgcaagaacttgagaattgaatgttcgagtgcaacaacttgacacgtgggtgcgttctagtataagaacttgacaatataatattttggtgcatcaacttagctaagcatatgctaggtgggttttttcccgcaacgtcaatatgtcattacatagcaatcctacggatattaccttataatattgaatttaatttttaagaattatattgcacatgcaatttacatccaattacctttaagaatttttgtttttttctcacctttccaaatctcaaccgaaatataataatttctacatcagtttaattgacttattagttattaggataaaaatataaatatgcttatatacaaatccacgctagcatattaattgtcaaaataagtacttaaaaattaaatatgtataaaaaaaatgctccaaataattaagttaccgtataactttttaatttattgtatgaaaagcgtacatatcttgcaagttgttgcatttatacgatcacttataaagttcttatactaaattgcacctatctaccaagttgttgcactagaatactcatttctcaagttctggcaccaaattgcacccacctgccaagttgatacaccgtgggtgcaatttactctaaaataaattctgtaaatataaagaaaatgtggatggtgcttcaagaccataagaaaatgtggtcccatatttttgttttttttttgttgattaggattccatgtcagccaaaataactttctatactgctatgtgatctaattttgaatttgtttcgaatttatttcgtacgtacactagcaatcaaacttttataacttttaacagattatattttttttgcgggggaacagagagaatattgaatactttgattgttagttgattggttccatttcactatgtcaatacagatatcattaccaaattgggatatattgatcatataattagaatataggaaaaaaccagataagattgtactatgctctaggagatgagatcaaattaccgcctgcagctgcggataagataaacgaaaagagattgtattcattccccttggtctcttaaccagatcaaagatagatactcctatatgtatactccatgtagtgtgagtatgagtgtatgaccggttctctctcattcagtctgtccacatcaacagagttcctctgataaatcttggcactctaagcaactccctcttgtgatcgttgtctcgatgaaattaaacaaaaaatgccagtacgagagtcctagaattagttgtaacatgacaatgacacacaatttggtgtttatcgtacagactttcagtttataagggattaaataagtacttactaacaatctcaattattcaaggattaatttattcagttaggggataagcacatcacccccattggcatttgacagttagatgtcattttcacaattgcttttgcagccacccaaatctatcaaccttgtacttgtagtttcataattgtttttgttttttagttactctcgaggaaaatgcgagtttattctgcattatcttgtgtgcaagcaagtacaattcaggatggtaaatagggtaaaacagtaagatcaagttgtttcataattgtcttttagttactctcgaggataatgcgtgtttattctgcattatcttgtatgcaattgcaagcaagtacatttcaggattataattagggaaaacagtaagatcaagttgtttcatgttattaattgccgaaataccaagtcttccaagatttctttgttacattatagtagaagttttctgctagattttgttctggtatcctggctaattatcagcgattacttacctccgttattcgatttttattcactataggtactacattcgtacggaggactacattaaaattgtcttgctgaaattgtcttgtttcttgagctgaaccatttttggtagagcctattcacttaaaaaatggtactatgatgaagtcaaatataaatgaatttggtacagcctattcgcttaaaaatggtactataacgaaatcaaatagcgttccaaaattgctcaagtgaaggtttatcaaactacagtgatgataatgtcttgtttgtctcagttcaacgaatttttacatttccctttttctgaatccaaaatatatagaaaggtagcagtattaatgtttttatgtttcaaaagttcaacttaaaagacatatgtaaaaactcatgttttcataatcagagggagtatttgtcaaactagccacacagaagtgcatctgaagcaacttgccccccccccccctcccaaaaaaaatgcttgcttgttggcttaaaaaaacgcaagcaacatttgaatttttcatattgattttaaacaatccaaagcattttttttctttttttcagccttagcttttaaaccactaagaatagaaacacaagttgtaaccccgtaaaatctttggcttctcatatttacgcaattatgagattacttattttgataaagatttatagcatcattcaagtaaatacaaagtgagatttaagaaacataagctgcttgtgatatagctgcacctaattaagaccggttaatgctatgactataaatagggaccaagatgtcctatgaaataaaaaaaatagaaatagcataatccaagcaaacccactttctaaattatgattggccatcatattagcaaaaaaaaagtatttttttaggttaatgcacaaaaacaattcgagattaactcatcgaggagtacttaaaaaaaaggtgctaatgtctgcgccctaagattacttttttgttgtctcatttatttttctacgggttatcatccgaaaccaataaattcgacatagctgatacattttcagatgcaaccaattgttttcctctctgtgtgttttgctcatgttttgtcaaacttgagagaaataagtggctagtaccctgaaaacctaaaggcaggggcaacgaatggtacgtttgcattgcaggcatttcttctccaaggcgtccgtgacattggcgccatccttcattgacttgacgaccgccatgaattcatctcatctcatctgatttcggtggtgtttggattagggacttaattttagtccctgtctttaaacattatttagagtattaaatataatctacttacaaaactaattacataaatgaaagctaattcgggaggcaaattttttaaacctaattaatccataattagagaatgtttactgtagcatcacataggctaatcatggattaattaggctcaatagattcgtctcacgaattagtccaagaatatggatgtgttttattaatagcctacgtttaatatttataattagtatccaaacatttaatgtgatagggagttaaaactcaagttttagtcccacctaaacacggttcatcaggatacaagatatcagcacagtgttgattgagtaggttcatcaggaagcagagtaatagcacgtaacagagttgggtatcctgtatacagcagttgtccccaaggaagcaactctccatcacatcacatcgcggaatctaaaaaagaattcatcaatcctccattttctaaaagaaaaggaaagaattcatcaattctgccctgccgcagctgcgtcctataaataccctacacgcgtagccatcttctgcaatcatcaaaacacctgtaatcatcttctgaattcatcaattcagagttcagagcagagtgtccctgcttctgtgcagaggagagagatcgagctatagagctagcctggctgctgccatggcgaccggacgacgcctctccatgatcctcctcctcctccttctcggcttggcttccggcgacaagattctcttccaggtacgcagccagccacggactgaactgaagttgtgaccgatttcagttcagtttctgaacaagctgttgcgttctcttcaggggttcaactgggagtcgtggaggcagagcggagggtggtacaacctgctgatggggaaggtcgacgacatcgtcgccgccggcgtcacgcacgtctggctgccgccgccgtcgcactccgtctccacgcaaggtcggtttctcctgctgctcctccttgtctgaaactaaactctgaacattttggagttggcgaaatttgggatcctgcaagcgtggagtggacagcacgctaactaagctaccctgattgcgaagtgtggataatgattgtcactttggcctttatttcatttgggttggaatgagatgtttcactgatttagttgaggaatttttggctagataatatcacactgacatgcgtaagggtcaatcaatcttgcaaccccattctaatcttatacagatgcaatacaaaggtaagctgtcagcagttagaaaaaaagattaatgatatataattagtgtaataatgagtactagtaattaagctccttccaggaaaaaaatatgtttttttttcactttccgaagtaactaatatgccactttattatcatgtttttattttctaaaaacaataaaaaaaaactactactgtacttcctgtgggtacgaaaacatatcatttctaaacatttaaactggatgtgcaaaaatcatgtgtaaatttagcatactttatccgttccacttcgggtattcaaaatacatactaactcagggtctatttggcataactctagcttcagaagctccagcttcaggtcaaccttttccgaagctggagctcaaccaaacgattttagctccatagaaattgatgttgattttacaaagttgaagttgattaggacgtgacatacacgggagcgtatcctatgcacacagaccctcgcgtgtacacaccgtgtacaccaactaaaaattatcacaaaaaattttaggaaaattcatacatgtactttcaatagtattacatctacgtgcaaagtcgcatcttcaaattcattctacatagagaataacaaaaaagataaaattctgacaaaattgcaaccttaaaactgtcagattttttgttttttttttgttacggctaaaatataatgaatttgacgttaagattttaaccctaggtgtaatacaattgaaagtatatgtatgatttttttctagattttttggtgacattttttagttggtgtgcacgtgtgtacacgtgagggactgtgtgcataggatatgttgccgacatacacacatgtagtgagtatgcataaggcatgccatatttatatcttggtctctactttatcttacatcattaaaatgtcaatggtgaatttcatatctctgtaaccatttaccattattcatattttcatatctttctctacaatcactatgcctcattctatctttttttattgaataaatgtatgtccaaataacaacttttttgttatatattcatgtagtatcataatcagcgcctagatctacaaacttagccatgtagtatccttttggtcttggtttggttatgcaccaaaatgagcgattttataggttcgtgtactagattgcatccacctgataagtttgcatactgccaatgcaatttactcgttattcaatgtggcgatgtgcgtgaagggtacatgcctgggcggctgtacgacttggatgcgtctaggtacggcacgtcgatggagttgaagtcgttgatcagcgcgctccacggcaagggcattcaggcgatcgctgacgtggtgatcaaccaccgctgcgccgactacaaggacagccgcggcatctactgcatctttgagggcggcacacctgacggccgcctcgactggggcccccacatgatctgccgcgatgatacccagttctccgacggcacaggcaacctcgacaccggcgccgacttcgccgctgcccccgacattgaccacctcaatggtgtcgtccagcgggagctcaccgactggctcctctggctcaagtctgacgaggttggcttcgatgcgtggcggctcgacttcgcaagggggtactcgccggaggtggccaaggtgtacattgaggggacaacgccggtggggttggcggtggcggagctgtgggactcgatggcgtacggcggagacgggaagccggagtacaatcaggacgcacaccggcaggcgttggtggactgggtggacagggtgggtgggacggcgtcggcggggatggtgttcgacttcacgacgaaggggatcatgaacacggcggtggagggggagctgtggcggctgatcgaccagcaggggaaggcaccgggggtgatcgggtggtggccggcaaaggctgtcaccttcgtcgacaaccacgacactggctcgacgcaacagatgtggccattcccctccgacaaggtcatgcagggctacgcctacatcctcacccatcccggcaacccatgcatcgtaagtactcctactactgctacctctgtttttaaatagatgacgtcgttgattttttatcacatatttggccattgtcttatttaaaaaataatgtaattataatttattttgttatgaattgttttatcactcaaagtactttaagcatgatttatatgttatacatttacataaattaattgattatttggttaattgactctcgaataacatgcactattaattgattattgtcatttcagttgactataaatatttttttaagaaacacactttggtaatagctatatttgtgaccctacagacttcagtagtaaaacatatttataattatttgtaattttttccaagtaaggaagtagtcaaagtttaatattgaatacttcatcaattttttgctatttattagccgtctaatacttttttgcccttatttatcagttgtctactaaacttgcataatgcacgtgtgtacatatatatacactcatcagtcatctaaaattgcacaataatgtgcctgtatatatgtacatgtagttctacgaccatttcttcgattgggggttaaaggagcagatcgcggcgctggtggcggtgaggcagcggaacggcgtgacggcgacgagctcgctcaagatcatgctgcacgacgccgacgcctacgtcgccgagatcgacggcaaggtggtgatgaagatcggctcccgctacgacgtctccagcctcatcccgcccggcttccacctcgccgcccacggcaacggctacgccgtctgggagaaaatcgccgccgccgccgccgccgccgatcatcgcacctcttccagcgcatcgctctgattgattagcgatatgatgcttgtgtgccacctcttatgttttacttctgctgtatatggaacaggctcttctacctttaaaggtacgtactttcgtcactgatatgtgggatcgataaaccatgggtctaactgttagtgataaagccatgatgactttgaagatataggatttcaatccctgtatatagataagtacatatgtaatatacatacgcatgattagtgacatatatatacactacattgccttggctgtgatcgaccgtcggtattggctggagatgtaaaccatttatattatcttaagagaaaaatatatacacagttaaccgagcactcctaccatttcataattctttgtgttttgaacaaagttgaggtcaaacttttataactttgattatcaataattttaaatatatttagtttaaaggagctagagatttatctttcaaagtattataagaaaattaaacatgcatttatttattgtatatattataataaaaaaacaaaatcaaatatatattttggagaacatgtcattgtccaaaacgttaagaattatggaaccggagagagtatatatagttgtgtctccaagctaattaaatcctgattactgtaatgtgggatattaaataaaggcactaatctgttcattttaagtgatttggtataataattgtttatagctcgttaagtaaagacagatatggtattatattccattataaaaaaaagcattaatctacacaattcgaactttctacttatggctattatgactaactttattttcatatccaattgagattagataaagagatactccctccatactcataaaggaagtcgtttaggataatgtttaagtcaaaccttgggaatataaatcatgaataactctcaaattattaagtttgaaaatgtaaaaattatatgaatagatttatcttgaaaaatattttcataaaaatatacatatatcatttttcaataaacatttttatagaaacaagaagtcaaagttatgttttagagaccgtgtcgctgttctaaacaacttcttttacgactaatgagggagtagctcattaaagtcacttgaacgtggtggctcgcaccgacacaaaccccggccgacatgaacacgcttcaccgtggcggcacgatggtgcatggtcatgcatcgctcgatgcttgccggccatgtctgttccaaattccaatggtgttgacgcacacgagcaaggatacggaggattgagggacgccagctggaacgtacatgtgtacgtcaaatgatcaagggatgaaatagatttgaaaaatagaaggtcctcatcagttggtctactattattataagtcataacggcttgttagcgattaaaaaaataatatatgagtaaaatttttgtatatatgttcttagtgattgaaaagctaaaattgaaaaaaaaactatgttgaaaagaatcaaattcaaattaaaatcaagttttaaattttaaatttggctttggcttataagccatgggcaaacgatgaggcacgaagcttgttgagcaaatagctatacaaatacatgatgaggattgggtcagctaaaatttgctcacaaatatatatctcgattgggtaaaaccttacgcccatgtgactattgttcagcctaacagttcacacttttggtcaggcttgatgaaatataacatagcaatttttcaactcttctccatttcaaccacacaatggtacatattgttggcaacttttttggcaagtagacaaacataatcgcaacacctaaacgctttgcggtgattgtagagtcacaaatcaccctaatcactaccatatttcacatgacaacaaatgatccattatcattacaataaatttacgtcacgaaacatgagcatatctattcacccaacaaataacataccaactctacaaaactattttccgcatcactagcaaaccatatttcagctatttcacaaatcttcgtatctcaacaaacatcaaattttcacagtgtatttgacctaaacccgataatttttttattttttcaatttctaaactatttttggttttgtcctcaaatttgaatttatcttaccctatttttaaaaaaaaatcttcatcatctgccactacaaatcaagaactacatccatgattttttttctttttttattttttttggaatttttaatttgctcaaatttcatccaaaccataccacggtaaaccgttaccgtgtcccagcataagcgttattaggtaaaccctggcactgttagagggtaaaacgccgaaggttggctagggtggtgacacgtggcgtgctgtgggtgtggcagaaaagatgagcacaaggaggcgatgtggcatttcggatattcaaaatacataccttagataatttgtttgataaaaagaattacgcgtttccacatactgtattgttgagcatttttaatttagaaaatatatcctatacacacaagttccccgtgcacaccaactaacaaatgtcacaaaaaattttagaaaaaaatggacacttactcctaatagtattacacatatatgcgaagtcttatattgaaattcattatattatagcggtaacaaagatgtgaaaaatctaacagttttaagggtaaaattctgtcttttttgttacgtctaaaatataatgaatttgaagataaaattttatacataggtataatactattgaaagtatgtgtttaattttttctagaattttttttaatatttgatatttacgaagtgtgcatgaaagctcgtgtgcacaagatatgttccattttaaatttacaggattgataattaactttgttgatgtaaaattagttaattaatgtggccagacacgtcgaggggcacggcggcggagttgaagtcaccgatcggcgcgctccacggcaagggcgtgcagacgatcgccaacgtgtcgctgatcttcgaggcggcacggccggcggccacctctgctgggccccccacataatctttgtaatcacatcaacgtgaagagcacaaaatctcacacaaatgtcaccattaacatgtacttccaccgtttcataatgtaagtcattctaacatttcctatgttcatattaatgttaataaatctagacatatatatcattctagattcattaatatcaatatgaatgtgagaaatgctagaatgacttacattgtaaaacggagggagtactcgcgattcgcgaatgcaccaggtgctgtagggtagtaggcatgctcagcacttgtgacagaggtctgagaaatcatacaacagaaggtccatcatattcctatactgctaattgttcaagctggtggctcgcaatggtgacatgatattattctcagaagtcgcaagtatgacctcaagcaggtgatattgtgtgttacatcatacctcctatacattgctggatggaacccagtaaaatgaactcattgcaatagcgggagaaggctaggggggaaacatgatatgaagtgaaggcaccaaacagctagcggaatagagtgcaacttggcctccatataactgcctacagagcctatctatgtgctagccaggtgtttcaggaagtagtggattagacactcccccgtttgtctactcttcttcaggattaaaaaagaaccagatctaggttttactttggacgtttgcggtaaggatacatgatatcatccatggtgtctttaatgtaggccccaactttatttaagttccttgctacaccattagccacaagtccagcattcctctgaaatctgcaggttcatcgggaaatccgtcattcattaaattttgatgccgatcttaagggatctaaacataatctaaaacagaagaggaactcacttggttaagaaatcatctcctctctgtgcaggcttatatcgccgtggttggggagctgcagtgttatcaagataagttaagtcttcaagaatagaaatgaaatgtagatactttggacagttactcataacaaactcaaagagattcatattaatgcaatttccgaagtgaccagattgtttcaccaataaagtcaggaccagtctgagatccagtaactccgattaatgagaaattggtcatacaagtagtggccaggaaacatttctacacaaccgtgataaaagtacagtgtgctaccatgtgtgcaggttggtcacaaagggtcaacaagtaagggcaaaattggtctatcatgataacatttggcggtttcaattttacacaggctcaccaaaaataatagggataatcaaggaggcaacattcgcactcgaccattgttgtgcactaacaatcctcattcaaagttttttctggagggaacaggcaggagctctgccatttcattgataggagggaaacatcagttacaacgctaaaaaaaaaggcatactgtgtagaattcaggtatatgtataataggtccaatatctaaaccaactagatgtgacaacaggcaaggctcatcaggtagaacacaatagccactacacagacaatcaactttgctagactaaatgtgtcagtgattagcatactgtggtagaattggtgttgctgttctacgtgctagtcaagcaataaaaataaaatatattcctaccttcctttttatggtgagatgaagcctgattagtcgaagtttttctatcagccaatagctgcatgggcatttgcagtgcaaaaagatcaggaaaaaacacaaaagatatatatttcaaatggaataggcgaatagcatgggtagcatctgtttgtactgtcgttcataaaaaagaaagaagaagtctattttgtaagcagaatatgaggaagcaagctaccacgaagtctaaccatttgtacatactacagagctaagttagcacactgatacttttcacagcatgtctgaatcatcacaataattctttatggtaggagaactgtttcataactgcttactctgcacattatgtcatactaacatgctccaacatgtgaactgacaataatgtgtgcataggttcagagcaataacatggttaagtgggaaatacctcgattccaacacaaataggcagttgcgggtgcttgtcacctttcccttcagaactcttcttgtcatccagatacatggaatagccgatacatccatatctgaagtcggaaaggttgcgaccttcctggatagcttccatctcaatttctccaaccatgtgatcagggactgatgcagaaacatagaacagtcagccaatgccaaccattgcgaccgaagaaaacaattcagattgagcatttaaacaatccataaaaattaggccaacagttaagtactccattaaatgacagcaaattcagagtaaatgacaacaaaacatttcaaaccaagcaaggagttacggcgcagtgcgatggcatgtaacactgtccagatctgcagttctgctgctattaggcattagcagtggcagtggcatgctaactagcaacaagtcaggatgaatacaaatatcgatcgtgcgttgtggtgtgtggtaaggatcatggttacttccaaaagttacagttgctactatgaccgcgccaatccagcagttgcgattgaacatctacgttccccattgttcctgcgtgcgtgcgtgcgtgtttgcagggtcactggaataaggtgccagaaaaagctccggcgctcggctcagaggcagccgcggctgaatcagcagcagaagaagaaaccctagaactcgtgagaccctaaagctagcgcgcagtagcatagcatatgctcacaaatgaagggaggggcactaccttgggggatggcgcgggtgatgccggcgcagacgggaccgcggtctcgcgacctgagcgacgacgagtagaagaggtagcccttgcaggacttccccttcaccgccccgcccccgccccctgccgccaccggcggcggcggcggcgcgtctgcaccccgcgcctcgccggctcctcctccgccgccgccggcgacgcgctccatgccgggctggcgggcggcgagctggagggatacgcgtgtgcgggatcgggcaccggcggcggcggcgtgaggcggcggagttgggaggagtggagcggggggcttcacctctttggctactccaacttccgtttatttaccatttcagcctcccaaggaaacataatggatgagatgagcccgtgtttgtgttgtgatttgtgaagcattcccttttcttttctttttttttgacaatcgtgctttatttaatttaagttgcaattgtgattttgtccctttttttagcgtttgtgattttacttttagtttttttaaaatgaagctttagtttgcccctgctttagatggcgttaggtgggtccagattttgtaagataataaaatggataaggtaaagaaaaaaatgtttacaaaatatagaaagaccattgtacccctgtaaaaaacacttaccagttaccaccacctaagccatccaacccattctcctctcccattccaaacaggtggatgcaggcgacggagacagaggtggcagcaccggagcaactcacgagcaggctgcgacggtggcagcgctcgccggcgtgagcagcggctgctcggtagagagcaggtggtggctcagcgacgctgtagcaggggaaggggtggcttagcttggctcagcaacgctgtagcttgctgcgaacatcgttcagagtaggagcagcaacaaggacacacgacaagcaagctcatccacgaggccaatgcaagggatgctgcctcctgattttctttttttttccccatctcatagttgagagtatatatttgggagaattttgtttggtaaatattttttttcctgtgaatgcgatgaatccttggtgaattttttgcgccctgtgcaacttctgtaaaagtgatatccaaactctatcaaaatttgtcaagtttggtcaaatttgagagaaaatgtgaagggtatatatgtcttcttgcagctcatttgacactgttagttggtcttaacagagtaagggcaaattgaaacttcgtttgaaaaaagtaagggcaaaatcacaaaccctaaaaagaaggggtaaaatcacaattacaatccaaaataggggtaagaatgtaattgtccctttctttttccccttcctttttacagtttgaaatttcatattgttttgtatttgaagtaaggatgtgtaatctaaaaacggcaaatatacaaagacagtgtatgaaaaagagcactagattagaaatgtgcatcaaatcgtacagtagctctctccttttcagcttattcactgaatcatttattccacgctctagaaaatattgtttttcaaaaaatctatcgcattgattaaattttagatttttgttttaagctatttagtattttgtattaaaataattaatttatttcgataattataagtagataatccgtgaactatgttcaaccattcatttgctgacaattggcttcggccttgcttatgtttatatttaccaatcaaaatatgaatttttaattttaaatttaaagttgattttaaggttttttatcgaagtttatatttcagcctttgtttttaaatcgttaagaacacgtatataaaagtttattcacattttttttggcaaatattccgttttgcttatgcttaaaatcaaccaaacgatggcttccaacgatacatgggcactgaatgatttaattcagctgacagaaaccatctctttgcatatcatagtaccagacaagacaaacgatgaggttaattggatggaaaggaaagcacgcccattatttcatcactgggatcgaattaaacaggcagtacagctggtatatctgaattcttgtttcaacaaataaatatcatatgtacaaaacgtaagattgcaggatacaattagttcctgtacaatgagttgtatctacagaatgaatacaaggtagtgatgcttatccatgctgagcgctgcggatgcattccatggccagaaccaagcactgtcaatgagttaacaaagaattagtctcagagtcacaaaaaaaaatgcagttttcgatcaggcaaaaacgactaaatacctttctagagtcccatttggagtagcagcactgtctaaccattaatgcagatgcggctggatatgcatcaccatcagctgttagcactgagattgaaatttttgtcccgtttcactgttggtcagtgactcagtgttacagattttgcatactatgtgcagcaaggacaaatacatacctcatgattgaaagagggtaacagttgcaatatatccatttttcatgacctgttaatcagtgaaggcagaacaaacggtttcacttctgagtaatgacaatacagtttgcacagggaaaactctattcttatttgattaattaaaaaccacctcaaaagcaatattctgatatccatagacaaaagttgacccaaatggattattcatggagccttgcgtctggattgctgctcgaccacaatcaccaaggatctcctaatataacaaccaaaatagatggttttgttaacacaaggcaagggaaaaggttaaagagacatccatacttggtcaaaaaaaaaaaagaaccataacaaaaaaacagcattgtaactcaaagcatagatacatttacagcagtcataaacagaaacgacattcctaacataagaactttggccattatgtttatctggaagaataaattggcattcactattcaaaaataaagggatctctcataaaataacctaggaagttaaggagatataaaacagaattgcaacagaagatgaacacaatgttgtgaacttgtgattaaataaatcctagttcaaagcaaagctgagcttgagaacctatctattaaatcaagacaagacaattagtatcttggcagtgcaaaagtcatgtcaaccaccataccttgacttgttcccactttgtgcgaggcgttatgcaactcttagggatactaccaggctgatctgtcccttcagctgatcaagacatatagttaataggatgtagttggtttcttcacaacaaactaattctacagcaagtagttcagaccttcggcatcatagataacaaagttacacttcatataggaattgaaatctgaatgaccagggaagtttgtgtgtaaaacaaacttctttatcctgtgtgtctgcaaggagaaaataaatgtagagcaaggttagcaagcattttgagtctctgaaaaaaacatgccctttgaactgcagacatccttagtgtaagaatataaatacctgcccatcaaataagatatcaataccacgagagaagtagttgtaaaaataatccccacaaagagttgtccgagggcgggggtctgatgctgaatgtattaccatctggtcaacctgacagatgggagagcaaaatatggtttgcagatgagagcgagtagattgaattaaggagcacactcctttatattgaacacaaggtgccacatcatgtttttacaatatcagaaaacagtatgcaatagtttggaaaagagttcttttgacatgcttcagtgaagcagtgagttgttgtctaatttcaacacattgtcgtctcctaacaaagtaacagtcctatgctatcccagcacccaaaagatatgccatgtgaaaatgggatgccctgagatcttgtaagggcatacatactcattgcctgtgtgcccatgattatgcatgcatggcatgtcatagcatattaaaacagagaagatctgtgtgttctatagcatggtcagatgttaacaggagctaagtacacgataaatgtggaagttcaaatacatgaaagattttactacaataccatacttcatgttcaacaaactcaatttagagcatattatttgtgtgaaatagatattgaaatatttacatgctacaaaacatctacgggaatccatattgcaatggtttcactaatagattaaaaaccgacctgcttctggtggatgccacatggacgacccaactcagtccacacgtcctgccagagatgccaaatcaagaaataaataagaccatcgcatcaaagtggtgagaaggggaaagcagagagagatagagagagtagacggcataatttgctacctgcggtgatgcaccgaaaggaatatgttgcccgcctatcgtgaacaaaagctcttcaccaagctggaaacatgataatatcctttttagggatgccaaaagattatatggagatacattttccaaaaaaaaatataattcctttttgttccatatgtgcatttgcttaaagaaaaggttcctgggtaagagatgagggttgtgaagtatatatatctccttggtttctatacaactactaaggctgaaaatattatcgatataatatggtgatatacctttgcatgcacttcctccatgtacaggctgcctgcaggtaatgcaggaacaactgctttatccatcagtgatccaaccccaaccttgctatccgttgaactgtcatatatagaaacccggcaagtaacaggagttgttccgtcaggaaattccagaggcaaatctgccactgccataacaattagggagctgagctgagattctgagaaaatataagtatataggacaactgaatattgatgcttgaataattaaatgtggcaacttggcagcagtgtaccttccccattggtaaacaaatttgtatattgactggggatagggaatgcaaaggataacccctacaagaaaatgtgagtaagatggataccctactgatcatgagaagaaaaggcaggaaaaaaatgtaaaagaataacacaaggcaggctacttgtcatgacgtactggatagaagagggtgtaaatgcccctctctttgtcatatatacccgggaaagtaggtccgaataatccataaacagccacaaaagtggctaatgttgatgggccactgaaagagaaaaggagaaaataaaattatcaataacatagcacagagagttgggttaaatggccaaggtgattcagtgaaacgagtaaacatgccaaatattggctcaacgaataacaagctcctcacccaattaaggactttgcatatcgcagttgcagtcttttcacgtcatagatctcaatgagacgaagcctctgtaaggggagaaattatctttatcacttgcttaagtacgctgaatatgtttcaccaaccacacaagttcaggaatagcaattctttttggcgctaaaactagattattttttttcctagagtaatgactttcatgctctctaggatctgcattacactttacaattaatcagaatacatatatcgctccaagttcaattcgatcacataagaggtgcactacagtactctatattcacaaaaacatttttcgtattaacatgttaggcacaaattagccgaatgatgcctgagatgtaaccggactaccaggaaatcaaagcacatgtttcatgtttgtaccatacaaacttacctgtgaccaaggatcgaagcgcaggtggaacccatggtcaggaaagcttatgacaaaatccaactttagaggctcctgaagccacagaaacgacagcaaacaatcagttgagctttactggcggcgcatttggtagcaaacagagccacacgctatcacgaacctcatcgaagtacttcacgtggacaacgtcgtagagtgttggctggccctctatctgcgcgaacgcatcggaaatcggcatccctgcagcagcagcagcaatcgcgacctcccacgtaagaattcaccagccacagaatggaagcccggcgattgcttccaacacaagcatatacatatccgtggcaaagcgagaggaaacaagcaagcaaccgacgacgacggcgatcccaaccgtggcggaaggtgggtggttagggttgggggggaggaggagctcaccgagggtgaagggcccgacgccgttgccggggcggaggtcgagcgtgatggcccccatggccgtgccctcgcagcgccgcctcaccggcaccgtcgccggcgacggcggcccgacggccccc

SEQ ID NO: 43621 - DNA, 8461 bp, Oryza sativa
gtcagactgacaggtggggtccgagtagtggtgggacccggtcctcagtgagagtgggttacactgacaggtggggtcggaaagagtggtgggacccagtcgtcagtgagggagttttgccgtcgcttcggtttcgtgaagaggaagaggagcgtcgccgcccgccacgaaggttaagtaggtagacggtggagatcgcttgtgccgccgcgtgcgctgcatcggggcaaccgttggatccgtgccttccaagactcggaatcgcaacagttggattcaggacgaaccgtttagggatagagaaaaattcacaaggatttcatacgaatacaaacatttgcgccatttttaacggataataaaaaggcaacggcccagagttgtgacgccacgctgacaaccaaatgcaagtaggttggatggatcaatcgaacgtaacacattaagcagtttatgcttgactgaaagataaatgatgcataggcatagcgatgtgtatgtaacaacaatgcactagctgatggaaaaacgaaacaaaagggtgacagaccagtggcttcgttcttattgatcatacaacatgtcgattgcacgttatcaactggaaaaagggaaattaagttgtttgcaccctggaggtgctaagttctgctcctagatgcagcagggctcctgttcatcagtcttcttttccatagttgtagataatctcgatctgcaggagtcatataatcaccttataaactgattgcgacactttgatgcacgaaacacaaaatcaaaggaaaacaatgtgacagcagcaaaaccggaacaagtatggcagcaagtaaatccttattcataaagctaaaatgcatcgcaaactgcacagaatttgcttcttttcacatatgtttatccataaaactaaaatttgcatactattcacatatgcttgtcaagttttgactgaagcatacatgccatataagtaatttggatacaactggaacaaaatactctctggtagtaccaaaagaataaaaattgagctagtaaagtggatggtgactaagagaatgcagcaccaaaaccagaacaggcaacttaactaaccatacagtttgtggcagttacctctttattaatcagtttatagtcacacatctaaaagcataaaataagatttagaacaaagagttatgtgtttcgacaaacagagatgtactccaatgtggactaatgtttgaattaaggtgatctaaatctgctgagtaattttgttaaacatttagatacaaatctccaagaaaaccattataaatgacaagcactacatcaatttctactaaggacaagcaaatattggacgaggaaaaggagtcaggcatgataagataaaaaattatgaatttatgttcttacccctttaggtggaggagggtttcttgtgaatttactgccaccaggagcccatgggactgcagagattcgaacaagcatataagaaccccaccttattgatcacatcatcaagggcatcataatatgcctaaaacatactactaactcctaagggaagtttgaatatctctagtacaaggcagtagtgtttacagcaacggtgaatacaaagtcagtctgatttgtgagattcacatatcagctcattgcaccagtagtccagtacattgacttgaaactagcaatacatctcagaaacagctgcagccttttagtcccaactcccaagcaagttggggtaatcttaaacaatataggtagaaataactatgagctgaatggtgatttggcattgccatttgaaagataataatctgtaaggcagttactttatagaagcaaatctgtatggcaccgcatacttatcagcagggatgttcatatatggttccagtgaaaccgtgtaatcacatcagtggcaacgctaatcactagctacttttgcttaagtttgttttggaaggtttcttacaaatcatagttgaacacccctacttatcttgtacccattttaagagttctgaagccttgaaagtaaaaaattaaacgccaaaccaaacagaaatgctaccatcctacatgacttaacaagagaaattcggcttgaaagagaggtttcggcagtgaaagcaaaattctccagcatttcagagcttaccaatgtagggatcgggatgctggaaattcctgtactgcgcttccgcatcatcgataagcctatcgatcacatccgggttgtcctgcaattcccctcacaaaatcaaacacacaaaaaaccattcgtaaactacaactcgcgagttcatttcgcgacacaacacaacaagcggaggcggagatgcgggaagcggaaacggaggcgttaccacatctctgttcgcctcgaacttctccctgagatccgacgcctgcgagggaggggggaggaacacgaggtcagatccgcgagcacggggggagcagatcggaaaggggggagaggagaggagagctcacgtcctggtagaagaggtggcggtggacggcccagttgagggtgtccttgagggcgcggcggtagagcagccgcaccctctccttctgcgccgcccgccgcgccaggaaccccgccgacgtcgccatcgccgccgccgccgccgccgcttgcttcctcttctctctcctctccgatggtgtggtgggattcggatgcggaggagaggagacccaactgacaggtggcccaagcggaggagggtggatactggctagcaaggccttgatgggctaggccttttgtatagtagtgggctgggctttagcacacagggtattattgtagttgggccaatttttgatggatttgggcttctactaatctggtaaggacctcattgtaaaccacttgtattttcctttatttttttatcttttcttacatttgtgggtatcctagcgaaatccgtaaatatttttctgctccctccatttcatattacaagtcactttgatttttttcctatttaaatatgtttatgtttgaccaagtttatgaaaaaaaatattgtaacagttctaatacaaaacaaacatgttctcaacatatattcaatgaaacattctaaaaaaaacatatattcaatgtaccacaagctgatccttggtattgcctggcctctattcaaaataaacaaattctccaatgacattgagctactaatactaagcaatttcttcagacagaaattctcaagaaaaagaggagaaaagaactcatatgagagtaaagctgtgttcgctatgggttgttcccaacttggaacagtagcatggaaaacggagcgatccattagcgcgtgattaattaagtattagctatttttttcaaaaatggattaatttgatttttttaagcaacttttgtatagaaaccactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtgttaccaaccgggactaaagctagagctgaccttttttttttgcatgcccctgttgctgcatggtttatatatatatatatatatatatatatatatatatatatatacatatatatgcatacatatatatatatatatatacatatatatattatgcaaagcatatgtatatatatatatatatgaacaaaatatatttacattatagaaaatgtgtacacatgcatatagaaacatatgtagtcatgtattaattacaatccattatatgtcctagctagctacggtttcgacgtagtagtactcgctgctagctcagaagctaaggaccagtgaattgtgtttccgtcgtagtagaattcacccttgggatcaaggatttcttcgttgatgaatcccatgagttgttcttgaaccgccgcgataaattccaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccctttgccgcggaccaaatgatggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgtttttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgtcttcgaccaactcaacttcgaccttagagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcaagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttctgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccacgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacagacgactccgacaacacgtcttttctgcaagataaaaaaaatgtattaggataaatgcgaagtaacatatatatatatatatatatatatatatatatatatatatatatatatattgcatttcacgttaacgttcgtcctcgttcgttcgctcgttcacgttccctagctcgttcacgttcgttcga

SEQ ID NO: 43622 - DNA, 12796 bp, Oryza sativa
  unsure (1)..(12796): unsure at all n locations
caaccgggagtaaagaaaagatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaaccgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccgttggcaccggaacagaggaaccttgagaggaccatagtcaagttcccatatgtcctcgatggcaccgtaatacgtggcagttgttccatcgtgtcccatggcatcgacacgaacaacgctgttttggttcatgctcttcatgtcttgggctctcgtgtagaatgtgtacccattgatctcatatccctggaatgtcgcgatagacccagacggtcccctcgccaggaaggcaagttgttggttgatcgactcgttacccatgagatgttgtcgtagccacgcggggaaagtatcaatgtgatccgtgtaatccatgcatcggacttaccgatgttcctggcgcgaactagagccaagtgctctcgatgtaaggagctaccaatgaagagtgttgcagaacagtgaaatgggctttacggaataaattgttgtctaccgtcattattgctttccttccgagagttccctttccccgtattctcccttcatggcgtgattcaggcaccccgattgggcgaaggtcttcgataaattctacgcaaaattagatgacctcctctgttccataacccttggcgatgcttgcctctggacgagcacggtcccaacatacttattcataacgcccatgtacctctcgaaaggaaacatgttgagtaggtacataggccctaaaatacggatctctttcacaaggtgacaaagcagatgcgtcattatatagaaaaataaaggtgcaaatatcaacttcaaaactgacgagacattgcaccacttcattctgaagggcttctaatctatccggatcgatgaccttctgagaaattgcgttcatgaatgcacatagctttgttattgttgcccggacattgtctggaaggataccccttattacaactggtagcagttgtgtcatcgacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctatttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgtcctttccaaatnnttaaattttctgtagatgtttcgccactgcgaaccatcggcggggtgtctcagcatccgtcctgttgacgctcttcagcgtgccatcgcaacattctagcattccccttgttcctgaacaaacgccttagctgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctagttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccagtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtctcggttagtagcaccaaccggggctaaagatcaccgggatctttagtcccggttggtaagttaagatctttagtcccggttggtgctaccaaccgggactaaagatcccgggggggcctgacaggtcctgacagcattcgaaccgggactaaagatcaaatatgcccgttacccttttgaaccgggactaaagatcatcttttgccccggtttttattgcatccgggactattgtggaaatcggccgaccaacgaaagatggtttctccaccagtgaactttttgcaaaaaacacaccgtttagcagtttgaaaagcgtgcgcgcggaaaacgagggagataggttgggaaaatggatgtccgaacacagcctaaattatcaagcaaagcttcggtaagtctcggatttctatgtagtgccagcttgtttcaacaattttcagatttgaggttaaatattttcttttctttacaagtcaggaaaaaagacggcgacacactaactaagctgtttcccgctgagtcttcatatagttcgagatgataggatgataggtcaagtcagaatagcttgactagactatgattctgcgtataacaagttcaaattttcaaaccttcaactgcaagtttgatgtacatgttgtgcagaaagcatgaaacaagattaattatagacaggccacccattcgaagtctgaagacttggagattagttagtctcgcctaatttttattatattatattattagcttttccaattagtcaaaccttaattaaggagcacagttaagagcctaacctatatattaacaccacagacaaagccaggagattgagattgctgtgacagtgactagctagcaacaatgcaacataagaggagctagctgtctagctctcttccaaatcacctacgtacaatgatattgatctcacttgtattcgatcgatgaactaaataattaaggcaatgttaaggtatagccttcactcattgtctgcgagtaaaatagttttgctaatccttctggatgcctatttaactaggatgcagaagtttgatgttagaaaacttagaattagctttctcccatcgaaggaatgaaagtcagttttttcttttgtgatggatatgtcgtatgacattgaacagtcatgaaaattttcaaccggattacagaaaatataccattaaggctaagaggccttttacagtggtgcctctaagtctaaacaggaaacaaaatcttacagcccaaaatttatgtcaaattaaacacattttttttcttttagatgcatgtgtactgaactgcatgtggcctgtgcagatgtcgaaaagtttgacatacgaaaaaacgtactgtgaattggaaaaatgaaaccaatatagctgatcgatgcaatgtactgttgaagtcaaagttttgacctagtcaagttgaccttagtacatcaaatgctcttagacaattatgctattttcgtacaataatgttcattggacatccctattattgtaaatgcgtggatgttgagatatcagatattgatagtttgaagacagaaacttcaaatttctcaacttcatagtcatcttggcagtattggtgaatacttgttgaggttgttgtctccagaatataatactacgtatgtagcacgatgaataaacaaaagtcctaataacatgctaacctttgactatatgccagtagtcttatttgtactgcaagagagatatttagatgagaaacacaaattctttggtctcacaattattttttcaatccttctatgtttaaagaaaaagattataataatgagcagatctatatggtaggtagatcgagatcggctgcaccgtcatcttcaattgactgaaagtttgtgtacttatcttttttaagttaaggaaggagaatatctgcacttcccatcaagatgaaaatagttatgaacagtacaagctaggaaggtgaggcaataggaaaaacaactgtagcacatccggcaaaaaaaaatataaaatgtgacttgtagtatttcagttgctgtctcttttttttttccctggtgagagcaattttcagttagtgcagtttgttcagtgttcatcttcctcaccttcacaatcactagcaggagaataatgtacatttatacatgattcaaacgtacatatgtgtacatggtactaaggtagtggtagtagacttgcagtactacagctcatgatacagtgcagcatagtggtatgcagaatggacatggtaccagtagcccaatttatgagcagcagcactgcctttttttcttctctgatctagtagcaacatttactcttgtggcaagtactgcttcactctactatgggcctgtttagatccctgtcaagtttttttcattctatcacatcaaaatgtttggacacatgcatgaagtattaaatatagataaaaaaactaattacacggattgcatgtaaattgtgagacgaatcttttaagcctaattgctccatgatttgataatgtggtgctacagtaaatatttgctaatgatgaattaattaggcttaataaattcgtctcgtagtttacgggcggaatctgtaatttattttgtttttagactatatttaatacttcaaatgtgtgtccgtatatccgatgtgacacggtaaaaattttcaccacacgatctaaatacagcctatgagatggttcattgctggcagactggcatgcaaggaatttctcgagcaagtgtcaaagctagctctgtttgtccaaccaaaaacaagttcagacaaggatgccattgcatatttcgcattgtccatcgctgcatttactctgtggatggcaagttgggtgtgggagatttaactcccggacctttcatgatctgctctgaataagcagcgagaaaaattaactaccacaggctcctctcttctgaatcttgctgcaggttgggtcttgtttaatggcttggaaccttcatctgtcagtgtctgcaactgctaatgagcgccaattacgagcagctagcactgacaatttttttactgcatccaatggagcagtaggagtattatatggagtggtgtggttgcagtgtcagtttgttaattatgcagatggagacgaggagatagatgcttctgtaatctgtagactgtgtacctgcttccttctcttcctgcctgtgatagtgtgatttctttactcgttcgagttcgtcttctcgtagtacgcctcttcctgctggagttttgtgggtgcaatgcaactgtacttttgcctcacagttcagacacaaattcagaattccagctaacactgctgactctgcctgaatctgaatccattatcagcagctcatctcagcttttctccagattttgctgcgtgcatctttttctctggattaaaatgttgatagctgttcactgaaaatgacaagccatgaatcatcagcagaatacctggaaaattatttaaatagaagaaaaagattaactgaggtacagatcgatgcaggtggtccctgatgcagaaaacggactgaggcagctacagttgtgtaaattattgcacaaattatcctattactacctctattcttttttacttattcttttggacatcgaagcaatctccaatgcgcatgtcttatcattatcattttccctaattatgtatttataaaatttattgaaaatataaccgtatgaaagagtttttcctgacaaatttattagtgcattttcacacattaaatcctaatatttgtaatctattaatgatttaagagttcaagatttggttctacgcatttaagacttcatcctttcgagaacagaggtagtaatcctattgcagctacactggtgtgaaaaatctgttgagcaggtaaaaacaaacggctggatatgtagtcgcaagatttacttttggccactgaaatgagcagccactgattaagacgcttaacttgttcttctgctagaaaaaaaaaagtctagtccagtttcgtgcagtttcagtaactcaactgatcaaaaaagttgtggctgttagaatggacaactgtggctaataattcctcgaaattaggacagagtggatctttcaaaagaaaatattaggacagaatggatcttttcaaactatacactgtggttcttcctgaagcagatgccaaaggtgcgagttttcgtcgcgaaaagacgctctcaacctaattgctgatggaacttagccatgtgcctatcatggatttaaactctccagacatgataattacatttttcgcgaatggacaaaaggcttgtgtgttgatatattaggaggattgaaaattttgtactattaattatacatgatgtgatccactcagcggcggccataggggttggggagagaggaaatgaagttacaaaataacgtgaatattagggaaagaactaatatcaaataattagaaggggtgaggcttcgaacccaagttgcctagcccaccaccttgtgaagctagtcagaaaacctctagtcatttatgagagcagaaatgaagttaagggctaattgaactaggaagcactattacatcaagcgtgaatatgtttagctgtgtgcatcctaactctgcataagttgttgaagatcatgtaatttcgctccttcttgtggcacaataatttaacacattacataacaatcttcgagtaataataataataataataatttcgttaaaaaccaaaaatggaaacactcgacaattttgattcccataatatcattgatcgtctgtcaatacatggtactaatcaattgtacagtgtggcaagtgtcaactaaaagaaaacaataaagctcaatcgacaaatttgctggcaccattcatggtgaggtggccatggctcacatagtcacatggtgtgaaataatgaattttaagcttggtttggactacattacagagacaaacattgatctgattcataacgagagggtaggtcagcaaaatttatgacttctcaaaggttggcgcagctcagcttcgcagtccgcattcaaatccaaaagaaagaaaatttccaaagccttcaaatactatacctaaacgcggttaggcgacatgaatatgcttaaatatgcacacagatatcgatcatatgatccaattgcagctgcaattatatatatgcaagattaagaaatgtgttagcatcaaaagcttcaggtaggcatacaaaaagcatgccaattgcatcatggatgacacattattagatacaaaatcttaactacgtagtattatacaagtgctcaagtgtcaccgtcagtcatcaacctatccacagggattacacacgtgcttagctagtattcatcaccagaaagtatctaagtacatgccttgattaattaatagtccttataattttatatattttttattggattagttcgtcctgcagcgtattctgaccaagataaaagtacaaaaagaatatgtattctgaaacaagatgaggtcgtgttcatctacagttaaatgtagtcatcaggaaaggcttggtgcatactctgtaattaaaaatttcagagatattccagaggagaagaaatattggacccaaaggatattaatgatcctctaagccctggttagcagcagaagaaatcttctcctgtaatttctttcttcagattaatgcacagaagcttgtcatttggcaatgaaaggggcttttgctgacagcctaaaaaaaaggagataagtacagtgctacactgacaatgatatggtaataatcaagccttttggataaagatagaaaagcatgcagacagaatataaaaccttttgccacttctgcttatttttcactcccatctcctgttgtatgatcccacacgcgatgctaagcacgaagtaaaaaaaaatatacttcctcagttttttatgcacgatatcattgacttttagatatacgtttgaccattcatctatttaacaaaaaattacagatatgccaaaaataatatacaacaaaataaataatgagtacatatttttttaataaaacaaatagttaaacatatgttgaaaatcaatggcgctgtaagcatctgagatgatcttgtcttgaagaagggcaaaatctcttttgaaaaggcacatggttcttcctttccacagtagatagcaaaagatgaaatcactggttgcaacaggtcaagctgccgctgtcaatctatcaggcctcttttttttacttgttctatcaacctgttcttctgtgatattcctaaactcctatggtagcgaaagctaatcgaatcccgtcagacaccatcttatcagacaaagcttgcaatctagtactctactactatatggcaaaaatcattttgtttaggggatggaatccctaacttttatgaaacataaaagagtatatgattctttgaagaagctacaaattgtcatatacaatttatttactttttaaatgtcaggtggtgcatggacacattcaaaacctgtatcatttgcacagttgaacttttcatcttgcaagagttatttacatgacaattcaaaggttttcaggcctaacctgccaaggaggcaaggctctcaagacttggtatcatatatttaaaacataaattgttcaacggatcaaacaattgttggcgagtccagcaaaacatagctctatgtgtttgaatcgaaagagtcaaaaaaaccgatctttgattaatagcagatagaaatgtcaacacgcttgcatcgaaggcacgtcactgcaagtgtcttcatgaactgaacacatcgaaagatggaaaagatggagaggaagattcagaaacgaacaagactcaccgtgcggtcaaattccaggaacacatttgatccggtctttgaatgcactttagaaatcaatatatgcagttcgttactcctcccgaaaagaactcaacgaagtcgtattatgctcgaaatgattactgcaacactgactcttctgaaagattttcaggtcatgcaattttcagtacatgcctgaacctgaattttcagagcaatatctgaatacctcatttttaatccaagagctcctttagaactctagaggaatagtttgtttgtgggctcatcagctgcaacaaaaatttgaatttcgaacctaattttagagttaattttaagcatttttcgtcgtagtttatttttcagcattgaaatttaggggttgttctgattatagtcaaaataaacattattgtcaaatttttggcaatttggtaatatcgccaagttttggcatgattttttatgtgtttactaaagtttgataaaaaaaactaaatagacgcaaagttttggcaactttaccaaaatttggtatggtttaaaatgacataaatccgaacaaccccttagtaaatcgctaagaagtaagaacacatgtataataatttacccatatattattatatctcgttgcctcgttcatcttttaaggactagtaatccatttcattaaggtcctgttcatttctccaataagagtcggatgaagttaaagatttttgtagcacgcttttcaaactgctaaacggtgtgttttgtgtgaaaactttctatatgaaagtttctctaaaatatcatattaatctattttcaagtttgtaataatttatacttaataaatcatacgtaaataccacctcgttttacgtaaaaaacttaatcttcatcatcttcattttctggagaaaagaaaaccacctaaacc

SEQ ID NO: 43623 - DNA, 64159 bp, Oryza sativa
caccaaacacccactccccccaccacccacctcccgccacgagtccacacggccccacctgtcattcaccccgtactcattcattgccacctcccctttctcccccttttccgtttcccacgcacggcttccgtacgcggcgccacgaacgggtcactgacgcgtgggcccaccccctcgtgggacccgccaccagaaaggcgttacaataaaaaaatatttcctggcacttttgcacattggcccctgggaaaacgtggaattgacagtcgcctccctggagtgatgtaatgtaagcccgaggtgaggtgggggaggagagagaaattggtaacgaacgccatttccgatttctctctctctctcctcttcttcttcttcttcttccccaacgagcgactcgcctccacctcctcgacctccacctcgcgaggcggcggtgcggggggccccaaaccctaaccctaattccgctgcgcccgcgcccgcgcccgcgcgcgccgacaggctgttgttgttgttgccatggggcagtgctacggcaagggcgcgtcggggaggacggcggacgatgagggcggggtggtgacggagcaccagtcgccgccgccggcgaacgggctgccgtcgacgccgccgcggcagcaggcgcaggcgcaggcgcagcaggtggggacgccgaggcggcgtgggagtaagtccggatcgacgacgccggggcaccagacgcctggggtggcgtggccgagcccgtacccgtccgggggcgcgagcccgctgccggccggggtgtcgccgtcgccggcgaggtcgacgcccaggaggttcttcaagcggccgttcccgccgccgtcgccggccaagcacataaaggccacgctcgccaagaggctgggtggggggaagcccaaggaagggacgataccggaggagggaggcgtgggcgctggcggcggcggtggaggggccgcggatggggcggagacggagaggccattggacaagacgttcgggttctcgaagaacttcggcgcgaagtacgagctcgggaaggaggtggggaggggccacttcggacacacttgctccgccgtcgtcaagaagggcgagtacaagggacagaccgtcgccgtcaagatcatcgccaaagctaaggtcagagctcgctgctgctggtggtgataagctgcttttttaagctctggttcacctttttgtttcatgaattcaaaatttagttgttgccgtcgcgccatttttgaagaaataactgaaatctaggtcagtgttatgattcgtatgatcgagattgaaggatagaagtaactgagatttaggaattttgtcttattatattatccccccccccccaaggatactggcacaaatggaagattgcgaatctcggattttgccacattagttctacattggcgattggttaatcttgctcagtttctggagtaggattatctcattcaatttcattttttttgaggagtttgtctttcagagaaatagacagtaaggttgaaccaggatatttctgcattttcctcctttagagagttacatttgtttttcttttttgactggaaacagtaggggaagatagttgcatttgtgagggacgaacagttacccaagtcttaatttgtggtgtgaagaggcttttggatgcagctagtacattgattaaattggtgacttagccaatcgttgctagtgataaatgatattctaaccaatcagcagtacatgtcctaacctaccttttttatctgtcctttttggcttttagttaaggattgtcgattttgaggtggattttcatgtgacacatctggggaaaagctgacatgaatacactggtctagtgatcaattatcggtatttttagtccatatgagacggtagtttcgaaaagcacatcataggaaagagaggttttgggtgtcaccatttgccagtcacaattcacaatcagtgggaggtagtgtcacagcaactgcaggctgacatgtactaaagacatttgaagtggagaaagatccaaggaggctacagagcttagagttgatttaggagacacatggcatatggtactgttacttaattgagtgatacaacaaaaatgggtagagtgccctttggttgttatttattgtcaggggcttcatggatcaggcactacataattcgaaatgattcatgatctgaatatgaattggcctgattgtctaccaccacaacagatattcacattgctttttaggatatcagatatgtcatagctgagtatcggtggttccaactggtttatttatggaatctgaacatcaataggcatctgctttacttttagcctttcagaaaaatcatttaattatttgaagaaaactgtttcatagtttttagaaatatttttaatacattctggatgtttgttgtctaaacagttaaatatatcacaagctaaatatttgctggcagactgcattaaatgccaaaaatctgggaccttgagataatgacaaaccatttttaaactaactggaagattcggtagcacgtccagtagccctagtgggaggctcatacggttaatcttgttatcacttatcaattagtaaccatctcaggagaccctttcttgggtcaaagatcaaaccgacatgatatttaacacacaaatggtttccttagagtttagaaattaagtttactctatgcagcgcaagtttcttataatcagtcttcaactcaacctagcagcagtttaacatgataaataatgggatttccgcagggcagctaattgtcaagtgtcctattgttgctccggttcccttgatccaactttataaaataatttataaatgaaagcatgcaatgtagtagaatgggtcctacttatcgtattatttgatttgtttgttctcttttcattgatgtgaactgcaatggtgcaagtaccttcacaacggcacctataaatttattgcagtgcctagttcttcgaactgaaacaaaaattttagcaacttacttttaacaatttactcttgtgtttggcagatgacaacggcaatatccattgaggatgttcgtagagaagtaaaaattttgagagcgttatcagggcacaataatctcgtcaaattctatgatgcatgtgaggatggcctcaatgtctacattgtcatggagtatgtttttttatgacttttatatgtaattttaaccaatatacttaagatttttctacaggcaatatttgatctcagattacttgacacgcatgcaaaatatcttgtctatgagctccacagttactttattattatctgcttttttcctattctatctactgatgtttgtgttatctactagtctactacctaccattgcagaaaatcactatttgtcgcaccttatttaatattgttaaggaagtattttccaatcatttttccttaacagattatgtgagggaggagaattgctagacagaatattagccaggtactttctacatttttctttatgcatagtagtaaactaatactatctctgtatatttgttaatccttaccaattatgctaacctgaactattgaagaggcgggagatacacagaggaagatgccaaagcgattgttgtacagattttgagcgtagtagccttctgtcatcttcagggggtagtgcatcgtgatttgaagccagaggtgtgctttgaaatcttggaactaatttatgtgtagtttacattcgtatacgtatgcagtcacatttgtaaattatacttgtagaatgctaggctatttttatgacatagttctattcttttgtccagaatttccttttcacaaccagggatgaaaatgctcccatgaagttgattgattttggtctctctgatttcattagaccaggtaataaactagtcttcatctttgtgtgtactaacatgcattccgtattaggtatggcttgtggataatcttgatttatatagactaccttggcttgttgttcatgcctattgtttacattctgtgctgtggcatcctgtcctgggctaattcattttacgttaatctgagttatctatattccaggttgacaatgcatcattcattttttgtggcttgtgtcctgatgcttttaatgaactttggctaactatttttctcttcactgttgcttggtatttcattagctgaccagacaccttgttctttgtattttgtgctatataatgcagatgaaaggcttaatgatattgttggaagtgcatattatgttgccccagaggttttacacagatcatatagtatggaagcagacatttggagtataggtgtcataacgtacattctgctctgtggcagtcggccattctgggcacgaacagaatcaggaatattccgatctgtgttgagagctgatcccaactttgatgattcaccgtggcctacagtatcagctgaagctaaggattttgtgaagagatttctgaacaaagattaccgcaaaagaatgaccgctgttcaagcactgagtaagttgtcaacattattatctataactgttgtgtagtatggcactagttgttttatttctctatcataaatcgtatatgagaggatgacacttgttttctttggcagctcatccttggttgcgagatgaacaaaggcagatcccgctggacatactcatcttcagattaattaagcaatacctccgcgctacacctcttaaacggttggcattaaaggttcgttatagattatcatgatcttctctgcatctgtaattattattttgatgtttcactgattttactgatatgtactctggctaataaatttgcatggactggctaaatgttttgttatatgcacaagatcatggctggctggctgtatgtaagatgcaagggcctagtttggttaggactgcatatcttatctcttgcaaaataattgtcagcatcatcggtgcatatgttatatactattgtcaggttgttagggatgttcatatattaaggagctgtcaagttcccaagttagtctccctagactaatttgggagaaaaataataaaatgataaaaataaaagatgaaggctgtgttaactattaactctgccaagtggaaaaactgaatatgcttgcagtatcattcctatgtgtggtataaagcgtgtggatccctttcctgtccttacatgtgctttggctaagcttttactgatagtcaagttgtgtctttcgtttatggccttgcatttttccatgtgttactgtgggggtggtatcaattagtggacatggttttgctcaaacttgtgcgttaaaagtccttgttataaatttgctgatgccagcaaattgtggtgcaactcaaccatatatttgtttattactgaaatctgagtactgtcacaggcactatccaaggctttaagggaagatgaacttttgtatctcaaactgcagtttaaactgctcgaacctagagatgggtttgtatcacttgacaactttcggacggtgagtttaccatattatttctgactacctcattgagataaaggcacacatgacacttgtcatccaatgtgcattacattacctgtaagtaaatcatagttttaacctcttaattcactatcttattcaggcactaacgcgatatttaactgatgctatgaaggaatcgagggttcttgaatttttgcatgcggtaaggaaatttcaccgacgactttaagtactaggagaatgttcaatttgtattgacctatattcaaagtacaagatcatgcaaagttaccagagagcataatttccagttgtcaagcaaaggctcatttggcatgctggatggctgtttatcttgtacatgtagtagaaattaaccatattttgattgatattgaccataatgtgattaatttgtgatgcacaacaagagttgtactatcacccttctatggtacctgcttaaatatttatattactatacgaattccatcattacctttaatgctgaaagccatatactgaatttttttgttgcaaagccatacaaccaaagctattatgatgaactgatggccattattgctttgtttgtttcttttctaactccttgcatcctgtgtttttttttaatttcttaaaatacatctcattggtggttgaagttgctgatctcagtgttgtgtatattgattctatcccagttggaaccacttgcatacagaagaatggactttgaagagttctgtgccgcagcaatcagtccttaccagcttgaggcactggaaaggtgggaggagattgctggaacagctttccagcaatttgaacaagagggcaaccgagtcatatcagttgaggaattagcacaggtatttatgatgatttccatgatcccatctgacaccacagctgccttagttggtagggtaatgtttgtgtggataatattgttgcaatttcactaccatggtttgtgggatccatggagaagtaacattttttctcgtaactataacggttaccctgaccaacctttctctgtacaggaattaaatcttgctccaactcattactccatcgttcaagactggatcagaaaatccgatggcaagctaaactttctcgggtttaccaaatttttacatggtgtcacaataaggggctcaaatacaagacggcattaagcgatttgcaaaagaaaatgtattcttttctcttctaattttaaagccgctcattatgtgaccctgattgatgttttcccctcctgctcctatccctctggtcaatatgatcattattcttgttcgtgctgctgtcggctgttgtcatcatagttttttgtagagaatacatgtaaagatcttttgtaatgaatcgaatgatatgtttgttcaagaaatatagtgtcatgttgttcttttttgcccagtaatttcagaccttcctacaaaatacaaatcatttgtccatgaatgcatcattgtcgatacatttgttagctgaatcttctctcttaagctgtcattcttcatattctgttgcaaacgagccatggtgcagactgcagagcccaaagggagattcttctatggccgtattgcagcattgcaaatgggcctgaagatggcaaagcgaagtgcaccaactcttagggctgttcatattgaaaccaaaataaatctaaccaaattttggtaagttgtcaatattatcaaaattttgtcaggatttcttatgtatttactaaattttagcaagaaatttaatgtatgtatatttttagcaactttacaaaaaatggtatggtttgaaatgacataaatctgaacagccccttaaccactttagttagatcaagcttcaatcaacaatactctgtctggatatattttttaacataaaattaaaattattatattcgtattcaaaagtacttacttatattatgcttttgtatcacataaatacttgtaattatgtttttttatcacacaaataatatcataatggactaattatcgatcaaattgtattctaatgaaataaaatacgtcctatgttttgaaaccggggagtactttctttcggtaactgggttggctctttgcgctgagaatacaaaccgcgacattcgtttgcgatgggggtaattgtctgaatcctgaagctgctgcttaaggcatcatctcagcaacgccacgttcgtgtgtgatcctcctctgaatctctgacgaagcacctggttgctacgaactcccttctgctcatggcaccatcttcatcacacgctctgtcgtcagtcaaaactaaaactgatgcttactatagtattcactattcagatactaatgacatctcaaagttttctcccatggtgtccagttctacacgcaaaattctcgtcgtgccaaacacggtcttggaatcggattatctctgcaagaactcagctccatccactgcacgccatcgccatcatcatcatcatcatcatcgctgcgatctccaacctgcaatgccattggagcagagaattttttttttctctctatgctgctctcgccatcgatcttgctgctgcctgtgtactgacgagatgaagaaacaagaacaagtttgctgtcctactcatggtgctgtcactgagtacatattctcgttttcgctttcatgggttccagaaatcgaccggaaatgggattaattctgcaacttattactgtgtttccagctgggagatggctacacacacccatctcatcagactacgacgtactccctccgtcctaaaaaaaaaaagacaaaccctagtttccgtgtccaacgtttgaccgtccgtcttatttgaaaaaaatatgaaaaaatttaaaagataagtcacgcataaagtattaatcatgttttatcatctacaacaatgaaaatactaattataaaaaattttcatataagacagatagtcaaacgttgacacgaaaacctagggtttgttttttttttttggtacggagggagtaggagtacttgtctgttcatcttatatagtattatataattgaattatacaccaaattgctttcccacttactctgttgctgtcaccgtgagctgcaatgccgcgtcagatcgtgctcggttcacttgtaaatgtcagacagagatgatctctcctatcgatcgcgtcaaactgatcatcactcaagcgagagaattacagttagaatcagaattactcgatcgatcggtgatgctgcttcagttgttcatgaaggagctcacttcctctcgttaatgaaaccatttcgatgagaaaagaaacgggccgattaatcaaagatggtctgtttttaatgatgatttcattgtcataaaaaagatgtggtcctttcaggcttcagcccacaggaaacaagatgcaagtcttttgttgtattttgttctttcgagttgttctcctctccctctccttcatctgaacttctgaaatttctgaaccagattatgcacagtaaagcatacatatcccaaattcctagtctagaggtcacagtatatgattggtgcgttgctatcaattgaagtgattatatcatctacaccctccgtcgcaaaataagtttatttgtgggtttttgtgttcaatgtttgaccgtccgtcttatttgaaaaaatataattttttttaaaaatgtaagtcacacataaaatactattcatgcatattttataatctaataacaacaaaagtactaatcataactttttaaaaataagacggacaatcaaacattgaacaaagaaacctacaaatgaacttattttgggacaaagggtgtacttaatgccatctctttcttaaataaaaatgattatatctaaatactgtgcaaaagtaccgtcgcttgacaaggttggcacgcatgatattgcgacttcttcacaaggtcaaaactgaaagagagagaaagatcgaacaactgtaccaaattctgaagcaagattcaaaaaatctaaccacttgtttaggtgatgattactcgcttggcgtttggatgaatatactcttgggaattcataccaatcgccaaattgcgaccctacctcagctaaaaactatgtctagttcacatctatggaaatggaccatatgaatcagatagcctgaacctactaattggtttgtagacgcagacaaagaagctaggtcatcagcttggatgaaccaagcagcaatcgttgaacttgaaactgaagcctccaatttcaaccctactttatctgcttcagaaaccaaaaagaaaaaagagagagaaaaactcattctttatcagcattttgcaaagaataggttactgttcatgatcactgaatatatttttgtgcatgtatatacagagaatgacagcatctttacaggagaattaactgatcgattgatattctgccattaggaacagatagtccgtgtccgtgcaatggaaccgtccttgaactgtaccttatcaaacttgtctgacagtgacgatgaagaaacttgtaaagtaaaatgtttggtgatgatcagattggatgagaattaatgcaactaacgtggatgaatacaaacctgtcaatgaaaccccgtcttaatcaggtcgacgtggtaatgtcgacacgagggtgttagtgagtcagtccgttcattttcttctatctatagctgacgcgttgttgagttctttaacacaatcattcatgatagattgatatttgatcaagctggtcttataaattgccaaccacacactaaattagatagaagggacatcttgaattcagcactttccatcaaactcttctggactgcaagtccatgagaccatgactaactgcacaagagattgaaacctcatctgaactattgtcatggacttacatttttatttattacggttgttgataaggtaccgatgggtgtcacgttttctagtgttagatatcggaggtaccagcttttacactaaaaatattctagctcctctcaaagaccaaaaaaagatgaaattgttcggtttttatacaaacggtgacaaattcccatacatgactcaattaagctgtcctaaagaatatattggaacctcctctgaactattgtcatggtcatggacttataaaatttgagtcgaaaattgttcagtttttatacaagcctggaaaattcagagatattgcctcaaagtcaacatccaggtggtgaaaggagaggcagtggaggccattccaaggcagaggcaaagattgcaagggaatggaagagtccagaatggaatccatggaatactccactacacaagatagtctcatcacgcatggtacaatgcatttgtcctttttttcaggcaaaaacacaatgcatttgtcttgttgtaagaaaaaaactatggccttcgctttgtccacctgctgcttcttttgccgtacacaaaaggatgctctccgtatcccctccatcatctctaccactgttcatgctttgtactaacaccattggctgtttcaatcatctttagttttattctatttctcccgatgtgttgaacccaataattggtgatttttcgaaggaaaaagtagttggtgccgtcgataaaccactcgattcgactgtgtctcatgtgcacttctagaggtcaataaaactattggcaaatatagagcatccctctttattctttcattttagatacggcgagatggtatactattagagtatgttcttactatatgaattgatgatattctgttctcaccttttcttaaaagaaaattctttccttaccttgatcgcccaagaatgttttactgtgagtagatgtttgcttattttacctcttatgaatagggaaagagaaggcatgaagagaatatagtacataaagaaaggaagaaacatatggatggatgacgaggtcttcattgtcagcttgttgacttattagccgcaaccaaaatttgaattttgaaagttattttgggtttttctaccatatatagtctatttttcagccttatttttaaaattgctaataatataaatataaaaaaatcataaattatttatgtttgtcattcattttttgacagcttattcagctatagttcaaccggtcatagccttaaattttgggttcaacatcattctagttcctaatttcacatgcttaatcgatgatgaacactaatgaataatgaagtgtagcttgtagaatgacatctctgaggacaagtatgctgccacatcaatggcctagggttttaatagcagctatggagagatccaaatcgaacacaactttcaaaaagaaaaatcaagcacgattctatttcattctccacattacatggagttctgacctacgcacacatacacatctctctttccctattgatcaccaaaagtgacctaccactaactagctgctagtactagagtatcaattcttgcttaattatttgtgaaaacttaatttggtgccactagctagatctggattggatttctccgaatttcgggaatgatctggattggatttctccgaatttcgggaatgctaaaaactatacacctctcataaacatgatgaccgcatagcactctgatcagtttgatttacttttacttttcactgcacgttgagatgaaaaaaaaaatctaatctggcatgttcagtggatcataataagaggtagttttgcaattaactaaaacatgtatcaatccgttatattttgggatggtgggagtaattagcaaggggagaaaatcaccaagaaaataaattaaactagattatctgtctgaatcttctgaatgtgtacggtacatgtgtgtgtgatctgcaatgcttctcagtttctcgtactgcctgtccttttggccaaacaacgtgtcctttgcttgttcatatccatccccttctccatttcctactgcggcgccgccctccctactaccatctcgagattcttctctcactctctctcatctcatctctgacagtgccaggtctatctgccacaagaagctctgacaactgttgcactactgccttcgtgatgaacggataatggattaaaccggacgtttttcaaactaaacaatattacaaatccattttccaacttcctataataattatcataaataagctatttagccattcgttcattctcggtttctgtttcaccaacaactttcaccaactaaaaactctgaatgtgttggaatgcattgggtagtgctggcgcctgtcgatcagtaggcgatttattgtcctagtaagttttcttttagagaataacgatgagtagcactaacagctggagtagctagcttagcactaagtaaattctgatgattgttgtttagtactgagagtggacaaaaccaagaaagtaagctagaatcctagaagagatgaaagaaaaaaaaaacaacatttgctatctagctagttagctggccctctttgttcttgtctatggagctaggttctttttctccactcttttggaagccaacatatagatagacatgtttaatttgtttctgaaatttcatatatttttttcatccctataccatatatgaatcttgatcaacaaccattaggaaaaggatgttctttctgaatagaaaaaggatgctctttctgaatagaaagagaatactaccaaccatatatatcatctcaaaaaattgaaaaaaaaacggaattcacaaataaagaaaaagaagaaagggaacatcttttgttttgattgaacagatcctttgatctccattttcatcatcatcatcatcacaatctaacttaactaggagagagagagagagagagagagagagtcctataaggatgaacagagaacaacccgcagctgcatgacagatctgctcatgcatgcatgatcctttttgatcatcatcacaaaccatgactaaattcctaaccaaaaggaaattaaaaccctaagtattattaatccatcgatctaagagagagagaagctagccaaagaaacaccatgcatcatcatctgatgatcatctcaatcaggccctgaagcaggcggcgatgtggaagttgttgtggtgtcccgacgagccgtggccggagaggaggccgccggcgccggcgccgccggcgccatgggagccgccgtggtggtgcttctggtggtggatgatgccctggacgcggcggaagtggtcgacgccgcaggggatggtgatggcgcccttctgctcgaacccgaactcctcctcggcctccttgaggagccccacgaacagcgggtgcttcagataacccaccggcaccacgaacctctctccctccgctcctcctccgccgccgcccacgccgccgggccccaccaccctcaccgccatgcaccccttcggcggcatccctccccccgccgacgagccccccgccgacgccgatgactgctgcctcttcagcaagtgcacacccatccttctacctatatagatatgactatatctaatcgaagaaacgctagcttggtcgatcgatctctagctccgacgacgagcaagaacgcgccgccgttagagcggcgggatctccatggcggccggtgaggtggcctcgctagcttgatggtttcttggctcgaggaggagttggtggaggaggagagcgtagggtgcgcgtgtatatgaggaggccggtgactgcgcccttttgtttctatctgtgaattttttttttactcttttttactatttatgatttattgatttcctttttcttctactgtttcttttcctgcagctgctgattttcctggtgagaaataaatgtcatatctctccccataaatattactccaccatttcaggagtgatattaattaatccagaaataattatttatcttagctttctctttgggatgtttaaaagaaatgtgttttttttttgtgtgtagctagctgttggagatagagcaaggcactaactctacagctttgtattagctacagcggagagggcatctgatccctccgtagagtgtagctggccagtatgccctggtgttgcctaggctttgtgtgcttacaagtgtcagtgagaacaccatgtgtttgagatttgagaatgtggtaccatacatattagaattagttagaatcaatttaccatgttgtatattaactctattattcaaagcaaaatatttatatctttttttactgtaggtaatatctatatcttatagcttcgttaattcgaagtaattcatacatttattatacccacctacacctacctcggcctggtagtaacggatatctctatctctcactagagatgttgccggtcaactttaggagacatctgtggttcctataaacgacataggaaagatagaatttcgtgtatgctactgtcacatattacaccaaacgctcgctcattgtatctgtgcagtctctcacaaacgacataagtagtgatctggcaagcataaaaaaatttaaagcctagcaaaatacgcaatggaagtctctagacgccgatgaccaaggtcgcaggccttaaatctatccaaggcgatagaatacatgtggtatacatattgcttgcaatctgcataacccatggtatatatacatgttacatgcaaccaaaagctcatacccgtgtgtaatttactatattgccttgttatatggactcatatgttatccaaagaaaaatatgtaacattattttgttgtggtaggtagatactatttttatttgctttgcatggttaattctaagtaatatgaatattcattttatatatccattatattatctctatgtgttggtagacaaatcatcaataaacttacaaagatatttacaggttatagatgatggaagaaagataagatttcatgagtgttatcgtcatatattacacctaacactcaacgtgtagtgtgtgtatcctcaacataggcggtgatatggcaagcccaaaattttattaaaaactactagaatatatacacaatatctctactaccttaatagcgaagtcgtcttccttctctcccctccttccaccgtgcacacgtgtaacatatgtacgtaatcaccagatccaatgttttatctcccaatctatcacacttatagcccatctctacttacatgagactgacctattacaacttatgagcacgttactcctaatcgtgagtgtctaagaatactggttgataaggttactaggcttaagtccgtctcatgagatggtacatggatccaatgtacagaaaatatatgtgtgatcctctgtataacaccatgatgtaagtgttacatatgcagccataagcgcagaattttatatttgcagtctactttaaccatgtatgagtgcaccacggtcgtagcaataactagcaatattcctggatgcatatatattttggatatacatatagaatatcatatcctctagttcttcatgtagattgttacatactctctgtttttaatagattgtgttgttaatttatatatatatatatatatatatatatatatatatatatatatttgaccattcgtcataattattattacttttgttaagacttagtttattactaaaggtattttatgcatgacttatattttatatattcgcataaatcttttgaataaaactgacgatcaaatatatgtctagaaatcaacgacgccatctttttaaaactagagaaagtatatatttatagctagctgatagttaaattatgtacataggtgacaaagcaaattacaatgcagactagttatgacctatgaccatatatatattggcaataattgacccatacaaaatttgctagctaacctgcatgactacaaatgattgcatgtttttcttgattaattccactctaatggcagtccatatgtttactcagtagggacatgcagatgcaggcagaggaggacggagctgaagccacggattcgatctcatcaacaagtaaggacagcaaggacaaattggaaaagaagcaggtttgttatgtcccgacacaattaatgttttggcaccgttgatttctttttcttcttaaatggcttcttttgggactcaatgcatcatttccaacggctcgtgaaccggctgatgaaggctacctttgattctttgatgtggtagaggctatatagagcactagctagctgcagtgcttctgctactttcaacactaataatgagctttatgtattcgttctcttctgccaataaactgttgcataatgctagtgctaatctagcatcaatacagagcatattaacttgtctttgccgacataagtatgaaatttgttcttgtcgatagggacaccttctccaactctctgaatataaacactgcatcatgcaggaaaacctttcagactctgcacacaggtagtccaaattagttagatgtttgctgtaaccatcagttcctccacaacagaatgaaactgtgagaatatgatgcaggatgatttcaaatcatatttttgcatttactgaaaaagaactccaaactagaaatacattgaaggaaagatggaatcctgaattgtactgcaggccaccgtgcacaccaacaaccattagtatggtcggcttggaggtcactcacaatcactttgctttgctttgctttggctccaataatttagccaaagttatctgcatagagaaagctaaggtttttccatggtgggtggtagtcaaacatccagccctcccctcatgcggcctccattattataaagcctcagtgacaacaaaatggaattattctcttcaggatgtggactttggaactgtatagcataaagtcttttttgtcaatgcacacctctttcgtttgcgaaatttgtcaagtacagaaagtacacagaggactactatggccggcttaccgtacagaattcagaagagggatcaaaacaacgttgcgtttgtcttcatgaaagtaaattgcagggatgctaattaaattgtaattgagtggttattacttatggattggcgaaaccgtgaaaatgaaatttgctctctggttatctatagcatataagatgcttatttttactgtagcatatccggaaatatttttatcccaataattctggctgaagatacaaatctctaaagatgctagcagcttctgaactcaatccatatctgaattctgaagatcttgcttgcacagtactacaatatacatccctaaaactttggggacaaaaatctgcaggcttaatttgaaagattgccagaaaggacaattgcgatatggtagcaaaagggagatcaatctaataatgagcaagggtattaagcatggaatgggacctgaccattgtcaccatggatggtgccggtcttcgcctttgatctgaactttggaaataatggctaggaaagcaaaagctcccagccatccatttaccaactagctagcacaccagtactagtactgcatctgcatcatggctgcctgcctaagctactagctcaatcaaactctcaacagtgacaattctttacttgattatctttagcccataatcccttgctggctcctccagtggagtatagcctgacgcgcggatgcatttctgatacagtgcaggaactgttccgattgagattacgacaccttttctcctccccatgatcgtcgattcgatttatctgggggagtaggggagatcttttttgaactaaaggtcaatgcataattggagcactttgggtgatggatttcgcatgaaaaaaaatatgatcatacatgatatctctgcatgatcaggtgtgcattcttgtctgactaatattggatggttaataaaccgttgtaaaaaccttggaattattccatcctcttttggacagacactgcaaatggaacgttgaggtgtgggatcatgatgatgctatagctaattaagcatgtagtaattcaatctctctatcaattgtggatcatatttcagaagttcagagagggtagggtacctaactacctactagtagaagaaatggtaacaagtctgaatctcaaatctgaatcagtaccttctgtagatcggattgcccattctgaacttgaagcttggtgcatcgatcgatcatttagagatctgattgacctgtgttcattcaacagaatccaattttttttttagactggtctgcagaatccagatttgagcgaacgaaatcaagaaacgtaagagcctgaatgcaaacatgagaaaatactggacgagatccgattgatatttctcgaaaaaaaaaggaaaagatcggaagcaatgatgcatagagctccagagaaagcggcgacggcggcgctcggagtggcgccgttgcaagtcacccgttgcgctgacggctgggacccacgtgtcagcgttaccatgcccacgcgggttcggtgaggaaaactccgacctcccctggatctctgtgagacgtccgatcaaggatgtgcggtagagattagataggagacaaaattttcacattggtcctttgcgtatcatgaatttccgcctttttcatatgggccttgaaaatcggggtaactcgatccatttacgaggcatttgggcctgaatggttaaacgggccaaatttactaaaggcctcaaggggatagacaagaaaactaagaacccttcggatattttttttatcgcaaacgcgtaaaagaattgcacgttaatatattagaagaaaaaagagttttagttacacaatgcaatcaggttcagataagggcggcatgcccatgcccatgctcgttaggttctgataagtacgtagacgaacataacagacacattttacagactaattaacatgtatgcaaatctggtttcatttttgtgtatatacacacacattctttttgggccgaagtctttaggtgggccggattaactcaatggctaaatcggagagctagatggtgatccgaggggattaggagaaaaaaactccgaccctttggatctcagtgagacgtccgatcaaggatgtgcggcacagattatcgcgtcagtccttccctcttctttttagctgggccaggcaaatcgatccataccacaaggattttgggcccgaacggttaaatgggccgaatttacttcggggcttcatttcaaaactgccgagatcaagaggttcggaaaataaaactccgaacccccttgcagaagaaaatcggtcgcgtgtttaaacattgatcggcttccgtttgtaattcggcgaaaacatattcgagaaatcgaaggcaaatgaatccgagaaatctaagggggtagaaatcaagcaagggaaaaggatcaatatatacaatctgcaggaaatggagaacgccataggggatacggagacgaaaactccgaacctatttggataaactgcaaatttacgtatttacatcagcaaatcgtcttacattaattaacgacgtcggcaccattttctgtaagccgtacatgtgcaaattaataaatctagtgttactggatgcatcaaccaaattaagacaatcccttttgcctctgatgattaacaagctacaggtagctagcgatctttctctttttcttttttttttgacacgtacgcttgtgtttagaatttttttatgggccgaactaaagtggagaagacaaaataaaattaaagagcctctaaaagaaattgtaagagaaaatggcaattcatgggggttcggagaagaaaactccgacccctttcgatcttttcatctttggtacttgtcatatacggagcggtatattcagcaacacacttacacacatactgtatctaatgatcgtatatatatatgtgtggactaattgatctgcaatttagtgctgaaatataaatacaattctagatgtatgtatatcatctccgtaaggcgcagattgaactgtgcgaatctgaagctgtgaaactctgaagacgtgcagtatatttcatcaagtttttcagtactccaaacagaaacgatctacaagtgcggattgatcatttagtataaattggttgcttctgcggttgcaaattaaagcacatttgctggagtgtatatgaattggattgcttcatgggccagttattaagagcgtatgcaaatgcaagcataggatatgcaaaactaaagcagaaaaggctggagtagctgatggatgcatgcatgcaacagccatgaactgtgttggtgacatgaaagaggcagccagatcagtatgcatggatatggaagctgctagctgttgcatgcacacatcttaaaaattggcttctgacatgagtgttgctactgcttccttctgcatctcagcatctgcatgatacctcatgtcaagactgccatcaacgtacgcagatagtatggccctgttcagatctcatagtaaaattttacaccatatcacatcgaatgattggacacgtgatatgtatagagtattggagtattaaatatagacgaaaaaataactaattacacagattgaatgtaaattatgaggcgaatcttttaagcctaattacgccatagtttaacaatgtggtgctatagtaaacatttactaatgatggattaattaggcttaataaattcgtctcgcggtttacaggtggattatataatttattttgttattagtctatgtttaatacttcaaatgtgtgtctgtatatccgatgtgacatgtcaaaactttacacccctagatctaaacacagcttgtatcggagtaatactactgcgtactcaggtggtgtttggatcagggacacatcggatgcttggacactaattagaagtattaaacatagactaataataaaactaattgcataaatgagagctaattcgtgagacaaattttttaagcctaattaatccataattagcacatgtttactgtggcatcaaataggctaatcatggattaattaggcttaatagattcgtctcgcgaattagtctatagttatggaatggattttctgattagtgttgcatgcatcatccatatgtactcctacgctactccctctagaaacacaatattagggatgagtattcatcctctgaattgaacttcttttaagagagggactacttcattggattattgatgtacgctccctccgtccttaaaaaaaaccgcactataagtgagctttttttttctcacggaggggtagattatttgctctacgcttctaaaaatatgttttctaaaaaaaactactatgttggttagatcacttattataaactactccatccgttccacattaattatataagatgcattgtttttctaaatttgaatttcttttatgttaattataactatagaaaaatataacaatatatattttcaacatcaaacaaacatacgtaaagtttaataaaactaattaagtttgattttagaaaaagttaaagcaaaatggaggaagtagttcataagtttatttttaaaaatatttaatatttagatttcttataaccaactagataatccgctataacaataatccagcgaatcatctgtcaaagaaaaccaagtatttttcacgaacgcgtaaaataattacacgtaaatataacttaacagatgcgtgtggaatccacttgttatctgcaaatacaaatgcatactcaatcaaaccaacttgagaaaacaccagtcctgttgctcatacatgcagtagtcagtagtctttttttttttaagaatcactattcacacacgcacttactgctgtcaacgtgtagatgtacttgtttacaaaacagagaggagaaaggttaccaatttagatgtaatcatgtactacactattataattgtaattaagtagctatggcgacgcatgcaaaggcatctattcacacgtgtgccctactcaacgagctgtacatgctttgactggtcagtgctcacacgagtcattctctgcaattaacggaacctctctttgtcagacgtaataaccggttttgtacacttatatcgctaattatcacctctctgaaatgagagatagatgtggatatatctatagacgcaatcaatatatattagattaattagttggttaatttttctgatcgattatatatacatcctccctggactgaatgatttagcgtccctttaattgatttcatatataatttgcaactacacgtattagctggctgttatagctgcctagctagcatgcatgtatatatggggctaattaaaacaccactcctgattcatattatattgcaatagctacaaaagggattacctttttttttatgaagaactatatacatgttcactagtacagctaacagtctgaagaaaaaaaggagagcaaaactgccaacagagaggcaaaagggaggttcctttttctgaaaacatttgaacatgagagatcctgaaagaattataaaaaaggagtaattaaaacttaagagctactatagcaatcaaagacaatgtacaacataacaagagaatctttagggatttgggatcactggaaacaccattttgtacatgcagcacgcactacataactcaatgtatgagcatctcgacacaaaaaataatgggtgtagtactgtatggggaagctagagctcaaggcttcaaacaggaaacaactcagagttgatacataacaacaaggtttacaccaacaccaatgcactggtgtcaaatatactcccctgcagctagctgatcgagaatcagctagctagtgccctgacaaacatatactgtagctatatcgataatatttaagttttcagattaatcaaaagtccgatgtttacttttgattagtgttctaagaattgaatgaacaaaattaaatctcatcatcatgatcagcatgaatgtagcttgcaaattaatataaaaaatcaatatgtagtatatatattgtcatagaaatgcacatcttatatatgaacttgttattgtttggtaagatcatgatctcgtatatatgcacaacgagaagacatccactcgagagtttagaatagtttcccgcagttccatttcatttattagaaggtaaaaatctacgtgccctttgcagtatattctttctacagcatttatggtagctactggatcataaagtaaacagaagagaaaaaaaaaggcacagtaattaactacttggccggtttagctgaaattatatatagttaccaccaaaaattaataaagatatatctgctctgctgatctcaaacccttgtcatgatttgaccatgaatgaagaatagagtcctactctggtgctttctactcggagtaaaaagtaatctaggcccttgatcatatttaattgtagggttaagatctagttttactcctaccagaattagtggaagtgaaatgtggaggggtgtttttgtctaggaaaaataattcgcgaaggggtattattgttttccgatccatagatcgatcaccatgtcatcctcgtcggagttggtcgtgcaagatcttaatcgatccatgtaatccatgaaacaacacagtgatcggaaacggcaagaagacgaatgagccgagacgacgctgccaagcaaatgacattgcgtgcgtgcgtgacgctgccgccgaagcctaggctggaatttttactaccgccagaactcctgctcaagatcgtcacttgctcggacgccaccacactcgtccgctcccagacggacgatgcgactgaggaagcggacaaggcggcgacggcggggaatacggatggcgacggagggggcggacaaggcggctaggccgggggaggaatagcgaggtgactgcgtgcaacggagttcagacctgatacgatgcgaacagaagaaaacatcccatgccaaaattacccctaaacgatattaggagattacttacctgctctttaaaataaacggtcaagattattctacttggagtagaatactgcaagtagattgcaccggagcattactctgaagaatatgaatctagcttgccttttctcttgaacagtgtgaatcagttatcggaacaatttataggcaattaattaattaacctcagtgaccaaagtataaatggaaatctgctagctacctattaattcccttaaactggaatcaaattaatatgtcccaatgcaacattatttggagagagacaaaaattgaaggagaaaaaggtaaagaatccacgcacagtgcaaagagttggtttttctctctagatctactccaagcaacaaattaacaggaagtaaatatccatatatttctcccggagtgtactacagagcatgatatatgtacttcatgtttcattatcctaccaggcaaggtagaacatgaagaaaaacgaagatgaaaaatagatcaccaaaaactataaaaaaaaaagcattttttagatcagtcaagctagctaagagttgtgatacccaagcaaaggtaaagatcagatgaacatacatatgaaagaagaaagattaagcaaggtatttgtacctgatgaatacagactagctagttccaaccatgaaggataggatctgcatggaacaaaggcctttaatgatgacagccttttcctcatcacccttcatctcatcaaaggctaattattgcagagagagaagagaagagaagagatcccaagtagctctgataagtgtgcaattgtacagtcatgcagtctttccccccatcattacaccaatctgcatctcatgcagttcatgccaccaagatctactcctcctatctatccatcagatgaaacaaaaagctgattagttaagcaatattcagttaacttacccagttcatcagatttggaagaggcaaaagcagggggtaataagctagctcatgatcgatatgcatgggagcccttctgtttggggggaatgaagcctggtccgagatctacagacatctactctcatctctttgactgatctttttcttaagatcgatttgagagatcaaaagatcaagctaggagatcgagaaaagaagatatcaaaagagagagaaattaaaagtagccccgagccagacaacattcccctcaaaatgaaaaggctccctctttagctagataacttttgcttgcttgcttgcttgcttgatcatatctttctctcagcttcttctacctgcagcatcttcctcacctcacacctctatttgactctcactttttctcttgatatttgtatcattactagaatgaaactagcagcagctagagctttctgtgtagggatgagtagtgagcatgcaggagaagccatggttttctggttccaaatggagagggtggagatgcatatggttgcagatggagctaggtagaggtgtccaaagctagtgtggtggctgtgtctgtggctgcttggggaggaggggatcaatggtcttttaattggggcagttagagtggacctctgcccacaagaattgctatcttcacctacccacccccaagccggcctaccatccatgcattttccattctactttctcttctcttgtctactattccattatttacaaacctaatgtgttgaaatttacaactgatggaattattaattaggcatgtctgaaattggatttctcatatggattttgtaggaactagaactccctcaataacacaattaaagagatttgtcaacactatatatgaccctattcttttctgattataccactagattatcatgtgcatgcttcctagctccaaataattaaacagtgtgatttttttttgcaatttttttctttaacaatatttcttagattttttttaaaaaaataacttgttggctttctaatcttccattcgttcgtttgagccctcgaataattgtgaaacacttaatttcatctatagttcatcatccatcatcactttcaaacatacacgagatatatgatgcatggatatatacctttgcccacatgatcaatggtggtttcttgatttttaactataagaaacattttatttttaaaaagtcttcaacatcaagatttggttttaatttttcataaaatgttctcctaatagctttagagccaaatttgtgaaagtattttgaaatatgaatctaccagcatagtttttataaagtaaatgtactttacaattcgacgaattattggtgaaaatcaataaagaatgactttctacgattaaaatatatatgtcttataaaactccatgaatggagcacttacttgagactaatcttgagtatgtataccacttgtaattaagaaaagccaagaaagaaatgttatcactatcgcctgtttgcatcaaccataggattagctagcttagaagcttgtggtcatttgtttgggggatggatgattgctgaccgccacgcaatcgatggtcaagattcaaaaaaggcatctctactctacagtctacacatataaacctttcctaatcctagagaaaaaggctatatgtaatcagtgcacattttcaagctctaaccccatgcctgacccccaccctgtcagacaggccaagaaaaaggtttcagaggaaaaaagatcaccatgaggtccatccatggcagcagctagcaagagagagggaacatgcacccatgactcacatactatacacttgagaaagttagtgcagccttttcttttcatccatttctctagcttttcatccatccctctactgtttcttcagagttgagacacaagtttaaatgcagagtttatgatgaaggacatgattgagagagagagagagagagagagagagagagagagagagagagaaagagaagagtatttgggtgtgtttgggggggggggggggggggccggctgggcctgtgcctggttggaaagaagacgaagcagtaaaagacaggacgaggaggggcaggacgccatggccatggcctggcctggccgggtattgcatgatcttactgccaatttttctcatgttttttcttttgtactccagaaatatattcgtggtttcgtggaccaaaaggagagaagacacacacatggagtagtaaagcgcaatctctatcgctttcttctcggacgaggcatgcagatgcagagaaacgggaatacgcaatggcaaatgcaaagcaaatttgtttttccgtcagagagactgatcgatcgataagttgatggatgtgaccacgacgcaggacgaagccccatgcctgcgctgctgcgccggctggccggccggcgagctggccgcggcgccattgccacttcaacgcatgcgacgcagcccccctgatgcagatgccaagctcgctctgatgccaaactgccataccttgcactgctcacacacgagcatatatatatactgatatgtgtgcagataaatatattcgtttcagagctagctatctcctctcatggcagcatgctgcagatatatacagtagtatattcattcagagctaggccagctgctctcacgagtcactcgtccatcgatctccttcttcccttgcactggatgccatgcatgctgctacgtgctgctgctgctgctgccacactttaatttgcctgaaatgtatgcatcgatcagactcagtgcatggatggttacaggtgaatttcttgcatgcaggaggctgtgtatgatcataatggagtagaatctgtactccattcggcaccagattcttgctttcgccgcatcacgaacgcatgcatcgcttgatactagtacctcaggaaaaaaaaacgggcattatatatgctctgctggctgacttgacaattccttttcagtttagcaatgtttcagctgcatgcgctagcttcgtctcaaaaggaatgcaaagaccctgaaatagatcgatcacagacgtgtactatatcagagaggttgcaatcctacgccctattaaaatccgcgataaattaattaaacagtagtttaattcttcagttctcagcaggagttgggtttcagagactttcagtctatatatcgtgtatagcgaattcctttactgaaaatgtgacattcttgtttttctttctttcagaagagagagcgtggaattaatattgcaattaatgatcattacatacatgcatgcaaaacaaaacatgttttcagaaagcagcaaaacctgttttcagaaagcaacaattaatattaattgatggtgtttattttctcaagaaatcaagagctaggcagttaattggctggctggcaatcaaagggttagctagctagatggacgcaaatgatggggttcttcccctggtctgctagctgtttgtccttacatacatgacatcgaactgcttttttggagagtgcatgtcgcattgcatggcctgtctgggcgtctgtccgtttttattctcgatcgaccaattggcaagatgatgatttcctctcttttcttcttcttcgtcttcgcgagtatcgaatgcagtacgcgatcagtaatgtcatatgtactctagctatagctagcttgaatgattatatgattccataacggtttgtggttaaaagttcaattcaattcgatcagcattgtactggaccaattaattaagtagaccaataatcgcatatcgaataagctactagctaggcagtagctagatatatatatatatgggaaatttgtactactcccttcgtcacattttaagtgcaactttccgtgcccaactttaatcatccatcttattttaaaaaaattatagttagtatttttgttgttatgagataataaaatatgaatagtactttatatgtgacttatgtttttctaaattttttttaaaaaaaataaataagacggacggtcaaagttatacacggaaaataattatggataaacttaaaatgggacgaagggagtcctaactaacttaggattctgtttttgttgttcttttcgttcctgtccagaaaatgtatatgctgctctatcatgctacttattgctatggcagtagcatgagctttatgttcctagttctccaatgttacacgccacacagatgcagcatatgctgtacggctgattatgcttggcgtttaatgggccgttgctggctaggccggtgcagttggagatcaaacggcccaatcagcccatcgggatgtcctggagatggcgtgagcggacatgggcctctgtttattcggttgtacggccatattgggccgacgtggagcacatctgcatctttgtcgtcggccggcccagtgtcatctctgacactgtatttttttttctcccttcaaaatcgctcgaactgatgttattcctgtagaaaatctgaacttgggagcataattttcaagttttatccttgccaaatttttataagaccacaaacaaaatatactctgcacacctctattatgttacatgagagtagtattagtaaggacataatactctattctcctaaaatatatagtaaatgtacaaaaatacttgaatagactattatatatgcatataatactacgagtctaaacttttgactgtcctattcataaaatagaagtataaaataagagaaagacttcagaacggtttgtaacggaatagttgatgtcagcacgatatcgtagataccgatctaatacattcgataccaaatatgataccatatagatatcagattcaatatgatgtaagttgtctcgttgaattgtaatactccttccatccacaaaagttacacatattacttttaacaccaagactaaggagaaattaaatcaccttgaatgttacaaaattaaggagtgaatacaagcatgcaactaataagtatttagatgactccttgggttctaataaaacatttaatttatctcttcatttaagtcttgaatgcataaagactacaaataggaacaacttatttgaaaaaaaaatcaaatgtgaaataggtgtaacttttgtggatggagggagtactaccattttgttgtatttctgataaaaaaaaggatacatacaattaattaactattaatctaccacggaataagagaccaagtgtgatcttccttcgagaaaaaaaaggacaggtgtaatcgtaatccaatccaatggcccaaggcgactcgtttccgtgaaggttgaggggcggcaaacagacgagagaccagaagcatcggaggagaggcaaaggcaacacaaaccccttccccaagacgccttcccgataaaccgactaatcccccttcgtctcttcctcttccttttcctcttttcccatcccatcgattcccctcctcccgctccggctccggcggccgcagatccatccggtgtgtggggggagaacctctccctcctccctccctcgccgccggccgccgcccgcagattggattggattgggttggattggattggatgaggtcgtcggagtcgtcgcggttcgtgcaggagctggtgctctacgccgccagcgccgccctcagctgcctcgtcctcttcgccggcctccgccagctcgaccccaaccgcgccgcctcccagaaggccctccagcacaagaaggagatcgccaagcgcctcggccgccccctcgtctccaccaccccctacgaggttcgattgtttccacccccaatccccaatccatcgattcgattctagggttctcctctctcacctatgcaatctcactctaccctaggatgtgattgcttgcgatgtcatcaaccccgaccacatcgacgtcgagttcgattccatcggcggcctcgaccacgtcaagcaggcgctctacgagctcgtcatcctccccctccgccgccccgagctcttcaccttcggcaagctcctcagcccgcagaagggcgtcctcctctacggcccccccggcaccggcaagaccatgctcgccaaggccatcgccaaggagtcaggcgccgtcttcatcaatgtcaggatttccaacctcatgagcaagtggttcggcgacgcccagaagctcggtcagctccgcgcgcaaatccttcggtttaactgccgctccttttcatttgtttgttgttatcgctgctgatttatgaaacatcttgcagtgtctgctgtatttagtctcgcacacaagctgcagccggctattatctttatcgacgaggtcgatagtttcttgggccagcgacggacaacggaccacgaagctatgactaatatgaagactgagttcatgtccctctgggatggcttcaccactgatcgtaagtacacactctgcttcaaacttatacatgaacatattccatgtccaaattgctagtaactatgcaaatatcctattctctttattatgtaatgatatacctttgccactttgaatatttgggttggcggccacgagggttggttctagaattccatgttactcgttctctcaatatgcccctgattccccacaacgcggacttatatctacattcgatttttatattagtagatataagatatatcaaaaagaccatgtatagtctggaatactgttcagtgtgctccattacctaagagaaaaagtatgttgcaacacacaagtgcactatgcagctcgcttatgatgccgcatgacattccactgtgcattgtgacatcgatatgctatttagttcgggtttcttgcatcgcatatggattcttgctaaacagtgctgtccaaagctttacttccgtgttgtatcaaacttgagcccatttccaacctatatataaatttatctctcataaccttcaattttatgctcaagttttcttatgttagaatatcaacatgcttaatgctttgttacgttgaagtctgaacaaattcatatttcattgttggcattcagcacagaatattcttcttaaaccttgcacattagttcaaacatatgtaagttatgtaagttaattgttagataggttatcttacaaacatacaatgatgtattgtgcacaatattgttaattggggtgattttttataagaaagtttgaaaatcgctgcctgcaggcacaggtggcagtggttcataaggggaaacaattgttacaatttagaatttcgaactggaagttagtactaataattattccagttaccacatatccctgctattatgggcattgttgtaatctgatcaattgcttgtgataaccatgcacccaaagtggcagaccgttagtgtatagagttaccatgcaatctgaatataatgtcaaattggtgaaatcaacacatataaacttcaacgaaattaattgagttggacctttttccaatctttttagcttttgtttttttcttgaaataactaattatgtctaagctggacatgagaaaacgattttttttttacaatacacggaccgtcacatggcttctctctcaagaaatagaaatcgatgtatcaactgtcgtaatttgttttgatcatgtcttattatttagggtgccagacatagtctcttcaaacatagggagcaacttattttgtaactagcaaacaagtttcctggttactcctgtgcaacatcttatgatttatttatatggctttgcagaaaatgcccgtgttatggtccttgctgctactaacagaccctctgagctagatgaggctatcctcaggcgctttactcagatatttgaaattgggattcctgttcagagtgaaagaagcaagatacttagggttgtattgaagggagaaaatgtcgagcctaacattaattacgattacatcgccggtctatgcgagggatttactggatcagacattctagaactgtgcaagcaagcagcattctaccctatcagggagctgttgaacaatgagaaagatgggcgaaaagcagatgtgagtattcattccttcttgttgcttactgtgttcactgctgattttttttagtattactaccaccattaattagttcattattacttcctttgggtaatgtttgtctacaccagttgaccttgcgaacggcaaacctcatgcatgaatccacttgtgccagcatagccgctgattctgtttaattggatttcatggtcaaatttcatttacagtttctagttggactttaatgatacagtaataactgaaacaacatcagattgattattgcccattacatgttggttctgactatcttgcctcctgattgctggttcagaaaccaagacccttgaggcaatcggatctggagaaagctttatcaacgtctagaaaggggaaaagggccgcgaatggaacatctacggggttgcagtcaccggtgtggattcggccctctgattcagaagacgatcaggtacagagcgcaatttttgagatatctaagctgatgtctcgaatagttcagaacagtcagtcggaaccgcaagagccatcttcaccttaatctaatccttttgctagatctcatgaaaatccaaaggagtaagcgcaggcattacctcgatatcgttaggttttctaatgcagcttgcaagattcagggtttgtatggattcatttagcgtcgcgaggctgcgctggtttttgaagttaatggcagctggcaatgctttgcactgatgttataagttaaattcagaattatatggcccgagtcaggattctatggttctgtgaaatttgttatcatcaccttgtattttaatttaattaaactactttagggtagactctatacataacgaagaaaagaaaggcccgcttgcatggtttacaaacaatcttgtttttttgtcggagcactctgctgtgacttgaaatagatacacgatgagatgaaactaacgcttgcttgtcacccaagagctgaattaatatatacttttcccttcaattatgtgtcttggaaaccaagatgtctcagcttctgcagtaagatctgtcatccatgtatattatgaacttgcgatgatgatgatgatgtcaagagcatgagtactctctcgatggcgatgagccgatgacgtctaaagtaagtaattaagagcatgagcacctgctcactctcttgatggcgctggtctccatgatggagagctcgtcggagagcgagagcttggtgcccctgagcatgagcgcggcgttggcgttggcggcggcgtcgccgttgatgccgtccatctccagcagcgacctccgcgagacgatggcatggatctcccggaggaggccgaggaaggcctcctcgacgttgtccccgctgagcgccgacgcctcggagaagaagaggccctggtcctcggcgaaggcggcggcctcgtcggcggcgacggcgcgggcgtgggagaggtcggccttgttgccgatgagcatgacgacgatggagttgtcggcgtgggcgcggaggtcgtggagccagcgggcggcgtggtggaagctccggcggctggtgacgtcgtagacgagcatggcgccgagggcgccgcggtagtaggcgctggtgacggcgcggtacctctcctgccccgcggtgtcccagatctgggccttcacccgcttcccgccgatctccaccgtccgcgtctggaactcgatgccgatggtcgacttggagtcgatgaagaactcgtcctttgtgaaccgccccagcagctgcgtcttccccaccgccgagtccccgatcaccaccaccttgaacacataatcctcctcctccatcgatatctatcaatggactaatcactagcttgcttagcttgattgattgatcaaaatatgcaaactatgcacagctgagcgaggtattgtgtgcttatatggagctgtacctttcttctgagatcacgtatgcggtatgcatgcgttgatattgattgattattgtagagtaattaagatgctggcgtatggagattggagatgtagaggagagtggttgatcttgctcctactgtggatgtatattgtctttccattaatttcttaatggattcgatcggaggcggcaaatcaattaacttaacaagattgaaaagatcagttcctgttggctgtcagtcatgggggttaattactaattactaatggtagacaggttgtggctctcttgctcctgtatatatgtactctccctttcatcattcatttgtagagtacctgagtacgtgctaatagctaagctagtagtgtgtcacaagcaaagggagcactgctgttactctttcaagattgatcgttcctttcatgaacttgcactcgcgtacatacatatatccatcaattagtgcttgtaatgtgcttcatgaatcatgccttatgtcagttttcataggatcaatagtgtatgagcagcgtatgtatacaactaaaagatactccatttgtcaagtcttacagaagcacaaaagttaatccaatgaaatcagggatatgcagctcatgctacgctactgtatatatatattcttatagctcaactgctcaatcaatatgtagtacattgcagagatggattacgtgtgcgttaacatcattcaactgctcaattaatatacagtacaggttctcaactgctactacgtaccttccatcacgctgcggcagtgtcaatctcccatggcgtctcacgttcctctgctttcctgtttcagttggttgcacaaccacaactttatgactcaattattctattgagaattatgagtttggcattatgcataatgtggctagtgcatcatccaaaccaatatatgattgtcctttttattatgtgaactcatttataaaccccaaggctgtgacagatgaaacagcttgctagcttcaaattttttctgtgcaataaagatcaaggtccctgaattatttagaggttggcagcggttttgcagcagaagaactgcagaaccacagtacaacatactctctccgtcccaaaataagtgcagttatgcactattcacattcaacatttgaccgttcgtcttatttgaaaattttttataattagtatttttattgctattagatgataaaacgtgaataatattttacgtgtgactaaatattttcaattttttcacaaatttttcaaataagacggacggtcaaacgttgggcacaaatatccacggctgtatttattttggaacggaggtagtatttagaattgaaggtcatggtacatgatgtatgatgattcaggaataacattatgtaaattactccattcgttctaaaatacatcaatctagaattcgtagcattgagatatatccaatccgatcctagattactatattttgggacgtagcatgtatggcccgacaaaaaaaaaagagtagagatttaagctgatattttactgagaaatgaattggcaatatgcaagtgttgcaatgaacaagcagcaattctgaacatgcgaggtttaattgcagcgtagcagagtctgacagagtaatgtaattctttagtaagaggtggcggcgtgggggcgcgcggggaggaggaggaggcggtcgcagatggcgacgaactcggccatgacgtcggcgaccatggcggccttgcccttgccgacgagcatcctcaccagcgcgaccacccgcgaatcctcagcaacgtcgacggcggcggcggcgtccgagacgagcagcgcgcgcgcgtggcgggcggcactggccagcgtcccggctcggagcgacgcgtcggccagcgccgccgcgtaccccgtcgccgcgcggctggacgacaggcggtgctgctgatgaacgacagggggaactggcggcgccgacgccgccgcggcgcgcgcgcgtgtcctgctgctgggccgcgcggtcgtgacagctaggcgcgcgcgcggctgctgatgctgcttggccgaggcggcggcggcggcggaggaggccgggttgagatggtggagcgcgcgcgaggcggggagcgggagcgccccgtggaggtggagggagacggcggcgtccatggcggcgagccacgcgggacacggcgacgaaatgagtggcttatcgcttggcttggctaatcctactacggcgtgatgtgtggctgtgatgcgatggaccggccggaggagtcggagacgcacacgtcacacgctacctgtatatgtgtggacaaaattttctttaaaaattttatagatgtaaaatatagtctataattataatgtaattgtattataaattgcatataacgtacttatatgtagcttttaaaaattgtacggcaaacccactattttcatgaagcgagcagccctcacccgtacgtacggacactatgatttttttttcctttctcgcttgcacgaatcttaaaatgaatctacgatttaacggattaaattatatgaaagttaccgtgtaattacaatgatgctatatatatttacatatgacgaagttttaactatagtaaaatcgaaattgcaattcaaatcgaaattgaaattggagcccaaaacatactaacccaaatctggcccaaaatgcgatcgctaccaatggtctggtctgcgatccaaatttggcccaaaatgatagccgtggcccaacttacggcccaaatctgcgaatgcatcgcgcagcgcttctcatggggcagtggaatcacatgggcctctctttgttgaattatatgggccaaaagatggatcactacatttggcccaaaaaaactgtaaatgcagcgagagatggtgatgggccctggtcgtacaaacggatgccgcatgagaacggctatatgccgtgcccatgccgcctcgctggccgatgtggtacaaaacatttttctatcgcaaggatcaaaggcagagtttataaaagcttaatttgtcgttaagcacctgcagagctcgcatgactgacccagaaaatactttaataacactgctaatcagtaatctggttccattttccacgcacaggagagtgattacttttgcattattaattgatgttgtgatatttatatgaatacatatataaatgatatttctgcaagttgggtgcagttgcagagtaggttagtcccccctaggccaaggtcactcgcacacatccagccccagccaataggttccaagggcccatttgctactccacccacggttttctctcaaaccttcggccctcgaatcagctatgtgccaaacaaaatgctcatatatacccatatatatgcacacatctttcattgcatttggcctccatctgccaacaaactcgctagctaccaggagaggaccattaacgatttaatacactgacacacacacacatatgtgcaagttcgatcgatacaagacaggaagagatcaccatgtctagctagctaaattaataagctagctagagctggttgcatggttgattagctacgacgtgcagttgattagagatggaagagatcgccggtggtggctcgccgccggcgatggaggaggaggagaggtatgtggaggtggcgtcgaggttctaccgcgtgaagcccggtgccggcggcggcggcggcggccgccgtctccacttcctcgagtcgtgcttcctctgcaagagcagcatcgccggcgaccgcgacatcttcatgtacaggtaattcagttcgcaaatcaattgatatatatccttaataaatttcacagaaattttgtgtgttcaaagttcaacaaggaattgatcttgattaatttgcatgtgtagaggggatgcagcgttctgcagcgacgactgcaggcaggagcagatggacatggacgaggcgctgcaggcggtggcgcgccgccatcgcctccgttcgtcggcggcgccggcttccgccgaggcagcagcggcggcgccggcgaggtctccgatgatgcaccgccggccgaccatcgccaacttcgcggcacgcactccagtggccgccaccagctagtgttgtgtactcctatactaacatggtcgagagatgaatctgccgctgcgttcatgatcaactgcatgcatgcacgcatcgctcatcatcatcaaacgccaaagttaaattaaacagtgtggattggcatatatatatgtatgtagcctaggtagttgtagatccatggaatattacatagatccgtgtttttttgccatcttcattttgtttgttttgtggttttcacacggttccatgtgtgatcagttgaggctagctacggccatggattggtaaattgttaattagattttgggatcagatcttgcatagttgcatatacatatgcagggtttgttaatttctcttctacacaagagatattcagatagatggaagagagatctgcagggatatgaaattaccacttaattgcagcaacagctacggtgagagattatcagatgaataactggacatgttgtatgaacaacttgtaatcttggacgtggtctgatcgatatgtgtgcagatcatagagactgtttcatccatgcatgttaccaggagcaactcctaacttgcatgtactattcgttttgtacatactactacaaatcatcaacttaaattttgtatgctacgagagattatgagatcaagattgctcttgttttccttaagttcttgctcttctcacttttcatttcttgatcaacttaagtacgattattatgcaacaaactaaggatggagatggcacagtacacttggccttcaagtccgggcgatgccaactaactttatcatagaactatcgtacaacttggtcactttttctaaggcttatgttggaagactagtctccactctacagtcatgttctctcccggacttcacatccaatttgccagtgttttatgtccttactttcccatgactcatcatcgcaccaagatatttctgcaatcaaggtactattggtacgagataccaaagttgcgtatatacgcatcatgttgccttcattttgcagcaaactgattaagcagagagcaatcttgcatgttccaaccagccatttcatgatcacgacttgcatgttccaaaaaaaactaaaacagagaggacactttacgtcccatcgcctagagcaatcaataacatgggcagaggtagagttgatgtcttatctagctaattgcactttttttcttccctttgacatcatgttttatccatcagttagactatttagcacgtcattttggttttttccaaagaaatcctaggagagtaattttccagtgttttggcagtcaacacaataaatcattgtgccggaagagataatggaacaaaactaacacacgttcatgatcctattacttgcccagttgcacttttgggttttgactagagaattccatgcacaaattagcagcaaaataataggtaagtggcacacccattttgtactctcttttttttctgggggcaactgattaatcttatgcataatccaaaatagtctaattcaagacatcctagtagccaatgagtgaagacaatgaactctcaacaaacacacacaaaagaaaggagaagaaaccatatatttactggaagtcccagaagcagatacaactaaacaaggttacggaatgcgtcatggtctcatggatgcttcagagctagatcacaaatcgatgggccattgacaatttatatttagtgacatatgcgaattctgcatagtgccacggcactggagattattccaaaagatgtagtgtgactgcaagaaaagagcaaagtcaagggcccatcctgacatgagctcaccaccatgagaaggacaagagagcctatcaaggttgtatcaagtgcttgaaaaggagaggactgaaagtgcacatcaatagggagagagagagagagagaaagagagagattaaagagcaagagattcctctactgatagctatgtcctctttattcaaaccttttcttatgaagtggttatctctggttggccttgttatcacctcaagagagggacatttgagggttcttcattggtggtagtcccattctaggattctgtagcactgtgcagaagaactagaagtttcagaaagtatcacgcgttctctgtaatcagatttaactaggttacttactgcctgtagtttctctaacttacatatatctctcagtctttaatcatgtgtgtgttgacaacagaactccagttcttagtgtatgctaaaagagaggtatgaagaaagcatgagagaatcgtgttagctagaagatttttcaaactatatggtaatgtggtagtggtacacatgttgatatataacagatgaacaatgaaacaataacagcagagcaggacacaatcatgcgcttttaggattatgaggccaaaaccaaaagggaaaagataaaaaggtaacacaagattgctctattcagtaccaacccatccaattctggcccagtcaagctcctttctaatccaagagaaaacgatgtagataagaactgatatgtttatccagagcagaaaatttcagcactgttcagctgttttaatttgttcaaaatggtgtataatcatgaaattatccaaggaacataaggcaaattggatttctgtggctaggattgccacaacatggtcaatttttctagaattttcaaataagttcagagatctaaatgaacaagcaactagatgcttcggtccctgattctagtccatttcctaaccaaaggccaagttccaaagcaggaatttctataaggcagctgtagctcactagaaagactaaaaggtccttttaacatgggccatgggaacatagtatatattcctgtaaggctgtaacctactagttgataagccgctaaccatgccggtttgatctgcactcaatggtccaaatcataacagtggcaacttatatctctaaaggctttagcatgtgggctgtggcaattacaacatacaagtccaactggcaagctcaagcaagcacataggaaaacacttcagcaagaaagatgacaaaaggtacacagagcatgaatcagaacaaaattcccaagctccactagctacacaagaaactgagtaagatcaaattattgtcctgaagacaagatctgtatttaaaagggtacagcccatagaacagaaaaaagattgcaggtacttacaagatatctctcgacctatggatggcttgttcatactaaaattattcttgcttgtgtaggcagccatggacagatggattctaggttgtttagcagagtttaaggttgaggtggaattacttcgatgcctctaggagtttacttgattgggaaagatcacgcctaaggatgaaactactggtgagcaataaatgcagtggttggatggattgagaaagtagtactctaaaatcccttagatttgtggacaaatagagaagcctaaaatcccttaaatcataacttgttttcaggcatttgaagaacagccatggtaaaacagaaacctactaaacaggataacagaagttcacttggttaaatctttaacagagttcctccctaaaaatctcctctgatatctcacctagtcatttatgatgaacatacattcttgttctggatattgtgaaacaggattcgtaaacataaaaaagtgaccaaattagtctttctgtaaactctagcagtctttactctttattaatctgcatcacttatggaagcaaaatattatgttgaataagctggagtaaccctaacctaacatgatgaacatcaaatatccttagtgatttttagaagtcatacaaattaccaccctaataatcataaccacaagcaaaccttagatctaattaccaagcaattgttcttacaagtctgagttttttcagtttttgaggtcctattggccgcaagaacacacatatcaaaacccaacttgattgaacttcttctcctagatcctaatttgtatgtagttatattcccatgcttgtccatcacaatgccattatcccaaacttaattttcaagcccttaggtcccagttcaaaatgttaccatgtaaagttgtagtttcatcctaaacatattgctaaattaagagcaaaaaattggttaggctcactactcagtacgcacccacaaaaggcagcaagcatgaatgaaccaaaacctagatcctactgcatctacaccttgttattgcagtccatatatgtgtcttagtagagctatgtaggcattatacaaaaaaactaaaactcaaataccctatcccaaagagtgatgcacagatcacccctgacattactagcagatcactccgaaaaatctgagcacatttaggcatatccatactcttgaatctcgaggaaaagaaaagaaaagagtaaatttcgtaaaactacacgttttgtggttcaagttacaaaaaaaaaccacacacattttaacacttggcacttgagtacatatattttggttgtgtagtttcacaaaactacactatcgataaatggattcacgtgcgagatgatgtggctgtttcacctaggacgaggacatggcattctattaccagccatcgcgcgaaattaatgagatgccacgtcctcattctagatggaacaaccacgtcatctcacgggtgaatctattcatcgatagtgtagttttgtgaaactaaactaccaaaatatatgtacttaagtgccaagtgtcaaaatatgcgtggttttctgcgacttgaatcataaaacatgtagttttatgaaatttactcaaaagaaaaaaagcagcataccgagctagggtttggaatgagcgtcagaatcgggggaagccgcggagttggtggagcagccactgccgccgctgctgcggaggtcttcaatgattccaccaagctcacgccgcgcagactccctcccaaacatgaatccatacctgcagcggcgaaagaggggtggaatgaaatctaagacgctgctaacctacgggacgcagattttggcgacgacgggatagtatacagatcaatcacggtaccagcaggagacggcggagaagactccggcgaacgccaccgtctgcaggagcgtgatcttcttcgccggcggcatcgctggcacgagaggagctgaagcggcgaagcgcgggagggagccgggcggcggcggcggcggatgcgtcggtttcccagggaggcggtcgccggcgaggggggtttgcttgcttttggggttaaggcccacggggagaccatgtgttgggccgatcggtttgccattgcgatttgggccgtcggccggcccaacctctccacaggattgggattaccttttttttctttttttttcggggaaatttttttattcaagtttttgagaaaagctttctaaaaaacaccctgaagttcaaaagtgtcctagaaacgaattactatgcattatatgttcctactttccctaaagttcaaaagtgtgcgtagaaacgaatgttcccacttcccctcaagttcgcatgaatttcacatggtttgcacgaatttcacacggtttacgtagatttataggtttttcataagaactctacagaactgtaagattatatcttgcagcaaactgggaaatcttgtgcaatcgaaacactttgcatgctccaaattattcgcattgatcatcatctctctctacaatacaaatgaatcaatgatcgatctctccacaatttgttcctcacgcactggttgaccgtcgttgaccgcagcctcctccggtgactgatctgacgtcacctcttcgccggcggcaggcggcggtcgccgtccttgtcggccgccgtcgtcgtcggtggctccatctggagcaccctctcgagctcctcgacgacctccctcatcgccggccgctccttggggttcttgacgaggcagcggtcggccagccgcgccacctgccgcgccgccgccgccgggtaccggccgcccagccgcgggtccatgatcgaccggaagctctggctctccggcgggtggcggcgcacccaccccagcagcttctgctcctccgccggccggctccgctccagcgaccgccgccccgtcaggatctcgtacagcaccacgccgaagctccacacgtcgctcttggtcgtcaggtgccccgtctcgatgtagtccggcgccgcgtacccgtgcgtccccaccacctgatcgccgccggcgagatcgccatcatcatcatcatcactcgggctcatggatcggatgggatgaattgattgttcgcaatggattttacacttaccgcggtggagacgtgtgtctttccttcagttggcccctctcttgctagcccaaagtctgaaagttttggcttgaaatcggcatcaagaagaacattggctgccttgaaatccctgtatatcacctgccagactaagaaactacggatcagaattcagatatttggcacagatttcagattgatcatatcgttcttgaacctaacagaattcagataggacaatgcttactagtagcaatactacagatgctaaactaatggttcagttaagagtttcagagttcagaattcagatattgggacagataccagattgatcatatcattcttgaacaataaagaattcagataggacaatgcttactactagctgctacaggtgctaaactaatggtccagctcagagtttcagagttcaaaattcagatattgggaagatgccagattgatcatatcatacttgaacattaaagaattcagataggacaaggcttactactagctaccgcaggtgctaaactaatggttcagttcagagtttcagaattcagacaatgtatcctgtgaggcatctatattttgagttttatggattcagagaggaggacaatgctttggagggcacctgaacttcttgcaggccttcatggaggtagtctaggccccgcgcggcgccgatcatgatctgcagcctcaatctccacgagaggggaggatgagctcggttgaacagatgatcatctaggctcttgttgggcatgaactcgtagaccagcagcctgtgcttgcttgtttctgaatccactgcacaatagccaacaagcctcactagattcgggtgctcaagaacacctaggaattggacctcagccagccattgcttgtgcccctgaaatcagaaaaaaaaagaaaaacataactttcaatctgttgatatttaaaaaaaaatgcaatctttgatttaacaattgaaaattgcatggattttgtcctatgcactggcaatctggcatcaagttttggcgtgattaagcttggtacgttgtttataacgtgattctgaattctggaatttagtaggttgacttgggatgctgtccggaccattgttcacgtggtttggtgtgtgatctgtggttgaagttgacatgtgtgggtgtccttgtcctacgggatgtgtttatctatttgttggaattgtcacgaggctaagaatttcatatgatttcggtgcaaaagaacaatatcctgagtttgattttaggtctcgatccaaatccaaatcaggatcgcttgttggtaactattgctggttgaagaacattttcagcagtagtaaatctgtagtgttagcataccaaaatgtgtgaatccgaaaaatatatatttaagtgcatgccgtctttctgaatcttctgtgaagattgtacgctacgagtcttgaatgtagtctagagaaagtaaaagcgaagttcttttttgaaactctgaaaaaacatgcagccatgtggtcagtgcccaagctgaaaagacaaaatcttcaagttcttcttttgccattcaatcgtcctgatgaacaaattcggtacgttttgacaaatctagccaaaatcaaatgcaccatggcgaattttcgagaggagcaaatgcaaatcagagggaggagagatgggagtacagctaactgatactgtactgacctgcaggctgcgctggttgaggcgcttgacggcgaggacgacccggccgccgccgccgccggcggcggagcggaagaaggcgcggtagacggagccgaagccgccctcgccgatcttgagcgcgcggctgaagccgttggtggcgctgctgagctcgtcgaggtcgaacacccgcagccgctgcgcgcccctctcgtccgacagctcctggatgctcctcgtcggcgtcgacgccgatgatgccttgctcttctgcccgtccgacgtcggcgccggcgacctggcccccgacgccgccgcccgctggttcttggccttgctcttgaacgcgaagcaccccatatctgatgggctagcaaattaaacctgagaggaggcctccttgctgattaaaaacaccaagaaccaaatctttggagagtagcatccgaaaaaaaagaccaagaactctactaattggagacacttttaatcccagtgagcagtgacaagatgctaaagctgttcatggagtagaaacgagatggtatgattcagagaggcaaattaagaaggtagaaggaagaagagaagaaattcagagagcagagcaaggaaacaaatagaatagagagagagagagagagagagagagctcaaattagctttgataaagacagctaaaattgcatggaaaaattaacacgaggaggaactaggaagacgacgacgtcatatggatcatgtggttggaatccatgaacaagtggggggcgagaagaagaagaagaagaagaagaagacgactcgcgtggaatcaatcgagagagaaaagaggacacgtaccgtcgcctcgcctcgcctcgcttccgcgtcgttcgttcgcggcgatcccaacgcacacgccgcgtctcccacttgtaccatcacactaactgtacaccagtcaacaagatcaatgaagagagagtgtactgttcttaattgtttttttcttaggataaaatcataaaataataaggaaatttattgttacaatcaacatagcatggaggaatgaatatacttacctcacctgattcattgctccatatctgcatatcagcatctttctttcttcaacgtgttcacgtcaaaattgaaagtttgattgaaattgaaacgatgtgacggaaaagttgtaagtttgtgtgtagaaaagttttgatgtgataaaaaagttgaaagtttaaagaaaaattttggaactaaactcggcagtagtagtaataactgtttgggtcaaaattcaaagtgtttgttggtggttgaaatggtcaaaccaaaagctttttcttctacctgagaaacaaaggggccatcaatctaaatgctgagtgtgcaaaatatgctcatgcctctttacaggaaagggaaggtgcatgttgatcttttacctgcaaaactgatttttgaccaggcttgggacaaaatggaaaattggatttgattcaacaagcggcaaccaaggacgcgaggtgtgaaacggtaggagatgtagctgatgatccttccagcagaattgaattttttttgtctgacctttttgccactctcgccatcgtcgtcatcttctcctgtcgatcggggacgaaaacaacttggcagcttgacttgtttatgtggacagtcttgtgcttgtttcgttcattcacatcatcacagtccttggcgcgctcaagaattcgaggccacacgtcgcactaattctgcaccttctttttcattttttttctgaaatcaattatgcaattcgatttggctaacaataggtaaaggaagctcaaaacaaaacccttatagctgaagctgaaggataacaaatgaaacatggtatttgtatctgactaagtaaattgtgaccattttggggcctaatattgttcaaaagatgtctgaatcatagttgtactaccttaggggtcctttggaacactggaaagtagaatgatttcacgtgaaaaatcctataaaactcctgtgtaatcgcagggcacatcttcatctttcagtgttcagagttcagttgcagtagccggcacttgccgcatcatcatcatcttaatatcatcgaaagtaatagcactcactagtctaccttgtagtatggtcatggtgcaaccaaaagtcccacatgatctgaaaatcagttggaacctcaacctgatccaatcgtctgaacctcaagtgcttgcagttacagaagcagacaagtaaaccctcctgaaaaacagatttttttcagacaagtcaccatcaagccatgacctgctgaacttactttacagccacatctccaccgaaccagattaaaaatcagtgctctagatttcttcccctacaacaacttggtgatccaatattttttttccttaatgtgcattagaaccttcttctgatgggattagtgtagtgagtaagatgctaattgaagctgaagaaagtagtcaaaggagaagatggcatatggtcttcgttccagacgacggtggagtggacgatgcaaacaagatttgccgacttgttgagacttgtgtcatgagcagtagaactagtgtactgtactgtctttggccatttaattacaggatgtgattattaattctaagacggcgaataataagccactaattaaccaaagaagaatattcgccgtggagattgcaacgaggaccatccccctgagctgtcgtcggtcgccatttgtgctactcatttcatgtagaacccggcggcaaagcgtggtgagtttggtgacaactctgacaattctctcgtcatcttcagagctcgatccatcgccaatttcttcttgtattatcctttcctaattctctcttcagatacaatgattcaacgatagaaccttgaaactcaaccgtcaccgatggatacgcttgccggagaagacgttgcagcgacgggtgaaatgttgacacgccatttccggccgccgccttggtcgtccccccggactctggcagcttccgcgatggctctgccggccaccaccacgcctgcggcttgagctgggatgcatgggaactaacccgccaatctacttacagacatatttagtgggtaacccggggtttaaaaaaaaataatgggtaacccacgaattgacgggtgagttaactactaactagtaatatgcccatgttgaacattacgtgcaatttcattatctctaataactttttaaatttaatgttagaaaaaaatatttttatatgatatgtgcatcgaatcgtttcacctttcttttttcccctccatatcggctcacctttcaatttttttcttcataatattttcctcctatctgttcagcttccatttttccctaatatatttaggttatgttctccaaaagaaacccgtaccctccacacgaagaacaaaactatgaattaatacgtgattaattaattattagctaattttttttaaaaaaaatagattgatataagtgagttcaggtcaactcggtatggcaaaccagactttgaaacgaaagtccaccggttactatttatttgacctatgtgggttgacccactttggtctctacccctgaggcgcttgccggggaaggacaagtctacatctccggatggcaattaggccttctcctgctaatgggccggacacgcatcgctacaaaattcggcccaatttgaattcaacgggcccggtgctcccgggctgggccggcctcttcacacgcatggatccacgtgacgtcacgccacgtcatccaccattcctccattcttcccaaccatctccaccttccccgcatccgcagtcgccgccgatctccctctccgctgtcggagacgacgcggccaccaaaccctagccgcagcagcagcagcagccgcccatggcgagctcacgcgcggatccccgcccgctggcatgaccgcagcggccgccgatggagccggggccttcgtcgccgtcgccgtcgtccgcgtgcgcggatcaccccacgccggcgccggaggaggacgaggagggggggagggggtgggtggtcgtgccggcgagcgaggtcccgggagccgacgcgcccaaggtcatcgactgggaggacctgcagcaggagctcgcacgcgtctggagcctctccgccgcgctcgccaccgccagggaacgcaaggcgctgctcgccgcgcgcctccagtccgcgctcgaggtatttgctcgattaatttgggtttataactcctgatggaatgggcggatcactgggcgcgttctatagcttccgaattcacattctatgcggatagtaggaaccctaggtgtcttctaactttgatctggaaccggaacgatcgatgatttaccttaatgttctcgagtagtagtctctgggggataatttgttagctgtgctgctgcgtggtgctcttttcttaatgttggtgtcgtgttacgattattgttaatcaggagttcagggttaaattctggatgctacatgtctcatgagatgctatggatgcatggattgtattgcggttactagtccttgcatggatgtatgacctgctatgtgtttttgagcaggcaaggaaggcttccgttcagcaggataatgagttggcggaaatcagggaaagagtgcaagcacgtgctgatttcatgtgggatttgaaaatgcacactaagaaaatgaccgaggatgtggatgatcgaagagaggaactccgcatcaagatccgaaccttgtcaacaacaagcaatactcttagcacagcgcgaaataaacttaaggtacaattactttccacataggagatggatcagtggctagattggtgacatgcattttgaatatcaactgttaaggttggtttcctgttaggcatcctagttcatcctctatataggtataactcttgtattcattatgattaagctagaagaacaatgaattaatccttctcctcaaatgctgtatcatctcctttttctcttaattcctcctcttcatccatattgtcccagtgccctttagtagtaatgactgttccttatgatataagaattatcacatctaaatgtgtggtttatagaacaagaaagatacgatgtgcttttaaactgtatatgatgtgcctttttctatttaactaatttttcttgaacctatttttgtaggaagctgataaattgctgtcaggggaaaatggtctccatgtccgtcttaaaactgtggaaaggatgttgcgcacaagacagcaatatatgacagcacaagtagcacatttatatcctgtgagacccttgattgagcgatctccagctaacaagcctagcttcttgaactccagtattctcaaaaccagtatgttaccttttcctgttacaacttccaagctctgtcaagttggtatacctgctttatatccaatgctgcctatgcttgataacatcagaatcttgctatccagaacattcacttgtagttgatgtaaatcagatttatttggacatgctctgtatgatgacaatgttcttcatcacctgatgctgcaacattagattcatatttcttctatcgttgaatagcattgaagcactttgagaatatttgtctgattactaattttgtccaaacaatattgcacacacaggcccgtcgtcacacatttttaaattattttttttaaaacaattgagatgccccttttcattttcagtagtaagaaccagaattaaggtctgccatgaactattgtaatgcatgccattatatgttagaaataagtatcattggtggttagtcatgaagtagtccttagattttcgttgctaggctactggctgtatctctgatgtgaagataactatagaaaaccaattttacctttgttgagatatcacctgttgataacatcaaacatgaagtcatttgcactttttagcttccagtttctggcaactatactagtctacaactctacaatggatgagccttagccaaacaagctgaagacttggagtgatcacttacttttttctcccatagcaaaatgtttagattcttcggtatgagatggtaatcttgaaactattgtcaaaaatttgaatgcatcagaattttgcaggagatgcggaatcaatggctccgaatggttctcaaaatggacaggcacctttggcaattttgggtctccaactatcgaagcttacgatgaaaaagactggctactttagtgacaagactgagattcagaattctgccaccgcattgggttatgttgcacatgtatgtataattgaaactgaaatatatgtccattggagattgatttaggcattcaaatttgattccagtttctttctataagttctctgaattttgtaggttatattctgttatagattgataggatgaagagacatttagaccaatttgacatatatataacccaatattgctggtcatacacattttagaattttacagtgatagacgtggcactacgctatgcaattctttttacttactgctgtttttttattcattcatttttggatcataggcagtgtcccttattgcatcatatcttgatgttcctcttcgatatccgctgcggttgggaggttcacggtcatatgttcttgatcgcgcgccttcagttgagtcatcgtccttagcttctgctataagttctgctcctctgagtacaaccatgcgaacaatggaattccctctgttttttgaaagccaggagacaacaagatcagcatatgcaatatttttgctaaacaaggttggtcttcttgctaagttgcgcgtttatttaatgaaaaagtgtttgattaacatgaatagctataaccatgatggagtaaaatggcaaaaggaaagatatgcctttcccttgatgccctcttattgaagatctgtaaattgttttcccaaatcaccatatcacattatcactagaaaaattggaggctaactacaatcaagcgaagattatttgtgaaaagtcgcatgtaagtctattttctaagagaatattttctaaggcccttgagttagcttcacgttggtgatttagaatcctattcctaagaaaccattagttgtgtttgctatgttgatctaattaggataaatgatcagctcaaatgaatttgacagcataagaaagtaataaaagtgtcagcttgtgaaaattttggcttgttgtatgacaacatgcatagttctgaagaacaaaaatatcagtgcacccttttaataacaaatcattatgcgataatgcagttagcagtttaaaattggaattttcatgtgagtaattctgagtcagctatgtaattcctatacgtaattggttatcaaaattcttgcaacttcgataaagttgtgcatggttatttttcatttggtcatccctccccttctgtttccttgcaggatattgaacaacttctgaatcacattggtgctgaaagtcttggcccgaggcatgtattagctaacctcaagcagctgactactattgtccagtcacagcagtacatttctaattaatttagtcccagaaacatatttgaagttctgtgagagttttgcttacggctaaatccagaagcggttggtgctatttttagcaagcacctttgttttccagaacacagatgagttaaggtttttctttgctgatatgttcactgtaaaatggataaatggatttgtcactgtaaaatgtgctcacttggtgtacaggaaatagatgagtaataaatgagaaatagtttgcatgttcaacttactcttcttgttacacttgttagtaattctttgttttttcttgatgtactacttattagtgctgatttattggaaggaggtacgatttaattttactgctgttgtgagctttcttgtgcctagtcactttcttttcagttctttacaatggtttggaatgttttctattttcctacaatattgtgctgaaacaattcgggaaatataggagataaggccttgtatggcatagctccagatcaaatcaactgtagatttgatatttctatgttaaattatagcggtttaaaattttaaattttatctaaaatagagtgaaatgatttatccaaatgctaatcgcaaactagatctatgaatttgtatttgtgaagctagtaatactcagctctaagaaatcttggattggaagctgtgttaaagagaatctaggttatgtaaatttgaaacaaaggttgcctatgcgtagttttcatagtaaggagaggcaagtagaaatcctaaaacagaaatgaacgtcctaactaagctacactttgctaacaaatctgttgtgtaaagtacccgatctggtaatccgatgagaagggtatggaaacgacgatataatcgaaacccatcgtaacaaaaacataatacatatcacaccgatatcctgtaatctatttgcaaaaaacgctgtattattggatgatccatacgctgctgtcactcttaaaaaagattgatatgctcgtgtacatatgtgaatgttcacagaatacagttcttacaagcaaacctgcttgtcagagtcataacatactcgtacaattttacagtacctcgcacacggatcccatgggtatagtattacaacactgtgcatcatgttcaagtagtagttgcgaccttcgagttaaacagcacaagctgctcttggttgatttgttcacatgtatgaagttcagatgtcttctacaatactcaatagccttctgctaactggtggagcgagaccaggaatgtctcggatagtcttgttctgtgggtttacaatctgcagtgaaacactatgatcatgaaccattcaccataaaaactgaatattccgaccagaagaaacccagaagagggccaaaaattatttttcctttctgggtttttttttagcttctcactaggggagggctaacagctgttcaccaaagcaaaaataatattgatgcaagggtagttctctcatcccctcatctcgccttatgacctctttgtttactactaactgtacaaaaaagttcaatccacaaaggacggagatagacaccatgataagggaagttcaccaaggataaattgatcgagaaatggttgactgatctcatctaaaaaccttacaccgttatattgagaataaatggaaatgtctgttccatagctgacagtggggccatgaactgcttaattggcacacttctatcgccattttgtttttgtttttttttaaaaaaatatataataagcagtgaaatggtaagattgtgtgaagggattccaagagtggaagaatggaatgccaaaattaactgtcaggtaagcagatatatggaaaatctaagcactcaccttaacgactattattgctatgactccagcaacaatgagaaaaagcaaggccatgatgcagcgatcagttgcaacctacatttaagaacagtatgaataaacaataatggggttgacagattatcggtgcctttttaatagatatcgttgagagggtacttacctgcctaccaatttctttcaccatttgtgatgcctttttaatggagaaatgaatggaatccagctcattaacaattctgctcatttgctctgtctggtcaataagaaataaccgaagttagctctggtatatccaggttacacagcatgattggctggtttgagaagaacaaagaaatcctgcctgtgatttgagagcagctgcagtttctgtacctacattgatggtctcttggacggtctgcagaagtcagcaacaaatcagtgccagaaagcaatgatgtgacttagtttgtgggaaagagcacatcaatttgctgtaagacttaaaattacaccctaataaagagtttttgtataagctaaaggaactgaaataacaaaaaaagatcaatacgtgctaagttggaaaatgatgcaacaagctcagttagaagccatatatataaactgaaagaagctacattttgtacctataggagggacaaaacacagaaaaattacatgatactaaatgcaagaaaatgcctagttgatccaataagaaataaaaaaattatgcacttctctttcgaagatatatcaagttgcttagatcttgtctagatcttgcacaacatagtaaagataacctgtttagatcttgcaatagcttgatcagtctcatccattagttggtttccttgatccattaactgttggtttgtcatatctacaaaagaaataattgaccattaaatctaaagaggtgcatatattcatgctagtgatggcatatccgccagaatattcttatcatttcacctgagaaaaaatagaccacctccatatgcacttaaaagggccctagagttgctacttacttgatgctaacaggacattttcttcaccaaagccatcttcaacacttgggccatcaaaaagatcaactcgcttattttcacttgcatatctgaagtccaaacgatcttttgcatgtaagtatcatgtaatgttagccaaagcagtatctgtcaagtttataataaagactaatttggtgaagtgattattagttcaagggcaaccccttataggttcatgtccattaatatgagcctttcacatcacgggataggtataaactcactgtttcttcaaagcaacataggagttcaattctttgatctgcaaaacacgaagagtcaggttaagagggagttgaggactcaggaaagctgaatgtataaaattatatcatagtataaggttctgcggtggtaccattgactgtttcctatcatgaagcatcctagcagtctcaggatcggtacttcctgccatatctttgacaactcgctcaaagtccttgataagcctaaaaatgtatacagagaaaattaagcaaccaaatgtctgtatgattgtatgccgccactgctagatccatcctttcccaaaagaacaaaaatcaattgcatttggagatactgatcagcatcagaacttgtataatactgaattcagtaatgcaatggctatggccaaatctcaactctttccaagtgacacatttgtaatcatagttttcaactgcccacattctgtacaaaagatgctgttctacactaagcagcgtaatatgtgtgaaaagaatggataacctcttgcaatcccgcatcttatcagtgagctcttcgagttgcctgctccgtcgattggcatccttgatcttatccagcttctggaacccatttctgtggacaaatgaagcagattaattatcaatctatcatctaagtcaaacccgtctttttgccgcattacactacaaagattttatttttattttttgcaggttaacagtctgatttccaggctcgcatttcataagcaaacatacagcaagcaagcaagcaagagatccaatgaatattacctctactaaaaacacacataaaccacaagcgaagcgatcgaaatttgaaatggaaaaaatggagaaacggatttcagaacacggcggaaaagattcggagcttactgcaatgcgcggaggatgtcgccgatctggccgtcgatctcggcgagctccgggttgaccgactccaaatccatctcccctcccctacaccggccggaacccgagccccacagggatcacaacaaccaaaagcaacaaaaaaaatccaagcagaaaaaggaatcgttcacgacggcgaccaccaccaccaccaccagagagtaccagaccaaaccccacggcggccggatcgacggggaccgaccaatgctgtgggatcgccgggatcgaggggtcgcggtggtggtccggcggtggtctccgacacagcgctcttgtttttcttttttttttcccctttttgttcgctttcgctttactactaccactagtatctagctcgttgatgctggaattatttcttgaccattttttgttgctgatgcatcgtatcctctctctctctctctctctcggccgtacgatctgcatccgacggttgaggtgagatggtcagcatcaatcaaatcgccctgaaagattttctgaatttccgttttaccgtttttgttttcacgggatatatcaggcggtatgttggtgaagcaagtaaacaacagagctggtgaatatttacacaattctgaaaaatagaatgtaaaacagttattaaaaagatatatttacacatggtccaagataaaatgtttgcactcttttataagtgtcctttatgagggtaatggatctggtcttggttgacttgacattttgtgttcttcttttttggagatgatgaacgtgcacggtcggtagaaggtgccaatccaacctagcatgagctaacatcacatcaagcaaccccggaaattctgctgttttagctgaccatcgtgtctaaactaactaatcacttagtactaatcaggtactagaactctagaaacataattcccctagttcaaactactccaaataaaaaagaggatataacttactactatggagtatatgttaaaggtgaggaaaccagcataacattgagatgaataaacaatatttcgctttttcttcttgctaccaaaccatgtctttacaattgtggcatccacatgcaatgctttcatattatcttttagataatgataacgtcttgaaaatatatcattaactatattttttataatatatataataaatatatttatagttttattatagtattatattttaagacaaaacaatatatgttattatagcgcttctaactaaatattagttattgccagttaaagctagaattaagttttacctcaaccttatataaaacatcaagaattataaaaccggaggaaaaattttgagaaactttctcaagcggaactgagaacatgtcatatgacaattaacacgcgcgaagaacctaacctaaggatgaaaatcgatcttttgatccttcctgcacactctccgctttaaacgcacacgcgcacatctatccgtatgagtacatttgaaagactagcccagtatatattggaattaacgaagtcaccacaagcatattattgcctatattagtttacagtgataagtacgcgctcatgtctgcattatacgggtgtctagtttgtaacttttgaataatggaaatggaatatattttcaagttgtgtcgtgagatataatataaccataagtttgtaaaataagaaaaaagaaagataaaaataaatgaaaataggacaaatcccctttattactttctagtttgtagtatttggaattgaaaaaaaaagtattttattcatcagataaaataggttacgattttccataccagtggattaatccgaaccgttgaattgaccatcggacggtccacagctcgtgcagttgatcatcccgtcctgaaaatcccgcgccacccaaaccccatcgtcttccttccagagcctcacctcgccatcgtcgccatggagcacctcctgctccctctcctcccccaccgcccctcccaacccctcctcctcctcctccgccatcgccgccgcccatccatcccccgggcatcatccggcgacccctcccccaccgcggccgatgctccgacggacgctcagtccgccacgcctccctcctccggcgccaagcccaccggcgtcaagaaccgcctccgcgcgaggaaccaagctcgccgcgtccaggagttcactccgccggcgccgttggggatcaccatgaaatccaagtcgtcgtcgtcgtcgaggccggctgcgtcgaagtcgtcggcgtcggcttcggcttcggcggcgacgcgcagggagaagcagacgaggaggaaggagtgggaggagatgagcatggcggagaaggccggcgagctgtacgtcggggagaaggggctcctcttctggctcaacaagttcgcctacgcctccatcttcatcatggtcggcgcctggatcctcttccgcttcgtcggcccctccattggcctctaccagctcgacgcgccgccgctcgcgcccaccgatgtcttcgccggctcgccgtgagcgcgtcgccgggggcgtgttcttgattaccatcgagatcgagtactctactagattctaggtacctagtgtatagcagatgattaaggaaaatgtggatcatttggtcgaggaagcagaggatgtaaactagtgttgctgtgttggcgaagattggtcgaggaatcagaatgtataaattgcactgcacaattttggagttaaaatgtttgagatattttgctgcgaattgtgggtgtgagtattcctgctatcttgctacaattattaaccaggaaattgttgtgttcctccctggttatcttcactttttgcatgttcttagttacctagtgtagcgtatgattaaggaaatgtggatcatttggtcgaggatgcagaggatgtaaactactgttgctgtgctggcgaagattgatcgaggaatcagaatgtataaattgcagtgcacaattcggagttagaaagttcagatcttctgctgggaattgtgtgggtgcgagaactcctgcatgctgaattccttgttaatctcatctcaccgtgcaggttccaaccatgcttcgttctttttatttttcttcagtcaattgaacttgggatatatgtaacatcttaagtgtaacagagagaactgaatgtgctaaaatgattcagagttcaatgatagtataatgagcaccaattgaacaaacaaaagtagtttctaatgattatttttgttagtaagtataagtactagtacagtactaattacccttttcacatacagatcaccgacttcttcgatccatgatacaacatcctccctaccatttcttcatcagtttgagccagcatttgcatgccatctaatgagtggtaaaccgtcagaatccgagcaatgcagatcatgacaaggatcgcgcgagggaggaggtggagacgagggcggagagcaagccggcgacgagggcgctgttgtaggtggtggcctcgttctgcatcacgttgtcgcgctcgtcgacgaagctgtcgttcttgtacggaccgccgacgagcgcgccggtggcgacgtttgggttgggcttggacgtctccagccacttgtggccgtcgcagccggtgtcgacgtcctccgggatggacgcgccgcggtggtgcaccttctccgggtaccggtcgccgtacccgactaggtaactaatcttcatcgggttgctgcctagcaagtaatccgcctgccaagaacaaagatcactgatcagtgcgtgatcacatccaagttacgtactgtatttctgaacatttctgttctctctgaacatatgttagtctgaacaattgtgaactctggttcatggatgattctgaatcttgttactacctgggacttggcgaatttgcgcaggtcggccggcgagaagccctgcccgctgcagctcagctccgtcttcccggagctctgcatgtagtcgctgtaaaccgcggcgaggaacgccgatgccaccgggtgctggagtgagttccactcggcaacgtacagcaaaccacctgaaataaatcgttgcaagctatctgaaatactactggattattattattaccagctacacaaatggtgaacctgagattgctttttttatttttgcttctgaatcttgtgaatatttaccttctgttctgaaagcggcggtctctgaatccggcaggagaatgcacatgacggcatcagcagtctgcttgtacatcccaagaacatcgtcttgtgcaacgtctgatccttgcgaagcaaagaagctcaccctcgacaaaagaacctgaaactcaaacaaaacaccacaaaaattcacttcataaccatcccaagatttcaaaatttgccatgaacagtggagttgaatcagtggcggtgtcacggtcattatcacccacctcggttccggcgcgcttgtcgtcccagctgaagtatctcgggttgcccaggtcggcgaagtccttgttcttgccggtggcgtaggcgaggtagctgtggttgccggtggcgtggtagagccagctcgccgcccagaggagctcgtcctggtacgtggtggagttgtagaacgcgctgagctccgggaacgtccgggtgtaggatccccggtgcttgtcggcgaaggcgaacagcctctcgccgtggtccaggagcgacgacgagtacgtcttgttgatcgtcttgtacaccaggacgccgccgccatggccgccgccgtctccgccgccac

SEQ ID NO: 43624 - DNA, 12921 bp, Oryza sativa
ctttaggatcacccacctggagatcagaatgccagaagaaattaattgatttcccaagaattggataaagattattcgatcatttgatgatgatcacctggatgtagaggacgtcgtcggaggggtgggcattgacgaggtaatccatgatccaattcagcgcgtcaatggcggagtcgcgctggtcggcggcgcgcatggcgtcgccgtactcgaggacggaccaagagagcatggtggccgtgaacgccatggggaatccgaacttcatgtggtcgccggcgtcgtacatccccttggagagatcaatcccggcctccttgccgtcgtccagcgccgagtcacctctccagtggatcgtgttgttcaccagcttcccggcttcatcgatcaagaacttccatgatcgagatcaaacgcaaaaaaaaaaaatgcatgcaaagttgagaataattccttacatttctggacctggaagaactggagggcgacggcgagcgcgtcggcgtacttgtggtcgacggcgccgggcacgccggggaaggggaagaccccctcgccgttcttgtagcggacgaacaccacggcggcggtgatcgcgagcgccatgagcatcagcaccaggagccagcagcagcaccgcacgcagttcgccatcgatggcgcgccgccccgcccggatcgctcgcgatcacgatctcctcctctcgatcgaacaagaacgccactcgcatcgatcaaggggatgatgattgatttatcaactggaaagccgcgtgcaatgcaacgccgcgcggcgaatcggcggtcaaccgcctcgatcgatcgcgctcgaaggttgcaacggcgaggaagaaaccgatcggctggtcggaacggaatgcggaggtggcgccggcgaggcgaggcgacgagaggcggcagttggtggggagttagaggctcgccatgaccgtctcgaccatccgccacgtaggagttcgttgttgcttatattgggggtgcaaaattaattaaagcaccggttggtttatctcacggtttagttttaaccaccgactctcaaatctcaattgttcaggagacgtacattaccaaaccaaaacacttttgagaaaaaaaaaacaggtttaaattttctgtttgccaaattaatgcatgtcatttttagatgtcggtagccataatgccctcattattgatagtccagtaacttgggtacgtggggaagtggaatccaagggtatgctttacttcacctaccctttacattaccactcgactacacatttattaaatattttctaatcagttcaactggtagtacagtttttacctcttaaattgtgagaaagtatatatctcttcaaggatacgagaaaaactcttcctacaaatattgacgttctcttttacagttgctattgttgtgctgccttacaatgcttctcgggcacaaaaacaatggttgatttttgtgttacaaatgtgctcaattttttggaaaaaaagcccagaagaggcccaaggcccatacggatgctttagcgcgtccgcatttattaatctttctttttgccattagcgtactcacctaatctaatcatcggattaggaaataagtaagcaaacaaaatgatttcatttcattagtttgggttgggggaagaaaggggaaaggcgagcgactagttcgcgagacgcgacgcgagagcgcaacccaacccaacccaacccgcggcgaagaaagcgaggagcgccgccgcagcgggagttcgccgccggcgacgcgctccttgcctcctataccgaaggtacatggctccccaatatccccaccgtctcgctcgcaaatccgtctgattacgcgtttattatccggtcgaatttggggggacgaatagatccatttctagccgattttacatgcaattttaaggggggtttgaattccgtagggtttcatggagcgtgccgctgctgatcggagtggcgcggaggagggggagagcgaatggagggaggagctgcggcagcagcagtcgcaggtcgacgcactgcgggagaggctcgtggaggtcaaggtcgggatgaagtgctccgaggaggactcgaggaaggagctggatcacctctgccgcagggtgaagaccatcgccacgctgctggcctacctcaaatccaaggccaggatcatggcgataccgcacctcgcgcacacgtcctgcgggattaggcaccaggatggcgtggggtacgtcgacaggaacggggtgccactggctgattggtccaagggcggcgagtccgcttcctgcgagggtttagatgatgaaacgtcggcggatagtagtcgtgttgccgaacatggcgatgccaatgagggggatgtagatgtcgaagacattctgaagtcgatacatgtggtgaccgatgtcatggagacccttgtgaagagagtgattgttgctgaatcggaagccgctaacgagaaagagaaggtgaggatgggtctggaagagattaggaggaagaccatacaggttgagtccatgtcggccaaagttgaggaaatggagaaatttgcagtgggtacgaatggtatgctgaatgagatgaggcagagggttgaagacatggtgttggagaccactcgacaaaggcaacgtgcggctgaaaatgagcaggagcttagtcgtgtgaagcatgacttcgagtctctcagaacctatgtcggcactctcgttaatgtcagagaaactcttctttcatcagagaagcagtttgaaacaatggagaaactcttcgacaggtaacttcacaagtatcatgatatttttagtaactattatttgtatgaagtgggttgtacaggattcatttccgagtgcaaactttatattaatttttcagagctttgcaaaaatatctttcatcttcccaatcctgtcattatgtaaacactgctgctagcaaaatcatcattttagggcatgctgctgtagtttaattggacaataaatcctgcacatgcactgtaatccctattcgtcatgtaaattgatgatgctgccaacaccttcatgctaggacatgctgctgagaaaattgttaagacaacatttcatattctaatgcattttgtaaagcacgagccgcttaatgatatgctcatcagctcatgaaaccaactgctctgcaggccttgaactttccttgtgacactgcatatacactagtatcattaaaacacagcatggaaacctattttttgctggcatatatgattgacataaactatgtcacgcattcaagtgtttttcttttggtaataacgttgggctgtcattgactaggagagctctatggtttatcctcaaggcacaaagctacatctattctgttataaattagagtttacactgcatctccagaagccttcttttttgtaacaactatgacctatccccactgtgttgatcaatggtaaagagtgttttgtcagatttgttgatagttgcttttaatcatgctaaatatcattgaaatgagtcatctagagtatttaaatactttgtcaccttttgatatcatagagactattgtcagctgatatggtgttacgttagtgtagtataaatcgaatcatcaagtctaggagttggtccccaacttcacatttaactgcagaaaaattgtgtgttttgatcatgtccaaaatttcgtatggatgttcagttgtcaaaatgatgcatgcttttgtggatatagaattgactaagtctcagtatgttttctactggtttgcatttcagcacttagtccaaaacactttttcttgctgtcctctaaacatgtagttccagttccttcaccttctgatttgagtgatgcgcatcctaatgttaaggaaatgcccatgactgattaaaaacatagaaaattacattcttggctgaggggaaaatcatatgctgtgtaggctcatctttttgtctcctttttccacttgatacagatataatcatttttcatggtcttggaatcatgcagagaaggctgctgtaaaacccatgatacctcaaataagttccctaacagtcgcatatgaaactacatattcgtaaacataacatagcattgacttatagtgttccttctgttaatcgcctagataagtacgtactcatgggtgatttatgaattggtgaagcaagtggtatccaatcctttcattccaaacaatcaatttggtattaagttttgtgttcttgtgaacaggctagttgcaagaaccaaccaacttgagagtgagaaagcacaaaaagaagccgaagtccagaaggtggtggaggagaatgtgaggctgcgtgcgatgattgataagaaggaagcgcagcttcaggcgatgagtgagcagtgcaagttcatggcgctgagccgtcccaactagctggatacttcctccgtcccaaaaaaaaaggcaaaccctgggttttcgtgtccaactttaacggtccgtcttatatgaaatttttttataattcatattttcattattgttagatgataaaacatgattaatattttatgcgtgacttgtcttttttatttttttcataattttttcaaataagatggacggtcaaacgttggacacggaaaccagggtttgtttttttttggaacggagggagtacatatgacaagctgttacgcttgttcaatgatgccacttacgaattaccgtcactgcattgttgcaacaagaagaagagctccagatagatgtggcgaaacaacggatggtgccaactgctggcgagtccgttccaggcactctgattgctgctgctgcaaacaaattgtttaccttaatgtaggtgtgatgtgttgggactgtaaacctgacatctttgtattcttgtaacttggaatttgtgtaaaaaaaaaaaccagggcacatttgtccgaatccataaatcctctgaaaaatgagctgcaattcatcgaatctgctctagttgcgctgcatttccatcagggtgaaagttgtcgcgtatattttgcatctttccagctacaatttcatctggttgctgaagtgatcttgcaactaattatacggttgtggaccccactgtcagtggatcagtggatgaagagattaatcctataaacgctttacagctcggatcacgagaccatcgtaattgaatgtgccaaacaaacaatccatgtacagtaacaaacccagctgcgactcgaccctgaagcctacgcgggcacgcggcgcagcgccccacccaagtcgtggacctcgtggtggtgaagggtagtaggcgacggcttcactactactacttgtactgcgagccacacgcagccaccgcgcaaaacccacgcgaccccttcctcctccgcctcgacccgatccgatctgagccagagccagccatggcggcgactagggtttggctctccgccctcctcctcgccttcctcctcgccgccgcccccgtcgtccaaggtaaacaccctcgttgcgcaccgattcgtccctccctttctcttctctgccccgcgccccgccgcgtagatccggggccgcgtagatgagcgccgatctcgataattcgcggcggggcagcggtagatctgcgcgctttgcccctccgcgggtgtggtaattgagccgatcgggctctgtggtgttgcaccggaggaggttgatgtttggagcaagtttaggtgggtattatatgaatagatcggtgtgtgggggcgggattctagacgcgacgtcttgggaagagtttgttggtgtgcaattttcatgataaaaatgtttctgcgtttgcatatttgttatcaaagtaacgcagccatctgaggctggagctttctgaaattgagacgggtttttcatgtatggttaacgatggtagattggtaggataggtttctatggtaatttttaacactgtaaaattttggaaccatgccatttaagattggttaaaattgagaataccatgctgctccaagcctccgacaagctctttcataattggaaaattgggatgtattattagcagaatctctgtttagaatagccaaccaagtgatgacgtatattctaaatttaccgatgaggttctagggctgaaaatggtactgttttctctgctatgctcctttgaactgaattttcctgcagttgccagagctcagtccatggaagaagctgctacagctgaagttgttgatggggctgatctaggaatcgtcagtgatgatacacaagtttccagcgatgggcctctaagtccggctcctggtgtggagacagtatgtgtttttcccaaaaacgctggcaaaagtgagtgtcaaatcacaatctcagcaaaatcatttatttgaaattcactcgctagtactgtaattcatttgcaatcatttcccttaatgtttaatatgaaatattctaaactaaattgctagttctgttcatctgataggattctattctatgcatatctgtaggatcttgtctattcttaatatttgcatgccatgtttggaaacatgttttgtttaaaatcagcatcatatccttgttgacttcaataagcaataatgtttcccttttcttgttttattgtagttgtgctagcaggtgaagaaactgaactactggttggcctgcaaaacgagggtaactcatgctgtttctttcatgaaatattcccggttgccacttcagttacttagctatgattagtgtttggcttgggctatctctatttatcttaaatcgaccagtagatttgcacttcatctaaacaggccatgcatatttgtctcagttatttgctttctgtgtagtaagttattgcaagttcatgtccatttggcttaagtatcatatccaggtcatgagattgtttcaatatgtactaggttggttgaaactgccatgttttctatataggattaactaataacagatcaccaaatgggcaatatgagttgtaagatgcatatgttcacgtcccttaatagcactagtttttcagctgcctttgatgcaaatgtgtctttcatgtattttcctatatcatgtaaattgatgcgtcagagcagatgcatagccatattagtgtgttcttttgttgccaagaatatgtgggtccaataaggaataaccttatgttagagatcactagtttaccgtacatgacattttcataaacgagcaaatttttcttgttttggcaatgtagattctgagttcaatagtttaatattctttttaccatgctagttcaaatgttttgttcttagtttgcttagagtcaaacaccctttgcatatgttgtgtttacaggtgaatcaactttgaatgttgttgctatccattcaactctccatcttccttttgaccataagatgtatggacaaaaccttactgttcaggtgaggaaatgtgggagcgttcttgtttttactacctgaacagctgaacttctgaaattaacctattgatgtgtgcaccatcaaactttcctatttattgataatttatttaatcctgcctgctctagagatataatgtattttgttttaactttgaacaccgagaaataactgttcggatcttgttctgttatgttttcattagatatctgtatttctgcttctcagtagtattatatgttatttgtctttaagtgaagttgaatcacacaatttattgagtcaagcacacattcttggaatgctatgttctaattcataactatgcttattttgtggtttctttttttgcagaacttcttcaatgcatcagttcctgtctctgtacaagcaacctttccgtatacattcgccgtgagcaagttcttgcaggtttgttaattcacaacgctaaccattgaaacaatcttaactataagatcaagttgtgtacattttgcattcatgacgtcctaatgcctgtctccttgcagcctggagcatatgatctagttggttacatagtgtatgagattgatcagaacccataccagaatgtcttttacaatggcactgtagaggttgttgaggctggaggtttactcagcgttgagtctgtgttccttattacccttggagttgcccttcttggtctcttcggattgtgggcatatggtcaagtacaacagctctcaaaggtatgtttctaatttgttgcgatacaggttagctggacatttgagctgtgtacgtttatctcatcaatcatttctgcgtgctgtagaaaacaaagaaggcccccaaggtggaactgggaactggaactactgatgccaacatggatgagtggctggaggtttgtttcgctgctcaccgaacatcatattgatcgattattgtgagccccatgcagaagattaacttttgagttcattgatgtggcagggcactgcatttgcacagggaagcaaatccaagaagaagaaatagattggaggcccttgaactctagttaatcattttcaggatctagaatgagacagttgagggtagcccttcacaagtaacttttgcagacgatagatgagaaaatggaggtgttttaaaccgtagtttcgtggctgctgcacatgtttgttgacaccaaatttcgaccttgttgtgtacttttacatgaaagttttttcttgaaaaacacagttttgttcaaggtatatgctatggatgtgatctctgatcttatttgatctgtgacatgccgaataacataagttcgatctgagagatgctgaatcacataaatttttattagttgcatacttgcagtgtcaactctgggattttctcagaaaatactggaatgatacatatacacgctctgctgtttttgtttttggttttctgtctgtatcgtggtacgctctgcttctgcttctatggaatgaagagtgtgtgtgtgttttccctctggtggagtatgttgcagttatatatacccactgtgtaataggcttggcttgtagggctggtttggttaggggcctaaaaatttttgtgaatgttaaattttagtaacttttggcatggctaattttggcaaaggtaaaattgtgtttatattgaagccaaagcctaaattaactgttgaaatggcctatttttttaggcaagccaaaatttggctccaaaccaaataaacaattaacactattgaaattgctaaatattggtaagaccaatttagacctcaaaccaaaccagcccgtaatatctctctttcctgcgttctttcaattttccgtttctaatgacgttgagaactccctccgtccgtcctatactcactctctctcatatagaagtaagtgattttgaagggatgtaacatattcgtgttacaaatctgacaaatccccaatactacggaactgcttgttaatcgccgtgtagaatgtccatcatgtatgatgtcactggccgttaatgtcctgacgtcactccacgcggcattaggcccattaatgcgcaactaaacgtccgccttcttgggccgtaaacgggcctgatgctctgattagcttttgaatgggcctttaacaggtcctgacgttcagtcattaggccttatttgcttttacatctgttctttattactctccccatttcaaaatataagacacaaagaaataattattatcatattataatttggatcatcctaataaatataatgcatgcattcaatagagttagagaatgtgagagaagaatttaaaaaggtagtaatttaatttagaatatgtcatagttaatggcatacatgcatgtcatagttcgtgctacagctggctacagatccgtagtccactgctcttctatttcatcttttatctcattaaaatatgtttatagctggctaatagtctgttataatacctactcttgtattatgaaatggagggagtaattttatagatataaaatcaggaagaagaaacagaaccataaaccataatccatcatcaagaaatcccacacccggaaaactttaactgaaggagtgcacaaaacctgcctctcatgtctgttagtctgtatcaagaatcaactcagattagagagccaaagaccaatagacggaacaaaaaaaaaaaggaaaggaaaccggaggtagcagtgagggatactgctactgagaagaagagcatcagagtcatggaagacgagcaacacagcttagcaaaataaaaataagccaagcttctgcttctcaagcaggatatacatgtcgtcatctgcacttccttcttagcagcaacagcaacttacccccacaaagcaaataaacaaccaaatcatagcacaagtggagcatacatactactactagtattttagtagaatagaaaaaaaaaaacgcaacttggcgacgaattaacccaaattaaaataacaagagagagcaactcgggcagagggaaaaattcgagctcagaagtcagaactgatgagcaaattaaatactactcgaatcaaggaagaagttaatagtgatcgactgttttcactcgtaaggcaagcggctaaacgccaaaacgaacattctaacggggcgaccaagttgccagttcaccatccgaaatgaatgtagtactagtaaatcattaagtacagtaaaccatagcagccagaggtcacttgcatcaaactttacagtgaaagaaacggccggtggtaaacgtgcggtatctgtatgtacatggcaggagcaattgggttgccatttatcccagcaatcacaaggtaggagtctaggaccagcagcaatggggttaaccaacaaaacatatgcccagctttgctctagtgtacacaatttacttgtcaaacagaagcgcacctatccaaatcttatggattctactgcctgactaggcttcttcttgagcttacaaatttacttgccaggttggggaatacaggttgcaacttgcgagcagaccgagcaagccggcagtaacagagatgcttcctgatacaccatatgagaaaaaacggtctgtggttatagttatgcaatcagtgaaaggaacatgggttaacagtagcaagaagttctttcttgataaaatcaccttatcagctacttctgttgagggatagaatcgctgcaaaacttcttgaaagtttggcactcgtcaaccaaaaagtcactgcaaattttggcacaaatcagcaaattggactcatgaaaacttctgtagatgcaatataggagaactagaaacttactagatgcgttcaaccatttctgttggatcccatctagggctccagggatagtcatttactggagctgacatgataggtaacccctgggcattgaagtgctgcggaggattcaccacaaaaaaggttatttccccacaccttgaaagaacaatttaacatacagagtaacttacaagggcaacacctgccctctctagccagtagatgctaaatcaacactacaagtcaatcaataacaaaagaaggttaacacatcatagtcttgcatgtttacttttttatcattttcaggaagaaaatggtccatccattagagaggtgaattggaaggggtgaaatgaaatggaatagtataacagctgttggtctcatttttgcctccccataggatctccaaaaaagaaaaacgatgtgtctgtgtttctgtgtgttttgtttgggtagatgggctataggtatcatccttgttcacttctactgactacccagctctaaatgctgatatcaacaacaagacctctattgagcatgtaagttacaactagcaataagcagtgacaaaccaaataaatacctgagaactctctaatgtcagcacaggttgatgcttagggaattggaggggaatgacaaagtggacctgcagcagttacatgatatatattgttagtaatatactaactggtagaaaattaaagtcatattccactagtactttttcattacagttctaaagctgtatcagatcgctggtcagattggaaaacagatagcagtcatgtaatggaaaaacagagaaagcactagattcacaaattttatgacataccagaaaagtgaaaatccctgagatggaaagaatcgtagcttttctgcaaaaaatctgaagtgtggacaggttggtagacaatttggcaaagcagacaataacatacgaaaacaatggcaaacaagtaccggatcagcctctaatggccttccaaaagtaggagccaatgcttcaatgaaacgtcttctagaaccaattgaagctgatgcttccacaaccttcggtatagattagaaacataagttttgtataacagacacgagttgcacgattaatgctatgccatgctacctttagcaatacctcatctaactgataaatgattcagtagtagctagtttccagtaagtctagtatgcttaaaataatgggaaaggatgtacattttatgcataaaggtacttccactaaataataagattgaaatacaggaaattttttcttgcttgaatcacctaaacaattcaacaatagcatcagatctactgtctatccttttcttttattcctcaatcctcacttattttccgcacactatttttcaaaggatgattagtcattccattaacatgacaactacactacgatgtaaagtagtaatactatcaacaataagagcaggcagtcaagaccaacagttacatgcaaaacttaaagctatagtacctggattttaagattttcttccaagttaggaagatactcagccatgcaccttcacaattcaggccaagaaaggaagcacacatcagcgacagttactttacttctttgaaatgttg

SEQ ID NO: 43625 - DNA, 1889 bp, Oryza sativa
  unsure (1)..(1889): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttaggttgtgttctgatgcaagatgggaaggtggttgcctatgcatctcgtcagttacgtccgcatgagaagaactaccctactcatgatcttgagttagccgcagtggttcatgcgttgaagatttggcgtcactacctctttggtactcgtacggaggtgtacacggattacaagagtttgaagtatatcttcacccagccagatctgaacatgaggcagcgaagatggttggaactgattaaggattatgacatgggaattcattatcacccaggaaaggctaatgttgtagcagatgctctcagcagaaaaggctattgcaatgctacggaaggacgacagttgccgtgggaattatgcaaggaatttgaaagattgaatttgggaattgtcagtagaggtttcgttgcaggattagaagcgaagcccactctcatcgaccaggttagagaagctcaaatcaatgatcctaatattcaagagattaagaagaacatgagaagaggaaaggctattgggtatttggaagatgagcaaggaaccgtatggttgggcgagagaatttgtgtcccagagaacaaggagttgaaagatgcaatcttgaaggaagctcatgacactttatactccattcaccctggtagtaccaagatgtaccaagatctcaaggagaaattttggtgggcaagtatgaagcgtgagatagcggagtatgtagctgtgtgtgatgtttgttagcgagtcaaggcagaacatcagaaacccgcaggtttgctgcaacctttgaaaataccagaatggaagtgggaggaaattgggatggatttcatcactggtctacccagaacgtcatcgggccatgactctatttgggtgatagtcgacagacttaccaaagtggctcatttcatcccggtgaggacaacatattccggaagccgtttggtggaattgtatatggcaaggattgtgtgtttgcatggtgttcctaagaaaatagtatccaatcgaggtagccaatttacttcaaagttttagaagaagcttcaggaagaggtgggttccaagctgaactttagtaccgcttatcatccacaaacagacggacaaactgaaagggtaaatcagattttggaagacatattgagagcttgtgctttagacttcggtggaagttgggataagaatctgccttacgcggaattctcatacaacaacagttatcaagctagtctccaaatggctccttatgaagcactgtatggtcggaagtgccgcactccgctgttgtgggatcaaacgggagaacgtcaggttttcgggaccgatatcctgagggaagcagaagagaaggtaaagatcattcaagaaagattgcgtatagctcagtctcgtcataagagttatgctgataatcgtcgtagggatttaagtttcgaggaaggagatcatgtgtaccttcatgtcacgcctcttcggggtgttcatcgttttcacaccaaggaaaattggcaccgcgttttgtgggatctta

SEQ ID NO: 43626 - DNA, 77813 bp, Oryza sativa
  unsure (1)..(77813): unsure at all n locations
acggatacttcctgcatattctaaggaaatccttcacgaaatctatagattggaagaatcctactcggacaagactgggtcgttgacgtatcgtataaggtctgataccttcgagttctacttggaaacctccagacctgcgatataaaagggaccccccggggagcctgcaagggatcgaatctcagagccaacacaacccacacagcctacgaagccggagcctgcaaggagccaagccatcaagatctagtcgaaccaactcgactacgatctcgccggatccgacaagttccactgttccctttgtaacctgtgttttccactatataatcccacatcgactggattagggctattacctatcaaggggcctgaaccagtataattctcgtcttttgtttgcttaatgtcgtattacatagatccttgtaccaacgtaccccaataccctctatatccggtctacgggtaccactcgtcgacagtggcgcgccaggtagggggacttggtgctcaaggttctactattatgtcatccagcttcgtcgacaacagcgtcaacaccaacctcagccaagtactccctgcttcaacgatgctggtgtggactcaagtcagtgaaatcgtcttcctggtttacaccacaatgccgatctcaaccggtcccccaatgaccggacacgagaacacagtggctacaagccaaggcgactccatgtcgaaaaattgtcccgccgagacggagaatggagcatcgacaacatccgagctcgagaaggattctgatacggccaaacattgtccttccgacatgaaccgcgagctgacgaagatgacttccgaagccacaaggtcctggtgtcctatccacaaaaccaggaaacacactctgcaagcctgctgggttttcctcaacgtccgcgctgaaattcgcgcctgcaaagaacgtggaattcagcgtacttctccaactcgtgatgtctattgtcctattcacaagacaaagaatcacgacctctcaagctgcaaggtctttctcggcaccatgaaagctccgtctcctaaattatacgtccccatcagggataacggcatggaacaaggagcgactccaacttcagatcgattcgttggggtaatcgatatcgatcctcacgaaccattagtcttacaccttctcgaagactatgggtcatcgacaacgagcgcgccgcgggaggtattggccatcgatgacgttggcatgtcagcgcacgccaacgcagaagcggggaatcaatcgactactccagcccagcacattagggccgttcaagctatactgagggaaactccctacgatcccgttctgaacgatgacctcgagcgttggacagaacgactacgggaatcagtgaccaacctcagcaatgcattcgaagaagccgctaccgcagcgcacccggagcagccaccaattggcgatgccaatggtgaagacccggaacgaagggaatcacctcaacgagctacccctccacctcgcggcactggcgatctctgagatcaaatcaacagccaccgagaagcacgacgcacacgagacaatgtgaatcgttctcggcgtcatgtctcttcatggcgccatgataatggaaatcgaggagaccgctcaaacgaggaccgagaccaggacaaccaccacgatcacaacgatcgcgaacgacgggtgccagacaatattggtcgaggccgtcgccataacgacgatgatgacggagatcggcgccgagacaacagcgggagacgacgacaggattcccgagatccaggccgacatcctcgtaatcgtacgccggaaccaagcgacccattgtcatcgtcatcatccgcgtcctcctcatcgtcaggcagacatccacgaaggacacacgaccgccgacaacccaccgcccctaacgctgggtgtagggctttctgtcgtttcctgcgagatgtcctatggcctgagagattccgacctggagcaatagaaaagtactctacgctgttgaatgatgggagcaccgacccagaggagttccttcaagtctactccacagtactctacgctgccggagcagacgacaacgcgtttgcgaattatttaccaacagtgttgaaaggttctgcacgttcatggctgatgcatcttcctccctactcaatctcttcatgggcagacctgtggcagcagttcgtcgccaatttccaaggaacatacaagcaccacgcgatcaaagatgacctacacgcgttgacacagaactcgggtgaatcattgagggaatacgttcggcgcttcaacgagtgcagaaatacaatccccaaaatcactgatgcttctgtaattcgcgccttcaaatccggtgtcagagatcgctacactacctaggagttggcgacaagacgcatcacaactactcggagattgttcgagattgttgagcgatgcgcccatgcagatgatgcgctaagacgcaagaacgataagccgaagaccgggggagagaagaaaccagccacggacgcatctgagtcaagcaagaagaagaatcgcaaaaatgggaaaaggaaagctcaagcggaagtcctcgcagcagaatacgcgaaccctcccaagcgcccagacccacaaagtagcgacataaagaaagcatggtgccccatacacaagacgaacatacattctctggaagattgccctgttttcaaaaaatcgctcgagaaacacatcacatttgaaaaaggcaagcaagtacgcgtgatcgagaagaacgaggaggcggttcctcacgaatcggattcagcgtatccagactccgacctccacgtttcacacatcttcagcggttccacaacatactcctcaaagcggaaatacaagaaagtggaacgtgaagtctgttcgacatggcagggggctgcacccaagatgaagtggtctgaacagaggatagagttctcggaagaagatcaccccaagaccgccgtcatcccaggacgatatccgatcgtggtcgaacccactattcggaacatcaaggtagcgcgagtccttatcgacggtggcagctcaatcaatcttcttttcgccagcactttggacgcgatgggaattccgtaaagcgagttgacaccaaccgatcaacccttccacggaattactccccaatcatcgtccagaccattaggcaagattacgttgcccgtgactttcggccaagccaacaactttcgaacagagcagatcacctttgatgtagctgaattcgatacaacttacaacgccatcatcgggagaactgcacttgcgaagttcatggccgcatctcactacgcgtatcaagtgctcaagatgccgggaccgaagggaacaatcactattcaagggaacgcaaagctggaggtacagtgcgacaagcggagcctcgacatggtcgagcaaacgcccagcccacccgccacgactgagccacccaagaaagtgagcaagacaaacaagacgccgaaaccggacggcgccatcaagattgttccactctccagtgccaaccccaacaagaccgtcaaaatcggggcgacactaattgagaaataggaactcgcgctcatcaccttcctccgcgataatgccgacgtgttcgcttggcagccgtccgacatgccgggggtccccagggaggtgattgagcacaaactcatgatgcgacccgatgccaagccagtaaagcaaagactgcggagatttgcaccagaccgaaaacaagccatacgagaagagctcgacaaacttctcaaagccggcttcatcagagaagtacttcatccagagtggctagccaatccagtcatggtgcggaaggccaacggaaaatggagaatgtgcgtcgacttcaccgacctcaataaggcgtgccccaaggatcacttccctctccctcgaatagatcaactggtggattcaacagccggctgcgagctgttgagcttcctcgacgcttactctggctaccaccaaatcagcatggcaaaagaggatgaagagaagacaacattcatcacgccgttcggggtattttgctatgttaagatgtcgttcggactgataaccgcagggaataccttccagcgcatggtccagggcgcacttagggaccagctcggcaacaatgtcgaggcatacgtcgacgacatcgttgtcaaaaccaagacaggcgactcattgattgacgatctgcggcaaacgttcgacaacctccgacgatatcgcctcatgctcaatccagagaagtgcacgttcggagtaccgtcgggcaagctgctcggattccttgtttctggcagaggaatagaagcaaacctcgagaagatcaaggcaatcgagaacatgaagtcgcccacaagactcaaggaggtacaaaagctaaccagatgcatggcggcactgagcaggtttgtcgttaggatgggagaatgagcacaacctttcttcgctcttttgaagaaacaagacaaatttgtatagacacaggaagccgaagaggcattcgttgcactcaagcgctacctatcaaaccgccctgtacttgttgctccccaacctaatgaagaattattcctctatatcgctgccacgccatattccgttagcaccgtcattgttgtcgagagagagaaagtacaacgaccagtctattacgtcagcgaagctctccacgacgcaaagacaagatacccacagatccaaaagctgctttacgcggtcatcatgacatcaaggaagctacgccactactttcaagcccacagagtcacagtcgtctcctccttccctctcggcgaagttgtgagaaacaaagacgttgtcggctgcattgcgaaatgggtagtcgagctgagccagtttgatgtccactttgtgccacgaacagccatcaagtcccaggtactcgccgatttcattgccgattggactatgccagataacaaatcagacaaccaagtcgacaacgaaacatggacaatggcgttcgatggcgcactcaacagccaaggagcaggggcaggatttatcttgacatctccctctggagatcaattcaagcacgcaattcacctcaacttcagggcgaccaataacatagtagaatacgaaggactactcgccgggataagagctgcagctgcacttggggtcaagcgactaatcgtcaaaggggacttcgagctagtcgcgaaccaggtgcacaaagattataaatgctctaaccccgagttatccaagtatctcgcagaagtcagtaagctagagaaaatgtttgatgggatcgaggtccgacacatctaccgcaaggacaacatcgagcaagacgacctagcacgacgtgcgtccagacgagaaccgctcaagcccggcacttttctcgacatccggacgaagccatcagtgaaagaggttagcggcgaagttagcccggacacccccgacattagctcggaggtcaccaaggcagaacgcgccgttgccgatatcgagaccacagacaactggcacatcccactaatcaaattcatcaacagcgaggagttgccagaggacgatatagaggctgagaaaataacccgtaaagcaaagatctactgtatggtcggcaatgatctatacaagaaagcgtcaaacggggtacttctcaaatgtgtctcgtccgacgacggcaaacacctcctcctcgatatacatgaaggcatttgtgtgtcacacgccgccggctggacattggtcgggaaagcttttcgacaaggttttttctggccaaccgcccttaaagatgcatgcgacatggtccagcaatgtgaagcctgtcaattccacaataaacacacaaagctacccgcgcaagcgctccagactatccctctgacttggccgttctcgtgctgggggctcgatatacttgggccattcccacgaggatagggcggctacagattcctattcgtggcgatcgacaagttcaccaaatggatcgaagcagtacccacgggggaaatcaaggccgacaacgccatcaaattcatcaaagggatattttgcagatacgggctaccgcaccgcatcataactgacaacggctcccagttcatcagcgccgatttccaggattactgcatcgggctgggggtcaaaatatgcttcgcctcggactctcaccctcaaagcaacagacaagtcgagagggcaaacagcatagtactacaagggataaaaacccgcgtctacgacagactcatgtcacacgacaaaaaatgggttgaagaactcccatcagtactatgggccgtacgcaccacaccgacaacgtctaacaaggaaacacccttctttctcgtgtatggctctgaggctatgctccccgacgagctacgacatcagagtacacgagtacagaagcactccgacgaggaccaggaggaacagtgggacatcgatgtaaatcttctcgaggagcatcgtgaacgagttgccatttgagcagccagctatcaacaggcactccgccgttaccacgagaagcgcatccgagcacgcatactttcgatcagtgactatgtcctccgacgggttcaaagccaagtagggcggaacaagctctcacccaaatggtaaggaccctacacgatcacacaagtcttacgtccaggcgcattcaaaattgcagacggcgaaggtcgcgagttagcaaattcttggaatattgaccaactacgtaaattctatgtatgactcaatgccatccgtacctgtaagacaccttacagtatcaataaagcctagtcttaggcccatgtcacaatcaaagtgtttttgcccaatgatcccttaccctaatgacacctagcgttgaaacatgtcctcatgtccctttacgccgtcttgacaaggcctccgaggaacctaagggatcttcggctggggacacccagagccgataaggccttgtcagatcctgtagagatgaaagaccatgtaagatctggtcgtgtaagagttctcgccgtgcgtattaaccaagccgtgaaatcagaaatcaactttccaacttcatggctggggactaggatcagagcttattcaaccaaggcgggtcaaaggtccaagagccttatcctccgagaaaattcctccgacgacaaggctaggggctagggagagtgtacgactcaaacggctgactaaagtcgtgaactgagaacgcactcttacacacgacatccagagtaagaaacatctgttaaagatagatttcttttctatttcacaaaatacttcttacagttttttacacaaatctttcgctacattatacctttttcctaagatatctgtcacagggtacgaatactaccaagaaggccaacgccagtccatagactggaagatcttctcggccaatggcaacatcgacctcgccagatggtctatctccgccggagtcctccgagaacgagcaaaaccctcatggagaaagtcgaggtccaagcgcggacgatgatctcgtaggcaagccagcacgtgtcctccggcgtatcggctcgatcgacgacactcctgcttcaaggcctcgtcgatacgcttgccgatgccatcgagttgggcacaggccccgttcagccatgagatgtatccggccaccgactcctcgggatctccgcgaaccattcgaagttctctacagaccctggccatggatgtgcagcaactcttcaagtacgagttaaaccacacctcacgacctcggagcgtttccacagcctgctctttcttcactgccagcatggttctctcgagttccgctacttcaaacttcgtcttccagtattggatacgacgatcttgaccaacaagggcaccctcgagatctgcttaatgtgataacgactaagtcaagctgtacacctctttcgagtacacagttgatctagccgggagggcatcaaggggtgaatggactactaacctgaggaaatcgtcgtcatccctgtctccataacaagggtctggtccacattgtcgggcgacacgtgtggttcaaactcgagaatcggaattatcaccagtgactcgggctgcccgcgctgctagacatcctcgttatcagcatctctacaaaggacaaaagctcccgaggtcaacacacaaaagtaaactagaatgataattgcacgcgcgaaggcggtcagaactcaagttttacacagcatgtcttggaagtacaagaagtcctactcttcaaataggggagaacagactcccctagatcgccgactccttccatcacctccttacgcgtgtcgctggccgccccctgatctaagatctcgcgcagatcgagttcaggatgcgacagctttacacacgcgaggacatgacacgcctcggtgtagatcccgttcgacgtctcctccgcaatcctggcggcatgcttggaagggatttcccccatcgccgtcaccagttccgcaagggaggaggtcagcgagaactcgtcaggattcaccgggatggtagacttgagctgcactccccggcgaactggtgcaggccagtgtaggtgacccgcaacgaaccccggatttccgacaggttgttcccgagttccgacatgcggtcctcgagccccttccattgtcgctcattgccggccaccaattccctcatcttcatgaggtcttcatgggcttcagccaactcgcgcaccagtcagtcagcacgcgcgttcgccagcgctgcttccgacctcgcctctgcaatctcgcggctgatgccgcgagcaccagcttcgaggaggcgccccatcttgacttggagctcctcctaggtgaggacggcaactggtggatcatgacctgccgcgggatcgctgactgggccgctaggcgtcgcctcccggctcccagctgcaggcacgacatccgtcgaggccgcggcaagcgacacgctggaagtccctccggacctggcttgcacagcctttgctcgcgtctccctacgggacgaccacgggtcagacaacgcttgaatggaatcacggaaacctaaaaattcatctacttacttttcgccaaccgtcacaagacgttgtcgtcgtggaggcgggggagacgcgtccaaggcctgaaagacaaccaatgtgaagtaaggcaaaatccttctggctgcgcgatcttgcgacaggataacttaccgagggggtcgacgccttgcgacgatgtccgcttacagaggagaacttcctcccctttgtcggaacattgccaccactagtagtggcagcagcagcatcagacgcctcctttgcgaccttctctttcagggacgccgccacctgatggtccgcgagcggcccgatgatgtcagtcagaggaagagcctacgcttaatcaagtcataaggtgatctcgaaggaaaaatgcgcgatgcttatcggatgcacttacgttgatagcatcatcacgttcggccgcccccttttcacaaaggggcgtggggatgttgctcgccattgtcagaccgctgatcatcacctggccaacacggcgctccacggcttcgctattcagacctgtgaatcgagaaccaaatttcaatgagtcaataagaacgcgaacataagcatgtcaggataaatgcgagaaagatacctcgaggagaaacccgggtcgcgtcctccggtccagaatagttataagcgggatgggcctgagcctggagcggctggattcgcctaccaacgaagtctgcaacgacttcataccctgacaagcctcgtactcggagatcatcgatgatgttgataaacgactgaaggggggctttgcggtccaagacgaaatcttgtccggttgttctttgggaacaacgaagacagggttcgaatctttgatctcaaggtagaaccacctattccgccatttgctgcgagaagatgggcactggaaggagatataacgcgacttcaggccatcccgaagtcggaacccgacgcaaccagctaccctgttggactccatccaacgcagttcatagtaagagcgaaagagatcaagaaaaggctctaccccaatgtaggcctcacaaagatgcgcaaagatgctaagaaaggcgatagaagttcaaaaccaggagaagaaactcggaaggcggaggaagaaaaccgtagagaacataatcttcgatcgtaaccatgtgacccaagatgggctagggattagtacctcctacttccctctccatggttccacggccaggaagggcaccgtcttcctgacgcttcttcagcgacgcactggtggaagatgatttgccgaggtccattgctgatcgaagatcgccggagaaagggcttaggttgatgaactggggtttcttgtgccggcgaagaaggcgaagatcgctcacaggtggaatgttttcaacacggttggcggacttcaaaatggatccccaaaatttctttaaataggcgcactaccgacggtgcgaattccaaggaacagagagagatgcccgccagaaatttctgggtccgttacgcgcggcggttttttggacttcagtttaaaattcgctcgtgaccgttgggcttcaaatggcgtgctcgactacggcctgtctctgcggtcctcgcaccgggaacgacaacagtttcgacacccgaagtcgtgaatggttacacgagctcattttaagcggaagtcgggggctactgtcagggttacgggttaggcataccctttacccttcgatatacgtcacatatcggtatggtatacccacgcgcatacggatacttcctgcatattctaaggaaatccttcacgaaatctacagatgggaagaatcctactcggacaagactgggtcgttggcgtatcgtatagggtctgatacctccgagttctacttggaaacctccagacctgcgatataaaagggaccccccggggagcctgcaagggatcgaatctcagagccaacacaacccacacagcctacgaagccatcaagatctagtcgaaccaactcgactacaatctcgccggatccgacaagttccactgttccctttgtaaccaatgttttccactatataatcccacatcgactggattagggctattacctatcaaggggcctgaaccagtataattctcgtcttttgtttgcttgatgtcgtactacgtagatccttgtaccaacgtaccccaataccctctatatccggtctacgggtaccactcgtcaacaaggtcgcctatcagttggagttacctcaatccttggcaggtgtccataatgtgtttcatgtgtcacagttaaagaaatgtttaagggtacccactgaagaagctaatcttgaacagatagaaatccaagtggatctgacatatgttgagaaaccaatccgtatcttggagacagatgagagaaggaccaggaatcgagttatctgtttctgtaaggtccaatggagtaatcactcggaagaagaagctacttgggagcgagaagatgaattaaagtcagctcatccgcatcttttcgccagctcttccgaatctcggggatgagattctgtttaaggggggtaggtttgtcacaccctgaaaatactaaatttataaattgttgtttaaatggaattattagaaatgattttaaaagccgagaagaaaagatctaattttaaataataaattccaatataaaagtgggccagataaaattttattaaatacttcacttgattctatagttcttagatttttctgggatttatttgagccaaggaagtatttttaataaatagaattgcatttcatgaataagttaaaaagaaaaaggttttaaaaatcctcttttggctttgggccgaaagtcggcccaaaacctctctctctccccggcccaagcgcgccccggcctagtcagcccgccgagccgagccgccgctctccccctctctctcccgctgacaggtggggcccacctgtcagggtcgtcgtccacctcgcgccaccgcagccgcgccctagccgcgcaagccaccgccgcccccttccaaaatttgcccgcccctttcccgatccgatcaaatcaatagaggggaaatgatccccaggatcccctcttccttttctcttttggaatcgtcggctaatttcgtttggaaataggtggatttgagttcgattcggatcgatctctctcctctaaccctaaactttccattcccgtcgccggtcgccgtgggcctccatcgccgccccctagcccctataaaagtaccccgggacctcctccgtccgccgccaccctcgctttagctcgccgctgcttgtagcgccgcctccgcgacaatccgtgcgccgccgtcgccgctgcgagtccagccgtgcgccgccgccgccgcttcggtcgtcgtcgtcgctcgggaaggccgccgtcgggatcgccaagtcatcaccgtccccgtcccgtccttcgtttccgtcgaagaccgccggagcaccgccgtcgtcgtcgacccgaatgcctccgccgcttcgacctcgtcgccgtcgtcgtccgttgccgtctgccttcgtccgagccctcgatgagtttgccgcgtcgccctctacacgtaggtgctctccgtttgcgccgccgcgccgccgttcgccggcgagcgtgagttgctgagccgccgctggtgatgacgtcatcgctgacatcagcgccgcgtcacccgtagacccgcggtagatcgattcgatctcggccgttcgttttggataagattagatctcgaccgtccgttccgtagaccgtccccgtgcacccgatccaccgtaaacccgagcccgctgacgcaataaatcatttttctttttcaaaaaaaattctttattgcgtcataattcaattaaaatctatataaatgatttaatccgatttaatctttaaaaattcataactaattcatcttagctcgaatttagttggttcaagtctctaaatttttctaaaattgagatctacatgttaaaaatatccacatgtactgttcatgattgtttatatgctgttttggtgattttgctcttttatgcctagattccgacgttcctggagagtccgaatttgcaggagaagattttgaagagttccaaggccagcaaggcaagttacacagatcccaaacaaccctttgagcatgttgattccatttaaagctattgtttctattcaactattgcatttatttttgaatgtcattgggtgggaataacctattgcctttgttatagccctttgttattgattacctattctttgtcacctggttaataatttgattagctagaacattatatggttttagctaaagtaattaggatgcttagccatacttagagacactagctcatatgaatgggatgattaataattcactattacttaatgatggcttaatgatagctcatgatggttaatcatgataggttgattaattaagatgccaactaaaacttgataatggtgggttgtgagcacatggttttgatggtcgtgctcatgacagttaaggaccggttcacgattttcggttatgaaacattaaccgtgccaaccacaagccagcgtgggcaacgactttactttttgtatagtatggttcattgtagagcaccagactgtgaagtggcggagataagcccacgggggtcgctggggagtccatgccttgtttgtaagggggtgattatgatccagaaacggtgcactgctttgaattgtgttatgcgaagggtattgtcacaatctctattcgggtacttgttaagtatcgcgacgcatggttgacatgatgttgaggttgtgtcttgtaggtacagtggtacacctctagccagagtaaaactattcgaatagtcgtgcccgcggttatgggcaggtctaacaatgtctttcgtgattagtctcatatttcacaccataataaatgatgatgaaaataatttgtttagctcctggtttggaatggtatattcctggtttggagttagaactgtgcaaccgggattggttgttcataatggttgggcctatgcaacgggtgtgttgtatagcgttggattaatattgtttaattaaatactttacagttttattaaattctaaagtattcattaaatgccatttatgcaaatgagactatattattccatcctttgttatcccttgcatttgtatattttctgcgtggcttgttgagtatgtcatatactcaccttgcaatcattcatcagaggaggatttctacagtcatgccgaaggtgtggaggattaggcgtagccctggtcaagctgcttgtgggatggagtcgcctgcgctgtttattttattttccgctgcttagaactttattgtttgagatgaactatctacctctgtaatgactttatattcgcttattaattagaatattaattgcactctattatcgatttgttattgtgtgcctcggctgattcctagacgagggtctacacacatgtaagcgtttggaattttggatagaaattccgggcgtgataagatggcgctcctccatcttcaacgacagtcgccgaaggctctgctccctcttcggcggccatatccgccccggtgtcgctttcctttcgccttataaccttctcctttacgactttcttcggtggcattcgctcttagtggtttcgttcgaagatccccacgatcggcgccagctgttgtcgaaacgacaactgcatatgtcgaaagacgtggttacttaacagtgattggaaaaaggtaaagtgtattgattagagaatttctcttgggatccccccattacatggccctatgagactatttatagcccctattacaggttcttactactagggttttggttatacaggggaatttacatggttacccttatgaaagggacatttacaagggtacatagtgtaatagaggttcatggaatcctgatgggccgttaggcgattgtcggcccaatggcccctaggcttgatgggccggaaaaggcttcttcggccctcgcgggggcgagcttgctttggcgaagtcgtctcccttcggcatatactcttcgccctgtatccttcgctcaagaggcctccggcttggcagagtacccgcacgatccttcgcctctcgcccgtgtcctgttccatagtcttcgccttgggggggaggggggcttcgccccaactaactttgacgtctcgggcttggatccccattcctcgcatagctttcggcagattttggtggaagtgcctcgtaccataccgccaacaatacatatatataatcttctaatcaagtgatcaaatgagcctaatccaactatctaaaatgtgtgtgatttggacccaaaaatctgtcgtgtgatgaatagctagtcccagtttgtagaaaaaaatagtaacattttcaattcaagacatattaattataaaatatatattcaattattgatatgatgaagctaatttagtattataaatattattatatttgtttataaacttagttaaatttgaaacagtttgactttgaccaaagtcaaaacgttttataacgtaaaacggagggagtaatattaattattattattacaaacttaattcttatttgatttgtttaataaaattctatatacaaaatattattttaaccaaagcaccatttagtgttttggaaagcctgctcatgaagaatgagaaagttgttgttctaacaagctaaaactaacggagcctaagtccactccgacggtaataaacctccgttatttcataggtggcgctgctaactttcggtataatgtttaatcattcatcttattaaaaaaatcagtgtagatatgaaatactccctccgttcctaaatatttgacgccgttgatttttttaaacatatttgatcgttcatcttattcaaaaaatttaagtaattattaattattttcctatcatttgattcattgttaaatatatttttatgtatacatatagttttacatatttcacaaaagtttttgaatatgacttacagtaaaatatgtgctaaaaagttaacggtgtcaaatatttagaaacagagggagtataattcatatttaaagttttttaatggtaaaacatgtcataacaaaataaatagtatttatataaattttttgaacatgataaatggtcaaacatcatcttaaaagtcaacaatatttaaaaaccaaagaaatggtgaaatgtcatctattaaaaatcaaagagtacgatatttgacttgcactccgaaccaccgtctaaaataactcaattactaaattgtttttcaatttaaggtttgttggtttcggagccaactttcgcctgccaatataaaatttgtgctattataggaaaaaattggtagcataccaaatacttacgtgatactattaagttatcaatatttttgtagggcacaagttatcttcaatccaaataagcccttaacttaaactgagaaacctattaatcgaatgtgtgaggaaactacaaatgacaccgaatatactaaaagagatgaggtcgtcgatatcatatatgtggtgatagtcacatgttttacgtgcgtgcgatgtacgaaaacctatcattgcgcgctacacattcatttattatgtaattaccaataccagtactatataattattgattgaaatttttaattattaataccagtttcattatgtcctaaattattggcctaatttgtttttcctttttcattcttctctcctcttctctgtctctctactattataaaaatttaaatttaagatgtttttgccactaatttgagccgtcgcctctttcatcagcttcatccgattccccattttcgaacgcgatgcttccatcgcttcgcagtcggataagatttatgagtaaaactaacaagctattaacaaatttaactggcacggtttgtgggcagcaacgataagagcccagggcccaagacacagctagggatgcggtcgggcacgacgggcacgggtagttacccatgtctgtgcccgcgagataattcatgcccgcggacatgcccgttacaacatgacggacatttctccacatgcagagacagtcaacaatacaaacattataagttcaacaataagacaacttcaaatgtcatactttagcacaattacacaatcaacaaacttcaattacacaagtttcctcttcttcctattcagcttgttttgcagttggggatgcatctacagaagcctgtgaggcttgctcacgccggttgctgctgaccggtggagtagcacactggctgctactggccgaagtagccattggttcaaatcactaccaatcaaatcggaaataacagatcaatgtcagtaggtactagatcgaaaaaataaataactagatctagagtacgggagaaggggataccttgctcagcgcaggggaggacgttgccggccggaggggagctcggcggctcggcacagaggaggcagtggcgaccggaggtgggaggcgcgactggagggaggcgcggttggagacgttgatgaccggccggaggggagctcgcgcagacgggtaggaggcgaggcgacaacggctagagggtggagccgccggcgacgacctcccgtggcgcccctcccagcggcgacctgacctcccgcgcggacctcccgtggtgcctatggcacccctcccggcggtgacctcccatggcacggtggcgcccctcccatgtccgcctagagcccctcccggcggcgacctcccgcgtcagcttggcggctgtggaggagaaaagtcgaagagaaggagatgcggcggctatgaagggaagagaagaaaattctagggtttttagatgttggtttttatactaagttgattgagggccacatgtcagttgatgttcgcgggtaaatgggcgaagcgggcccgtgtgcccgtttgttacaagttttaacccaataagaaacctatgagtactaaatagagaacaaacccaactctattagggtttttatccacaggtaaacgggcaaacaggtcaaattgctatccctagacacagcccacgaagtcatttgcacggcccaccatttgctacgtgtgcaggttatacagagacaataacacatggtgtgcagttatacgtggaattcaaagtatttcttttaccaaattttcactttttccctactaatctttacctttatttaaaaatttagaaaaatatcattatctattaaaaaatcgaaatgtttatgtctgcttgtctgtttcatctatcgctaccggtgcggtgcgagataggattggatcactcccgcgccgccacgcgtgtgtccatctcatatcacacatacgataatgagtctatcgtgcgcctgtctccatgccagcaagagaaaatagaaccccgagctacgcatatgcataacgcccctgatagttcgaccaccaccatccaggcatccactgtgagtagtgtgtgtacatcgcacatatgataatcacatattcacgtcgggcaactgaaagagaataagtacatacataaatctcacatcaacagccatgattttttttctcttttaatgaaaggcattagtcttgctgttatggaaatcaagggtcaattcactctatggaccaaacttatggtagatgtcatacaaactagaccgcatgacttcacccgttgtaatgcacggacatttctctctagtttgataaaaaaaatgtcagatttagccatcaacgcttgcatctaagctatagtaactagatcatgtgctcgaactctccagctatcgtaatatatattagtagtactagaaaataagcatggcgaagccgattggggcactctctagttaacctgtgcatactataattttactctccatttcaaatatagtaacttctagcgtgaaatttttgttctagaatatagcaacttcttaacacactctctagcctctctctttaaaaccaacaggagcactagtatttcattgagagaggagaaaaaaacaccattcttcttgggtttaggtgaaacaaagcgggttcacagatatttacatcagggacctcgtcttaagcattggggaggctatccaggaagaaattttaagtttttgaaacaccgtatatatgtaacttttacttatatgtgatcccctaacttccgctgagcaacgccctcctagcttgattaggtagaaaacatcatcggcgctgaaatcttcattgattacaccaaacgttggagatccctttctaccaaacgttgattacactgataattacatgtcatgttaaggtggaggttatttgtccatgttgcaattgttgcatacatctttgtagctgaagtgtagtttttttagaggagtagttgaaagatgaggcatgtggtcgtttcctcatgatgatcgtgaaacaggtaggtaacgttgtgtggccatacgttaattgaatggcgtgctaggttgtcagcggttaacctactggctaatttgaaccaatcataacatctttcatttaatttatacacgtattttctcatctcaaccgatcataacaattgtatgtaatttcatccctctctttagttcccatgaaaagttgagtataattttgaggaataaatcaaagatgttagtataataagattttctttaatttcgcataatattgtttaactttaacatacgaatagatagattttgctctcgataaggtttgctcggctctgttggtgtcccatggtgtgatacgtctttgtttctttttccttatttacatctaggtgtgccatttaccgtttcatcaggttgctcatagcttgttctttcttttttttctccatctgatctaggctctaccatcatgtgtagatgccggtttgtttgttagttggaacttaccgctccctgtgcttctctttgattggctgacgcagtggttagcttagtaaatgaggatgagttactgccttcgtgtgatgtagcaaatagtagtaccaatggagtatcaatcttctctatctttccactggtcgctgtttcaggctgccgtcggaaagcaaaattctttggcatatcagccaaacttcgcattttcatttcagccaaagaatttccattgattggcgtatttcttgatgttggatcttctgtggcttaatggttgcagctctcaattgatagtagcattcatatatgatgggtttagggattagcaaaaaaaaaatctcaattgatgtaagttgtggaagtaaattactatcataattaatttgtagcaatatatatttagtaagccatataatctctcagttgctacatgtagtcgtcatcctcctcagggttgggttcctcatcatcatcctatggtgagtgaacatacatctcgtcaaactccttgtcgttgatgtccggattgtcgtacaccgtatccaacacaaaattatgtagggcaaagcatgctgtaattttttttgtttgccacttcgtgttatatgagggtatgcctcttaaaatcttccacttggttttctaagcatgtagataattaaaattctcttgcaagagttccggattgcagccacgaaaatccggcacatggtaccattcacccctatatggagccatatatcgtggagccaaggcatatccagtatcaaccaagtagtacttatctgcacaacaagacatatatttcagaaactcggccaattgtaactgtattaaaaaacacttgcacatactgtgaggtgggtgaggaaacaaatcagatttgtctcctctcacgacgcggttgaagacagccatgtcatggcatcttcccttcatcccagcggcaacaaaagtgaagcgcatgtcaaagtcacatacgaccattacgttttgactagtgtatccatgcctacacatgtaggtcatgcactcctcttgtggaatgatgactgggatatgggttccatcaataactccaatgcaattgatgaactgtggggaaaacctagattgcaacaaccttccatgcacaccacgaaaagcaggatcacgtggttggatgatatcattggaaaattggagcatcactttcaaaatatccctaaatttccgatgcacggtgtctggtgacctttgaaaacgcttgcaaatctggctttgcgataagtcgaaatttctttttaggtttgtgaagttgctttgccatcaatctttcatttgtgatatgtgcaaatctctttttatattttcccacccttgtcgattcatatattgaccctccatgttcatctgagccttttcatgaaggcatcgatcaaggaatgccttggtcattcgtcgagtccaattggcgcggtcgtggctcatctgcataggctgaagtaagtggaaaggtagcatgtgcagtgggttgtctactctcaattatacatagtacatatcgaattattgggttaatgtattagttaagtgaccacatcatttctttcgaatgaaagtagtgaatacataaataatatgtgttcacacatacctaccttgccgtgttgcaaatgagcaactgtggagtgcaaagcgtatcgtcgttggtttatcctagagcacgatgaggaagatgatgttagagatgtgcgcgggcgttatttttattttgtagtacctatttggcatgtaattcatcatgttgagcgtgggaactgagaagtactaaaaagaaaataatcattcggcaaatcatgcatgtcattttctttcttttccatcctgaccaagaagtaatataatcagattaagatgtctcaagagacatgcaataacttaacttatgcatccatctcttggaactatctcaatttgttgtatgtggccttccagtagtttctcatcatcatatccaaagatcgtgtagattttgccatttgcacaaaactatgcatgttgaattgtagttgtggccactaattgtactccttccatcccaaaatataaaactacgtatgttgcattgtagccgtggccactaattgtactccctcaattccaaaatataaggtacaaccgaccaagaaataattgttggttgtgccttatatttttggtatggagggagtagtacttaattcatttaggaatcatcctttccatcatatttatatgctgccattacttatgtcatctactcttaaagcaaaaggtgtttgcttcactccacatacgtccataattagtagactatacacactgacacactgatgattcaaaagaataatgtttcaattcgcctaatttgtggagccctattagatcagatgcatattatgatcatcatcaattactcatacattcatgctaatgattatcatcaattactaatacattcatgctaatactttgaagtattctgcgtgttgtattaaattacttatcatttttattttttaggagctgataaggagtatgtcgtggcacaggggttgagtcgccagggggagcttatcaatgggttaaatgccaaagttgtagccgtgctcacgaagattgcaaagatccgcagagagattttggtccgaacactgagccacgggtggtaaaaccgcaaagcttagaaaatagcttcggtcttactatgtggtttcatatggtgtcgtgaagcctaaatataaaacaactttggtcttggaccgtcaataatgattttttcttagaatttggatacttaatcgacctgcttacttctattatgttaatactaattactattgtaggaatcctggttcttatttatattgatgattatatgtctcacgatgagggatatttaagattttttttatttatataagttttttcaatacttccatgttgctattggttatacaaatttatttttttagagcttgtggaatgtgttcctatttattgatatgcttttggtttacacgaccaattgcaacgagtgcttgtcaaaacaaaactttggtaactaatcgtcctatcgatgagctttccaactactagcagatgcgaatgataagagggacattatagtgccaaatccttatgtattatttactacggaattatatgccattatctgatcattagaattaaagtaatataaacttccaaatactgtcatatactttgatatctttacttgatgaaactacagatgaagctgtttttgtaaggtcaagtatatgatgctaatgaaccatgttagaaactgccaatgaagttcattcgatggtgatgaacgttgttggtatttcttacgttcataaataaaatccacaagtgcacggatataccgctgtaacacttcacccagaagtattccaatatataaaattttcactgggaatgtgtgtgtttagctcttctttaggtttatcaaggatacaagatataaatgtaggccaaagggtagagatgatattctaatgtggtacagtgttgtttggaaggcttaactttaattttatcgctatgcttcaggcactgctcactactaccagaatgcgctctactctgtacccgacatggaggactacaatgatttcgagggctgtcaccacctctacactaacctctaacgtacggtgggatacgtagccaacaatagtaattaactatctagacaccatgtctatgcaattaattactactctagcgttagctaaacactaaagtaatcactttttcttaatgaacgatagtgaacaatgatccgcgttagctaaacactaaaataatcactatttcttaatgaacaatagtgaacaatgatccagcaagctaaataggacctaacttaggccctatttgtttcagcttaagattattgagccatattactataagctggattataatagccgacatagtataagttgttagctgtttgtttatctggatgataagttatttgttagctgttagccctcaataatataaaaaaagcacctttagagtggattattagattatagtaatatggcttatagattgtaataatctatcatgataagctatctgtttatttcagcttactcctaataatacagattataataatcctaacctgaatcaaacagggccttaagaataccacacaagataaatctcaatgacttgattaaaatattctcaactagagcaaagcaattgctaaggtacaaaagaacaattctggaactcctccaactctttctttctcactctctcccttagtctaagtataaataaaagaatacaaagagccttataattcagctcacatattggtgtgttgtgaatgagggaagagaggggtattttataggccaagagacgccttgggagtatgtagatcctaagcatctaaagagcatcttcactcttgagctgccaagtgtccctccatgagctgccaagttcccctccatggcggtttattccgatagaaatgatcacaatcgccttggatagtcggtaactaccgacatgtgaaaatcgagggctagatgggctgttcctgagttggccgacccctggttggcccttctggcccttggttttcttttgggccctagtaggtactttagtatttctgtggagttggcccatttaattatgatcttgttgggcttgttggctcaaaactctatgagcttggatatggaagtaatatttccgtccctcatgtatagttcatctcaactttggtagtttatcacctgcatacaaatatacaccgacactagtggaatttgttagaaataaaccttaccactatgttggatgttttatattttcagatttatgcaggtattgacggcgtaaatttcgtatttaacagccatcaacaaacgcgttcaatcctttgaagtacttatatatggttgattatggggggcacgatagccggttgcctcatagtaggccttttgggccgcaccgtacagggtgggcaaagcgccccaggcccgtgtggttagtttgtatttgaggaaagtaatattagataagggaatcaattttgtcccttgtaattagattaccatcggaccgccgaccgccctagctctatatagggggtgccagcataaaccctaaggggttaggacttttgcatcttttctccacatacgtgccgtcggctactccattgctgacccgcgcacttggacacagatccaatacatctcaactggacatagggtattacctctcgacaagggcctaaaccttagcaggtgagtcccgacgtcatctgctgacgtcgtcgggactcacctgaacgcatctcgggccgacgtcaccagatgcgttcaagcactacgtttccccgccgaccgagttccgctccggatatctcgacttcatcaccaacaaggccggcgtcctcaagctcgcatctccttcagctacaaaccaccggccatggcctctccagtgccgatcggcatccccaacttcgccgccctcaccattagaattaccgtactaccagtggcaaaagaacggcaaaaaaaaaaatgccaaaccaagaatgtatctaaccaaatgttaactcaaaaagttgattaggcaccacacaacaacgccgtttcaaaatgcaccacacaacaacgccgcttcaaaatgtcggtcatatttgtgacatggcagagagaacacggaaatgtaaaacctgaacaatcgataattattcaatggcgtacagccaagtgcaaagaagtataacattcacaaggcacttatagttttaatttgcctttcaagggtttttacagttaagcgaggacatctacaaccaccgcttagaatttcaactctaaggtatttttcagtagcaaccacagatctaatcatctttcaagctaaacatatccctctgtttctttataaaaaaagaaaggtgaacatatctgtacaaaaattcgttggcaccagttttacaactggaagcaagtgtgaaatgattactgcagcaaaagtaaccggcccgtttcaatatgaactccatgccgctcaaggttgacatcaatagtaaacagagatctgtgagttaacctgatggttcatgactgcatgcatgtgttcataactaaaatgcagcaatagtatctactacttcctaagtatttaaaatcatagaccaagaaaccacgctgctcatcatttccccaaaaaacctgtgccgtgatatacctgcaaaaaaagtatatatcttagtagagagtagtactccaagcatagaccaaagttcaatcacttatcagataccgcaataaaaatgaacatgcatctcaagttcttaacaaatcaatatatagaagctcatagatgagttgatcttcgtcttaaaaatatataaacaaattgattgtgatagtccaaaatgaattgcaaagagttataaaagtagcatcgagtttcctgcaccaagtcacaatagttctaccaaaaaaatatatatatgtattgaggaaagatgggcaatctatacatatttcatcattagggagcaatttcagctcctatacaatgtactctttgctctattattttactaagtgttgaaacaccatgtaataaaggaaatttatccataaaagaacaaaaggcttaccttcaatacaagccctaagtagcctaatgaaaacaatgatagtacacataaaagcaatcagaataaacataataaagtttctgaataataattccactgtatttttctttaaaaaaatgatgctttctcatgtcatcacatattccaaagctttgagcataaatatgttttaaataaccaaagtcttatatgtgaaagcaatactgctaaattgttcactaaaaatacttcatgaaaccttttttttttctgtaaatataaccaaaggttgatatgtgaaagcaacactgctaaattggtcactagaaaagtacttcatgtgacagccttctttaaattctacaaaaagaaaacatcaaagtaacatattccgtagagcatcaaaggcatcaaactaaatggaaccaagggagtacctgcaaaggaagagcgaaactcttctactaacaaaagaagaggccaaaccatttatgctacagaaaggctccgcagtttgtcacagtgaggtgtagggtagtccttggcccattggcgcctttggagttccacatgacagaatcttcccagcatgctcttgtagtctttaaaaacatactgctcaagattatctctagaagaacttcctcgtggaaactgctggtcgaattcttgtttgctgacaaagtactccaccccatgcttttcagtgacttttgatatagaaaagtagcttgtccttttaagggaatactcaggatgccttgctggaatgaaagcaaacaagatgaaaaacaaaacccctgcaaggtgcaccaacattgttaaatttatgcctgacccaccctgaaccggatgttcccgtctctgttgttgctgttgcctcactgttcctcttgctctgtaggcattgtgagactggaacatattatcatgggtcccataaaagaacgacctgaatatctcatctggatctaagtcttcttcataaccatagaagctacttcttgcttgcctttgtcgccttgtagttctctgcctcatgacattggaatactgataattaaactcatggtcctcaatggcacctgtttgatcataagttctccttgactgatcattgcttaggcacttgaaagccttgctgaccaacttaaatgcatcctctgccccaggagccttgttcttgtcaggatgaactttcagtgacaacttcctgtaggctttccttatctcttctacagagcaacttctctccactccaagaattgcataataatccttgttctttgtgatgttccgaaccactctaacattttcctcagtgtaacccttatcaacattagaaggaccaacagattctttacgcaaattttggctttcaccaacttcaccacttctagccctgtattggcgtacagcaccatccagggtatcatacttcttgggtgtgcccagcatatcatcaatcggaaggctggggtccaatctttgggcaattcgaaggaatttttctgctcgctgtctatctccagatgcaagtgcagtttctgcaagtttgacagacctcaaggcctcatctttgtttccatccatgcccttagtcagcctttttacaactggatcatatataggtaggacacccaaattgaaaaacttttgaacaaggacagattttcttcacctatgaagcagatatcattcaaaatcaatcgaaattggacttgatgccataatacaaatagccgagtaactctaattcgatagcatcttgtacttgcagtgacacaaaaatgatatctaatcagaaggtagatcaacccgagaaattagggtgtataaacaagtggtataactaagagtacaaaaactaaaccaacaaacttaggaatctctggtaaagcagaaaaatagccaaaattttgtgaacaaaagataacctaaatgaaacagattgccacaatgcatagtatggaactaccagagtacaacagaatgctttggttggataaaccaactgagcatggtcaacacaagtggcaaaaccatgccaaacaagcatgacttttaactaagaaatctatttacactccatttccacatgaaccacatcaacttggatattttgcttatttcactaggtaaaactactacgatggacacagttgcgctagcacttaaaatgcctacacctgcaagaaatatcacatttggaggaaagcattaaagaattaagcatcataaaggcattcaatgctgaattgctgagaaagaacttaataggtcttaaagaaaccaacaaccacttggatcaatgagcacaagaccagcttccctaggcataaccccccaatgtaataaagaaaaaagtttgtgctaccatcatccaggcagtacaaagtagtgccagagtagccgtttcagccaaatgaattcatcccagagaaaaatactcgtttgctatgaagttgaggcagatcacatttgccacaaagttcattggcatgtaaaaatccgacataatttagtgggaatcaactcatttgccacaatgccatgtgaaatgtcaaatttttcctcatcttcgttatgtgttaatctctctcctctactgccggcaaccgctgctccccatcttcatctagcacctagctccctctgctggcgcaccgcacacactttcctctacctccagcagccggcacacgctttcctctacctccggctgccggcacacactatcctctccttccagccaccaccgcaccccagctcagtttgtcagcaaacacacccaaagctccagtctccaccaacagacagctgaagctagtggcacgcgatagcgatcagacctatggaacactacacatgcttgtggccggagatgagctaagaggaacaagattggggcaaatttgcatcacctgtggcaaaggggtgtataaactattgaggaatttttgcaggccaacgatttcattcattgcaaatgtgattacacacatcaaccccttcgcgaaggaacaaccaatttttctcctatcgcaacaacatgaaccatcgaactagacagacaggctccacgtgtactgaaataccccgaatcgtcagccagcagcgaccagggaacacgatggactcctaacggcgggatcctcgcaaaaaccctaggttagggccgcggcttgggcgccgcctcgtgaccaagcaagaaacgataattccccccaagtcgcggcgagggaaagccaactaactaatcgaagatccggagcgggctctgagcccatctacggcgattaaacttaccccgggtcggagagatatccccggcacggctagtcggcgacggggagacgaggacgacgaggagcaccgccgcggcgccgccggagcggggagagaaagaggagagaactgcgcggtggcacttttccacggagcccctcggatttcctctttatttaggagcgcccatcgagccgagacgagagtgcgtgctggccgcgtgggacactgcgctgtggggcccactagctgtttgccgctgacgggtggggccacgcagccagcgcgaatcgtaaagcacgcggaccccgtctcctttttcatacatatcctcctctcgctctcgccccgctcgcttccgaagcttctcgagccctcctcctccgccgccgccgccgccgcctccgcctcgccgccggcgcagagtcgcaggttagctccgtactccgctcccctccccgaaccaagccgacgccgctgctggaatcctagtactcctgcgcgagttctagcgtgctctctctctctcccgtcccgtgccgttgcgtcctcgcgctttagttctctcggttgagcgagtgcgcgagtgttctgcttggttctccggtagatttggtagcccgcgatcatatctcctaggttttttttttccttcggttgagcggggcagcaattgaattcgtggtcgtcagggtttctgagagctggagatgcagtgctatgcttggtttgttttgctgtttgcgtgttatcgttacgtggcttgacgctacggccattgttggatttgtgcgtgctaatttagctgacttgatgtttgtctgtcaggaacgatgagccgacgcaacagccgcaccatctatgtgggcaatctccccggagacattcgcgagagggaagtggaggatctcttctataaggtgagccatgattacattacggattaggcatgtgtgtgccatgtaacagtgttatcctctagtactaaagtggtaggtcagtgcaaattttgttttggtatcagcgagtacatcgtaggctgcttttaggacttaggaggaagatatttgggggcaatactgctttcttatggaattataaatttgctatgttgggccctatggttttctgttgtgtggttggagcatttgttaaatacttcaatgtgaactagatatctaagttgcgtcttcacgcgaccataacctgtcttttatttacaaatatgataatgaattgtttgtaacagttacctatgttaaaatttaattcgtctagttgcagttttcaaattctacaattgaattttgttaaggattgaactttggagagtatttggcccaatttccgagcaattaggttgagatatagttttgcgttatgcatatcagtttgtttttctatttgttggttatggatatatctgtaggtgataggtattttttttatcttaattattcattctggatcatttctataaccgacacatctgaattttagacctgccagtattgtttaggacttttgtgaatatatgatttattatagttctattgacataaaatccatataatacacattattcgttatgtttattgggtctctgtggctatgtaaagatagtagtgataatcatttttatgtgcagtattttcactttatatggatttgatttcgctatatttattcatgtttgtaattgaatttatgaacaaattgagatagcaatcgaggtgtaagtggtggccatggatcgaagtactgacacgggtgatgttggctgaggaaatatatttcaacttgacagaagatttatcttaatatgagtttcacatcttgttagtaaaagagtttattttgcttttcttctaaacttgacctaggcgcacggagaaaagaggatggagtttgggcttgcagctgttgtagttaggatgcataccgatccaattaggcctatttatgtcaccgagttatacatgcaccacagctagagggtactctagaatactcctacatttttaacaactacttaagtttcatccaacggtaaagattgtttcgacttattttgtctttaagcgtatctgacggttcatattagtcagaagaagtggcacatcctggtttctttttgagatttacttttcacttggagagattccaccagtcggttgggcacttgggcacctctttgttgttgccatcttatgtggtgaactggtgataccgaaggatgttactggtagaagggtagaacaatggcatcttgtaattactaaattttctgatatctttattttcttgattattcatacagatagagtttaactttttttttcattacttttgcttctgcagtatggccgtattgtggatattgacttgaaaattcctccaaggcctcctggttatgcttttgttgaggtaagggattaagtatgttatggtgattacttgctatgagcacattttctatctagatttttgctcatctttttatatataagctatcattttatttagtcataaccttgttgttatttgaggatttttttttggggtctgtgagcaaatttagcacatgaaaaccgactacagacattagctttatcaaaatctaacccgaattggttgctattttttttaacttaaaaatggtccacactaaactggatagccaaagaaaactggacctttactaattcttttcgtatggtcaaaagttgccaaattttcataagataaacttcggcttggcgtgaaataaaacaacccctggataacaaactttagaggttctgttagaatgatgtgttaatatgaacccaggagtgttttgagctttgaataggaggtagcgaggtgggtaagcagagtgcttgcattctacccctgaatggacttcttcccaatcatggcaagaggactctaaggccggcaagtagatgcaagttgatgattaaataaatttcttggtttgaaatgaagcattctatggaagcttatatttcaggcatctcttagcaacccatgcgattagtttagagctgaaacaaaggaatatactatcgcaacaatttacccctaacgaactcctcaactggcttgcctgcttgcttattacaatgtgtgactacctctatataccttgctcagggaaaggaataggcaaatctctaaaatggataagctggcaagcacaggtttataaacaggagttaggtatgggttgtgtgatttgaacgatcaagtaacggatacaagacatagaccccctccaggtgcaaacattattgttctcatgctttgccttgctactacttctgttctttttatagaacattttttttatctataatcaatatatcatttttattatttttaggaaaagcagaatgggtagatcttggcgcgcgcgcgtgcacacacacaaaaataataataaaaaactggtttaagaatatctcgcttttgttatgttggacatgtggttctcattggaaactatgatgactaacgaaagtgcataggatgtgagcaaggggcaacttaagggttactatggaggcaagagaatggaaacacccaaatttgtttctttaagctcatgaggaatttgggggtgacggagactgacaaaaaatgtaggggatgagtgaaatttgacatacgatcaatgaatttttccatgtagcataaagacaaaggttagacaaacttgctttagaggaaacttaacaactagcctcaaatccagttttgccaagtgttgctgaactatctaaagaaatgcttgtcaaaattaaccttgtgcaatctgattgtacatatagcaccttagaggctaagaggacttgatactaactaaaagtggttccttatgcagtttgaagaccctcgtgatgcacaagatgcaatttatggccgtcatggatatgactttgatggccacaggttgcgggtaagtggatcttgcatgatatccgttatctttcttgagagaataccaggtggtgaagagggtagttcatatttatttatttttgttgcagcagcaaagaggatagttttgtttttgtcgtaatgttaatcttatacctttatttaggtggagttaggggatggtggcagaggccattattttgatcgatcaagtagctatagcagtgctaggatcagtggtgccggtaaacgtactgatttccgaggtaaggattttataaactcaagttttacaaaacttgattggatacatcagtgtttttatttgctctattcatggaatgtgcagttatggttactggattaccttcgtcagcatcatggcaagacctcaaggtattgatgcagatgaactcccatacaattattcactattcaagaatcttgagttttacttccattttcaggatcatatgaggcgagttggtgatgtctgtttatatgatgtatccgtagggtggaggttagtactgaacacttgtatgatcttgctgttgctgatattaattttggtatgaattgggcagtagtttgttttgataatacagcaaccatttaagctgtattatctttttccattcatgtttcagtagttcttacttcttaatactgaaatttctgtgtttcagcaactattggaattgttgattataccaactatgaggattgaaacaagcggtaagtttgaattagttctatgcattttactttccagaagtgaacactgccatgtgccatctggaaattcatgttttggttggttcctttaataatagaaaaagggcactttgtgatatgccagacacctactttctccccaatcatgcatgttcttatcttcccgtgaagatacacctgacaagcagttttttgttaccttacagataagaaagcttgatgactcagagttccgtaatgcattttcacgggcatatatcagggtatggtcatactggaaatgtttctgcacttcatttaacctaatctcaagttgaagatttacgtactcatggacatgtctgttaaaggtgagggagtatgattctgctaagcgcagccgctctcgttccagaggtagaagccacagccgctctatctccagaagcagaagccgcagccgctcgatctccagaagcagaagccgcagttatagcagaagcaggagtccaaggtatggtttgaatctcataatgctcaaatgaatttgttatggtaacaacaacatgaatattattacaatgtgctgttttttccttccagatctaggtctgcttctcggtctcactcacctgtgaaagaaaggtatgcacagttccattttgattttgaatttttcaaagttaagaaactgagtagctttggcatgtgttatcttcatattggctattgaaaaactgcacatgattttttaagaaatggaccccctccaatgttgattattgaaatttgattatgtaattagcctatgttatcccatatctccctcaaataattgcaagaaaggaaatgtcgttaacttaaatgagtttactgctgttctctgcttccagatctaggtcggcttcacagtctcgctcacctgtgaaggaaaggtatgcgtagttccatttcgattttgaattcataacatattacatagtacatggaatgctttcgattcattgcgatggtgtgatactgagattctcggattaatactatgttacaaagttaagaaactaagtagcatttgcatgcgttatcttcaatttgccaaaaaagaaactacatatgattttctaagaacccctccaatgttgtacattcaaatttgattatgtgattagcctgtgtgatcccatatctatctctaataattgcaatacacgaaatattgtaaaatgaaatagggccggctctttatattctcatataatttgtcatttcctttctggtttgtactttaaatgttatgctttcgagatgcattttttcttctgtacatgcactttgagtttccactctctgatgattaaacatgcagaaaactggatagctgtcatttgttgaaaatttgctcttgtctttcctagatttgggacatgcagctatttgggttgcgttggtaggatattggatgcgttgagaaccaaaggatggtttggaacgttggatagttctgctggctagtgacatactgtatgacaagtggactacaaccagcgataggagcaagatagggctggctctaaacatatttggacttatggagtgcatttcgtggtataattgaagtactattgacttacgcatttctattctcaaatgtaaacctcggccttgcacccctattggttattctcaaacataacctcaccttaatgttgaagtttatttctaaattacactttctgatgaaataagtgtgtttagcgattagctctttaaccaatttgtgatctattgtggcttcaccttcatttggaggactcgtgattttacttataaggtctgtcatagtttttcaaaagatgacatgttacatgtacagtggaaaaaggtggtccctttacctatgctcatccaaaacacttctccacatgtttactgtttattgctctcaatctcatgtgtattgatgttaccatattcacacatattttgatcaaactgttgtaatatccctttactgagtaacaatttcttggcttttggaacattttgcagatcaccatcaagatccccaccccctgctacttctgtaagttttccaaacaagtaacttatattctataaatttgttccatatagtaaccattgtctcgtgcagcctcctcgtgaaaagtcagcaagcaagagccctgtcaagagcagaagtttatcccgatccccatctcctgtccgtgacattaaccaaaaactctgtatttttgtgagcctttaatatgcttgaagtttcccatattgatatggtcaatgcttcctttcaggtgaaatctgagtgaagatggatgcacttgaagcctgccagaaactatttcatgatttgtggagctgagtttcggaaggcagtagattgtggattatggtttatctgtttctgcgttaccattgttgttacttttcagaagagagccgtgttatttcactgttgcttggtcatgtcgtaatatctgtcagaaacattgccttacatgcttagcgttttacttgccatcaccaatctatcagacctcgtagcacatggtgctcgaacttcatgctatacatacagcactatgaactctgctatattctaaagctcaactatctgtagtaactgcaggaagcctttgcgcttcaattattgtctttttactctagttttttagagcttgtgcttgtgtacttgtatgcacctgttatgttgtaattctacagagtggttttcctcgcttaattgttgacatgttttgtcgttcggtgtaattgtgcgaccactgatgcgtgatatggtcttgctgacatggcttggcttggattggcttgacctaccctagtattgttggttttgtttcgttcaatccgtgatgaccttcgactttatcccggttgtcttgattggaagttgtcatccacggagaagacgctatgctcagctgactcatcccatctcgggtgtgtttggttgcctgcagtggactttacctcttttgttgtaaagtctatttttaaccgccaaacttttactttagttcaattttattttgaaaaataaaactcaccctagcctttcaagaccaggtgagttataccctaacagtccgtttggttggagagagtttttaggaaggattgggagtttagagagatgaggctattaagtgttttgtttggttagaagatatgggaattttggtgggatggggatgaggaattgaggaaggaactccctccttttcaatacctgggtaggggcagttaattgagagggaattcctcctttactttgtctaagtaaatcttagccatccgtttttattaatgacctaatctccaactaaactcactatcaatttccatcacatctaccaaacaaaatattgggattaaaaatcaaattcacatcttaatctcattatcaattcgctcgtgtaaacttccaatccccttccctcgagttaccaaacaagccataggtgattttcgtcatgcgaacttttttcttttttttttcatacctaaaaccaccatcaagatcagagtcggggtgaagtttgcctggttttggaagtgcaaacaatcagtttatttagcttagggcgaaagatagacttggtaaaggttcaagggttacaaatagacttcaaccttttttttcttcgactgttttttttcttcgactgttatgtttgtaatttctatttctagaattgtttcagctaacatcctgatccacaaggcagagccctcacctagctattatatcatagacatggattttgtttaatatcataatgaattcggatggggataactagctatatcatagacaagtatttcgtttggtatcaatatgaattcgaatataaataagtccatttgatgccctaatcctttactttgtccaaaactcaatctttcaatacagtgcatttaacaacctaaacttttaatacagtgcatttgacccctcaatctttttcacttggttttcacctacgtgacgctgatgtgatggtctagccaacatagaaatcataggtcatatgtgttattctctcgtccctttagtactagctcctctagcttcatccactggtgatcatgaaggcaacatcacatagtgaatggtagcttccaatggctttctcgatagtagaggcttcaacaacaacgccatgtttgggaccatgatcatcccccttatcgctgccgccatgaggacaacattagggcagcgccagtgctaaatccagaatgtggagctccggctgattggaaagggaggtaccttggcatcattgattactcggctatcctcctgtgggttctagaaaatgctgagattaccgccgttgctctatcagctgggtcagcaaccgtggcaggagttggaatgggtgctgtcggtgcagtgggagtggcagcattgggtgcaagtagtatagatggccataaggcccgaggcctgatggcccggcccaagcacacacgacccgattggggtcatgcccgggccggcttgacctgatagctgggccatgcctgggccgatgccttggtacggtgggccggcccggcacggcccgatccatgaggagggagaaaaatagttagggactaacattagacttaatgcagccatataattcactgcccaagagagaagggatgcaaatagacttattaatcattcagaaatggcccaaagaaatgagggaaggaaattagacttctttttttacgaagaagcacgattggctgttgggccttcgaaccggcccagcacgccccgagttgtattggcccgggcctgggttgatggttcagcacatgggccgagagggggcagcccggtgtattggttgggccatgccggcccgatagattttggcccgagcacggcatgcctgggccgtgccgctcagatggccatctataggtgcaactggtcctgcagctgttgctggtttgactgccgctgcagtaggggctgctgttgctggtgggttaacagcagaaaagggtgtggcaaaggatggactaactgctgctgatcatttaggagaagatttctacaaagttctgcttcagcaagaacatttcaaatcaaccacagtatgcattttactctatcatgaattattatgcatatttggcagtgttttttttcctctttgttaaatgtcgatcatttatagagtccagtcagtctcaaattatttgttatatattctaccctgaaccactgttctgctgtgtggctacaccgaagtttggctatcctaattacaatatatgccgcaacttggcatgattaaaagcttcctgtgatttcttagctgcaacttattgttgctaataatagtttggatatctgtcctcttcgcctcagttgaatattgcatgatgatcttctgatgtaaatcctgctaaccttcattttttctcattattgtaggttcgatcaattgtagaatcctaccgctggtctccttctgtctccattacactggacacttccatgcttactgtactaccgttgctaccgaagtacaggttaaggaatgtcccagtgattgagcctgataagccaattactcactccgtttcaaaatgtttgacaccattaactttttttagcatatgtttgaccgttcgtcttattaaaaaaatgtgaaatatgtaaaactatatatgtacataaaagtatatttaacaatgaatcaaatgatataaaaagaataaataattacttaaatttttttgaataagacgaatgatcaaacacgtactaaaaagtcaacggtgtcaaaaattttgaaacggagggagtattaattaagaacttcattactcatactggtgttgttaaaggacttcagcagttgcaaaggaagggattggtttgattatatttcagcactccctctctcggacttgggacttccgtttatgtcacttgatgaggttattgcgtctccctaatccaattctttactaatgagaaatcatgtcccctacattatcaagataaaagttatatctcaagctgaaatgtacatttttttcacttcactttgcaatagattggtaattgaacaatgctgtgctttcttcaggttatcactgctaacagtggtgatctaatcttttaagcttttaaggacaacaaaattggtggtgtgcctgtagtagaaggtcccaacaagtttcaggtatcaaaccatccgactatttgttaccgcgtgagtcattttttaaattttgcatttccatgttcctaatgataaatcttccatacatacaggcaacttactgtcatggagttcatgaagaccataggctccaccgttcttgattcagggaacggcctggtgaagccacctctcacctgttcgcctgacgcttctcttggcagcgtgattgacagcattgcatcaagaataacccaccggatatatacgtcgtggacggtgacttcgaggttgttggtgtcgtgacactgcgagcacgagacgtgtgatctcttgctttatctatgagcctcctcgttattgtgacaactatttggcaccagccatggataattaagcttgaggacaaaggtgcaggttctgtggacacaagttgagcctttttatgtaacgtgaacaccaaaataacagactgaattagggagcatgcagtagcaacactgatgtattcaggtttaatttgtggtgttcctgcagtgaaagtgtgtagaacaagagtgatgctgttactccatggtctcttaatgtagtttgctttgtgttacttaattcctatatagggaaaagttaatatatcctcagtaaaagttcatctaacacctcatactttgaagtcagataaccaactctatcaacttcatagtactgttcgtataaccgctaaaagtaacttttatctaattattttattcggttttatctaattttacatgtacaatagatgaatttagtgacgtgacactcccactatccgaaaataactctatttttagtcttgggtgttcaaactaaggtcgagagaaaagaccaaagtctccttatcaacataaaaatagcattccattctgatgaatggatagatagataaaggacattgaaggagtaaaacttaaaacagtattgatgagtagatagataggtaaaggtattgaaggaataaaacttataacaggataaaagtgaacttatttttcatcaacaaaaaaacagtattacgagtgttttagaataaaaggtataaaagaaataagatttataataggctagaaatgaacttattttagaataaactgttcaggttagaaatgaagttatctttggaccgaggaataaatatattcaagatatatgtcaaattctcccttagactcttttttacaccaataacggaggatcgatacaatgacaataatcgaggatcaaggattaatgaagtgaaaatttatcatctttgttaaccaaaaccttattaagtatctgtatacggaaatcagcatgtccaaaacaacctcagaagttatatgaacaatattatgtagtaagttgaagcgtttaggttagggtgttagatatgcttgtatccaaagttatatttgtatgacgttagaacaaactgagattgtgtgccttcctcggattgagatccattgacttacttccttccaactttgagtcactgacatgtggatctactctgtcagtgacctacgtcagaattaagtagaggatcctcttttgtcttcctttttacccagagggatccgtgtctatccctccaagtactaatttgttttggggtgaatcgcttgtaaggtccttcaacttatactttaggttctatttggtcctgatattttatattattcaaaaagactttaaagtttatcatgtaacttaatataatccatatacccgctaaaaacgataacttagaatgccgcaccatacttgccttgcatacatggttaaaattgatattttgattttatccttacctatgccaatttttttaagaaaaagagaaataaagagaaaaggagagaaaaaggacaaatacaaatgtagtaaagacacaaagatacaataatcattatgttttgccgtttcctttcttctttcttatttcatacattcttcaatgcggtcaggtaaggagagcactccacacgtccacatccgacgcctggaagggtgtttcctctcccaacgcattaaggctttatgcattgtgcataaactctacagaagggtatcaatgtcattttaacagtcatgcgctcggtttacgatgatgtcctaatggtttacgcaaacaactccaaccagcaccagtacccggatatcctgccagacgatatggtcaccgctgtcgccggagaagatagacgttgcacatggtttacattagagtaaattaatatagttatggtttatgctaatagagaaggaccatgggcaacgtaaaccatgcggtgggagaggatatggtcaccgccgtcgccggataagatagacatgcgcatggtttacattaatatagttatagtttacgctaatagagaaggacctgccatggccgctgctttatttagcgtttatagaggtagaacacaaggtaagttatatatgtagtttaaatgaactttcgtacaagatccggataagtgaatggttattcgtttatataaattcctacatggttacgcaaaaacttattgcgagttacatagccacagcagatccggactaaatgaatggattatgttctattaaataataatgttatgttgtgggtcagcctcacaaccagggtttgtaaaaattgtattttttttaaataaaagactgaaaagaccctgcaattcatagcggatggcccaacagaagtacatgaaaatagcccatctgcgttgtactattttactactaaaacccttacgttttcataattatgctcaagtttttacatctgtattccatttagcaccttaatatttttaggatttattaactactgttagatattttatttgatacccatagattgaaaggtaattatgtttgaatctctcaaaggtaattgagtaaatcatcatgtgactctcataggatctaccacaactactattcatcctccttggaacatttaaaaattggattacgccaagcaggacgacaggcagggaatcagcccatacaccaaaaaagatggattatatgtcaaggacaacaagggttacgccaagcacggaatcaacccatacactaccagctgctgtctacgccaacaagatgagagtttatgctacaaaatggtcaaattccaaggtttgtacgcgcacgcgggcatcgcgaggtgccctacatggtacacacccacgtgtggatctcgcgcgtaaacacatccatgctacgctcgaaaggttaatgtacacgcacgaaggatgagtttacgtctacgatccacgggcaggcatgaaccatatgtaggcaactcgacatcctccgtgtacgcaccaccaattacgcctacgtggggaaaccacatccatcctacgttcacagtgtcgttgcacgcgagacgcgacgtacgtgcctgaggcgtcgcaacactctgttgtcgctaatcaaaggacttgcaactatgcaatgagtagtatactagatatacgacgaagaacactgggatgcgaaagaaaaaaactctgaagtaacatctaacgataacaactccaacacttaacatggagatacgaaagaaaaggaagtctgaagcaacatctaatgataataactccaacacttgacccctcccccagcccagccagccggcacccattagcccattaggcccagcgtgcaagccaggcccaggaggtagggaaagaggccacgaggagggcgcagtcgtgcacatatgcacggtacaactaagggccgacgtgtcgatttgacgtaagccgtgcgcggtttacacgtacgcaggcatcgagaggtgctctacatgtggggcaggcgtgaaccatatgtaggcaacacgcgatcccccactcccccactccctgaccatccatgctatggtcgattgctcgaaaggttaatttacacgcacgaaggatgagcttacatccacgatccacgggcaggagtgaaccatatgtaggcaactcgcaatatgatcccccgcgtacaccatttacgctctaaaggttcacgtcaaaaattccccatttacgcatacagatgaatgggttacgcaccaccaattacacctacgtggggaaaccacatccatcctacactcacggtgtcgttgcacgcgagacgcgacgtacgtgcctgaggcatcgcagcactccgttgtcactaatcgaaggacttgcaactatgcaatgagtatactagatatacgatgaagaacactgagatgcgaaagaaaaaaactctgaagttacatctaacgataacaactccaacacttgacatggagatccacacgaggacacggtttacatgtacacggatgatcgcgagatcaggtgcccaacatggttcacgcccacatgtggatctcagacataaacacattcatgctacgctcgaaaggctaatttacgcgcacgaaggatgagtttatgtccacgatccacgagcaggcgtgaaccatatatagggaactcgcgatcccccgcatatgcgtaaaccttcacgcacgtctcgcgcgtacaacaacactgtgcccgaggtgtgtgcattatgcctaagtcgggatttcggacgtaaacacgtacatagagcgtaccgcctacaacacggtttacgcgtatgtgatggctgatatgctatttcgcgagtcgtgcgtgctctacgcgtacccggagatcgctaggtgcctacaaggttcacccctgtccgtgcctacaatgctttaacgcaactcgcaaaccactgtacgctaggcgtttacggcatacgtggatggtttacccacacgatgggattgcgcacataaacaggcacgtcgaacgtatgagtagaatcgatgtgtttacgtccgcaatccgaggacggtggtggcccgaggagaagaccttgacaaaattataaactatatatatcacattttcaatattttggataataataaggagctaacaataaaatcgatgatgtgtttggctcctaatagttgaaatataaaggactattatataaaacaagccaaaatgggcttcataatggactgccattgggatttactcctatcgttattcagtacacggttgagaggattacctgctaaatttaggtgggcctagcccaccataaatattttttcgttctcacagcatatactagagaagtgctatcgatcttatgtggctatatactttgtattttctatttgtagaccaacgtaaaccgaatgtaaccccaatcgcttggttttagctaggatcttctacatcagatcatttgtaccactatttacgtgtgtcgatgcaatggctttctctagacacgatctacattagaggcgcgatatagagcgtaaaccataaaaactagcacgtaattgaactttccactcgcctcttagctttccggggattcctttgtcctctctaacgaactctaacactgcgtacgttccttcggtgtggaatcacgacaagagtgaactaactattagagtttacactggtgtccaaatgaccgtcatacccctcggataaattaaccccattatttactcagctaacaggtggcgctccctcattggttgtgcctacctttatgcagctttatgctgaccgcacttaagaaaagctcttcttattttctatggtatatataaggtagaatgaacattttgattttaactatgtatgctaggatgatgtggcatgtatgtataacagtttcggtggatcagagactatatcaagtcacatgataaatttagaggtttgtttggacaatataaaataagggattaaactaatctctactattataaaaattgaagatgtttttgccggtattttagtacatcatctatgtatgagtcggttttttaatacagaaggaatcatataatagatttgtttaaaaaaactcgcatgctagcttgagacgatcggtcaaaccacctgctaactcctcccaccacccacctcttctcagctgtctcgcagaacagtgcagtaacacgacggtcaacgtgcagtaacactgcgtcttatgtgtagtaacagcgctcaaatattgttaacatatagtcatgatggatctacttttgataagcgttttttttctagcatcatggtgcaaacgattttaaaaaatagtacatcatgtgagagatattgttcttcaaatcttggcttttttagaatttgactctccacaagtagtaatgctatagcattacttgttactactgtcagttgcacgttactacaatcccatcgcatcgttactgtaagagtgcagtaaaaattataagtttttgcagtaactgtgttttactgcattttttggatagtgttactgcataaacatgtggtgacatgtacttgcctttgcagtaacactccacttttgtgtagtaacaaatatatttagcatgtgagacattaacctatatatcctccacatgcagtaacactatagcatcattgtgaaaacagttttaaaaataatatatatcttgtgagatattgcttttcaaatattggcattttgaactttagcactacatatgcagtaacagaatatgtaatttgtagtaacatgggtatatacatgcagtaacatggttttaccaaatgtataaaattgttcaaaacactcgtacatcaatcagacctcactcaaagccacctacagactttacctatagcccacctattcgatcttcatctcgtaaaactgacaaagtaaaactacgattatcgtgtagtaatataactacttggaagtggtaatatgcacctattatgtagtaacacttctacttttgtgcagtaacaagtatatggttagcatgtgagactttaacccatatatttttgtttcgattcctggtctactacaattttactacgacgttactgccaaaagtgcagtaacgtcctacgtgttctacagtaacgtcacgtgttactgtacttttacaacaatgttactactggagcatagtagcatgttatgagtttcggtagtgaaagatattagaattgataatcatattactttctcacaaaattcttgaaacaaatagcatcattagatgaattggttaaaagaatgtgctttgaactatgaggtcatgtgttcaagtcttgaatttggcaatttattttttatttttctagaaaaagagaaataatctttcagggagaaaaaaaacagaaaaaagaaagagagagagatcgggaggagggagggggaggggaagcgagagagagagggagggggtatagaataactattctatactcgggtgtagaatagtcttaccctctatatatatatatatatatatatatatatatatatatatatccaagcgaactcccacagtgaatttcatcttaactaaaccatataataataataagattaaaatagacctcatccgttgcaacgcacgggcattttttctagtcatacaaaaaattaagagaccgcattggctattcactcttgttgtggaagataaaactgtgcaagcgtaagtacgtgcgcaacatgctagtgatgccatccccggttgctcacttcacagatgtaggatctgttttgttctttgccaatatcaaattttgggcaatagcaagaagtagtggttaccatttttttttggtaaagatgtactttatcgactaattatttatccatcaactgaggctcaagtaatttattgattattccaatgattaatgttctagtgcgatttttttagataatatggttcaatgtaacccttcatgaagtataaataaaccacttaaaaaaataaaacacccaataaaaagagaatctcttgtatcatagcagaataaaaaacaggacatgcacaaacagagccaaagggaaagtgcaacagctcatatagtgcttaatatccataacaggatatggcacataaagtagtaccatggatatgcatgcgtataatgttgtaagatctgatcttagaaggaaacaaactggataaaatatatctctatcctctggccggccactgcatgcgctaatcatcctcagcccatgcaaaccaacgccaaacctcacttcatgtgaccaatcagcacgtatagatgagatagaatccaaattcatctcggtcacctcccttaacgctagcacagacctggctcctggttatgctttttttcagatcaacaccagaaggctttgattgcaatgaaaaatacaagaatccatatcatgtcttcatgttgtcaagctattcactgtgcatccttgctgttgtccatctaaaaccatgcatccatcaagcaccagcagaccaaagaacatgatgatctcatcaggcgtaccatctgcaccttttacagcactagcccaaaatctcatatacataaatctaccgaactacatgctatagttctctgctagtaactatagcaaataactgatacttctctgcacacacgcacacacgcacgcgcgcgcaacacacacacacacacacacatatatatatatatatataggatacccatatatatatatatatatatatatatatctaactcttgagcaaaccactcaacacttttctaaataaattggcttgcataaatagactaactaaaagccaaattatgatacaaacaagccgctcaggttgattcttaacacagtgtataacatcctttttttcagaaaaaaaataatttggcttttacttagtctatttttgcattgtgttaagaatcaatttttagttagtctatttatgcaagccaatttatttagaaaagtgttgagcgtataacatctttttttcagaaaaaaaataaaaaaaagaatttgaaacctatttaattactaccaaaacctaccaccatacccacaaatgcatgatcaaaatgtgcctataatctggtgaagggaggtgtaggtgccaacaacattgacgcacactcctatgaccagtatcccgacaatcatcgtcctctcgaagcagccaactcctcctcgggacatgtagatcttgagatagctcaggcacgggaccagcacagcaacggtgacgttcagcgaggacccgatgaacaacatgagatagccgaagaagggcaccgtgcatgccagcaccactgtgctgatgacgacggctatgctggtgagcaccctggtcaaccagttattctcaacgtccgtcgtcgctgacaacttctcctctatcgctgttgtgactggctggatcacaagcgtgtagttcgccagcggggtgatcagtgtcgtcaggatggcaaacctggtgtacagcttccctgtgggtaagttctgtgtcacctgcgactgcacatcctcaccatagatcagatatctcaacactactgtcactgcgtagtttaggctacacaacaccgacgagatcaacaaaacctgcacattaattggagagtaatagaacattattggagtactgatccatcatcatcatcatcatcatcatcatggtttcataaaccaaattatgataattggaactgataatccatgatcaattatcattggttgccaaatccctccaagtgaaaggtaaaacttaaaaatgcaacatcattgagcaacatcatctgaagatatggataattgaatgcaacgtttgatcaatatctatcgttagatcatggatatgtatcagtaaaagaatggtgaaaggtccaagattgttcaagaaacttccatgagttaatggagcaatagtcaatctcctaccacttttgcatcttatccctaaaaattctcatacctattggttgagtctaaacttagtacaaaaatatatacaacacaatagatctctattttaacttggcatagaaaagtttatgatgcagcacatcttccaaatttagatatgttgccttttaatttatctaaaattgtattggactatacataaaattacttaaaaacaaattttgtaaactatgtattcaaatagctaatataattctttcgttttaagtgctagacacatcttctaactttaggtttaacatacaaactaaataacattaggcggcacatgattagctttatatttaagctacattgcttttacatgggtgtgtatgagtggtaaccaaatatagttgagaggcgaccctaattgcctccagtcaccggtttattccgctggagtgataggctgtactgtagcacagtacaccttcatgtcaccgcacacgttaaactggtcgaaaggccaacccaacattacccaaaatttacgtcattatgcaaaaaaaatattaatgctaaattgtgaatattgcacttgcaattaatttcatattgcacccgccattctatatcagtgtaaattaacattacgaaattgataactagtacaacattttttttagggatggaacaactttttttaataaatcattttaatgttgatttcatttgatcttaattcttaattttaattggatggtcaaaataaacttattggcttaacttttatttgcatgatgtatatacacctgctatatgatgggagtgccaacaaaatatattaagtatgatgagaacgtagcaactatgatgattaagaggtgtgcaagtatagtatgcatgattattgatgtatgagttctaaaaaataattatgagtgtgcgcgtcttccatgcatacatgtaataaaaaaacaatatgtttgtattcttactaaacctgttgctaatttatttccaccatttactattcaattttcattaacgataattctaaatttacattgttagttgttatcataaattttaccaaacttactatcaagttcaacacataaatacattttaaagtgtaccttaggaaaatccttcttggacttcattgaggagtacacggtcgggaagacgccatggccggcgaagcaaacgaagtagagggtgagggcggtgggcaacccactcagattcaagaggttgttgcccgccatgtggaagcccttgtcgggcacgccggcccagaccccgtcagcgccactgacgagatgagcccgactaccgagacataggtgagcatgctgaggttcttgagccacgtcatcgggaggatgacggcggccgtcgcgagcacgaacagctgcttcccgtgcacttggtaccctaggatctccaccaccgtgctggggaggagcttatcgaggttgtcgccctcgaggatgaggaagctgatggcgacgaggtagagctcgacgtacatgacgaggccgatggtcgtccagccgtaggcgccgaaggcgaggtagccgatgtctgggtagctccgtacacagcggtcggcgcacatgcagcggtcgataaggttgccggtgtagaagcagatggcgccgaccatggcaaagagcgccaggctaagccacccaccctgcaacggcataaccagaaatcacattgctaaagttgaggcagctcctcctgaaggaagcaccggtgatgcagaacgagacgccgtcggtagggaagagttgctgctccatgtcggtagggaggaggagctgctgctccatgtcgcaaatcatatcttcttctcgtgtttgctatggaggagagcctcatcgatagggctcttatccgccaccataatccccatgtctgtgtgtacacctattaaaccaaaaatcacccgacagatttttaaatcaaaaacacttagatttttaatagttacataatacacatatggaaatagcatgtataacttatcatatgtatcataacacataattcattattaaagataaccttatagttaaaaataaagtgcaacttacactcagtgaaaaatagaaaaaaataaattacatacaaatctaatagagattacattgtaatttaggcctggtttagttcccaattttttcttcaaacttccaacttttccatcacatcaaaacttttctacacacacaaacttccaacttttccatcacatcgttccaatttcaatcaaacttccaattttagcgtgaactaaacacacccttacaatgagtgaaaatgtaattattacaaattacactgtaaaagtactatatttacactgtaatttttttcctcgacttaactcctctctctctcatcattaccaggctttcatgccctgtatgcttttgggcaaagtgaagttgacaggaatgagtacactagacgattaaaaacaactttaaaatatttaattagtgagagacaaagataatcagtcatatgcatggttgtacaataccacgtagtccagcacacgcgagttaagagtttcgtgggagcgctgacacaaagaggtcacggatctaaagtttcgattaacggttgaaaaatcgacaaatcttaacggaaaaatttgtcgaggtatttttagcttaattgattattaattgagagttgagatgagatctaatttagaatgggcagaatatgtgagattagttatatgttgatatatcttgagtcgataattcatgagcgtaactaactggggcgctagatcaagctccaactcttctgtgctcatttgcacttcgtggactcgtacaattggtaataaattcgctttttcttctcctattttgtgtccacggttcaccattacgtccacaaccggtagagacttacatatgtaatcttgggacttacattgtaaatacactaaaattacatatgtaattttgagacttacaatgtaaatacatgttgactattttttcatgaaaaatatggcggaataaatatagatactctcaattaataatcactttaacgcgcggcagcatactgctggactgagagagcaaacaaaataataatctatctattattcccatgctggttgttttgccgcctgcctattggtccaggtggcacaacgcttttctgatgcgtgtacgatgctgcctatacacagttgtgcatggctcatgtagcatcatgggccaagtgccatgcacgattgaatggactaggtaggcccacgtgtgaagaaagaaaaaaaagaaaaagattgatctatcactgtacgtattgatttggttgcttctgtttacaccgtaattttgacaaattaatccttatattaaaactttaaaaataaaccatgtcaaaaactaattaaaaaaacagaccgtgaccttagcgccaaccctaatgacactaaactaaaacatctcagcaccacccaacatggcacaaattagccatgtaaaaggaactcaacgtcactatacattacgatgacctcttaataggtttaaaatatatagcatgtgctgaaatcctgagtagtgtttaactttattcgttttatcaaaaaaaagtgcctataagtaataaaaatagacaaaacaattttaaaattaagtagtgaatttaaatttatacaagtaattcatagcacatactacgaatgcatatgtaattttcaattattaaataaataaaccaagattagtattgctatgtcttaaacatatggtaaaggttaacatatatactttagagaagtgctctcacgaattgtgcttatcgttgggtattcttgcaaaacgctgttaatcctagaatgaattcatactggtacatgtatgtcttcctgaaaataggaaaggaacgtgcatttttttcaaaaaaaaaatatatgttcaatgtgttcaaatacaaaacatgcaatttcattaaaaaaaattacttattaacccaataaaacatagctagcatatgttaccactctttctgcaacctttttacaaacacaaaagtaagaaaaaatatttaagagttttgtggacatgagactgtctatatgacagccagctgaatttttgggtagtatcagccgaattttggatggtggaatctttcctaatctgacacgtgttaaaaatcctaatgccgcccaaatctccaaccactggttgacgtgtgtcacgatgagttctattttgagcagttaattaatgggtctgtcattgtcaatatcagttcaataaaactctgttgctcaactaaaatggcacgtcaactattcttaggttatgcggttctgctatacattacttcttctgctacacatcatacatccttttcgttcaagttgaccagctttatatataaaaaaacatagtaaaacttttgacatgaaataaatattatttaaaaatatataaaatgatggatttaacaaaaaaatatatgttttatcaaacttaaaaaagttggcttaacccaaaacgtccaaacaactttaagtttggccaaatatatagaataatatagtaatattttcaacataatataagtatattgaatggtatatttagtggaaccaatttgttgttgtaaatgtcactatgttttttataaactttgacaaacttgaaaaggtttaaacaaggacaaacccaaaatgactgaaaacacatagggagtagtacttaccgaaaaattatagttttattgcttttcactatctatcagccattaagtccattaagtaaaaattaaatttttttctattaatttcctactgtatagtcctcttcagtgcacacatcgcaattatcttcacctgcacgtgcttccaatctcaaaattataataaaataagagaagggcaaaacaaaaggaaattaaccctcgggcaagagatacgtatggaggtagagtcacaatgaaggaaatgaaagaaattaggttgttaaccaatttttcttatggaaacataatttttaaataaagcatgtttctctaaattttacaatgaaacaagcgatgggcagattaagaaaaaactagtgttcccaagtcagtgacggtctggcggattcagcatgggtggccccgctcaaacccctcctacctagttggatcaccatggagagcaaggagagtgggggagaaaaagaagagtagagggggctagagaaaggaggcacagatccccctctaattcaaagctagatcatacaaaacacatggtcctaatctacatatatacggcattagaatttgcagacaaaacaaagagtatggtgaatggagacaaataacaaaaaagggatataaaacgagcatactggtagggttaggagaaggcgcacacatgcagggaggaggcgccattggacggaagaaagggatatatacacctttcgttttgtaattatatgttgagttccgttccgaacttatatcagtatatcagtcaggtacttcgaacttaaaaattggtagttgttttcgttggattactctatatacctaataaaaaaattagtaaggcttccgtgagtttttttgtccgtcgtttttttcgctctttcttccttcttttttcccgtatttcttttttttccgtccggccttttttcgttttttttcttttttttccatgcgtcccttttttccgccgttttcctcttttttttctatccacttttttttcgacgtcgcttcttcgggttttttccgtccgctttttttgtcctttttcttcttttttttttgcacgttttttccttcttctggttttttcatctgcttttttccatctctattttttgtcactttttttggcacgcggtgaggattcggtttctaatccacttggtttttttttcccattgccaggatttaatctcaagctgttgtcctggccaaaccctagcgccaccgccacagtgatatgcctcccgtgcgtttcctactataactgattgcaaaaattgattccccaatactccctcattatttgatttcctcttaaaattcggctttacatcactagatttaatctccatttaacagtcatcattttcccataatttccccttttcaatttggatttaattcactagatttaatcttcgtaagccggtgatcttccccttatcgtttttatcccaagttttgtggattcgctctgatttgggaaaatctgaaaaaagagatactgatgtttctgctgttgtatcactaaaagatgtcttttcccgttgcaacgcacgaccatttttttcttgtcccatccaaattacaggagcaaggaaattacgaaaaaaacaagtatagaaggatatagcagaacattcagggtaactggccaaataacaacaatagggaaaaaagagaagaaattatagcaacgtagctaatttctcacctctcccaccaatttgtagatcgatggcggccacggcgcgcgcaccgcctacaccacaaccgcacgcacgggagagatataccggtggagacgcgcgtgacaacaatgacacggcgagctgtggtcaggagctctcactagcgggggttatggaagaaggttaaaagaaaatagcgggagaggattagatctatatatggaagaaggttaaaagaaaaaagaaaggaaggtagggttatgtcacgtcccaaaacgactctaaaatacatcctctaaattatgcctagaataattaaaaaccgtgtgaaagcctccaacaattaaaatgtgcaaagttaaaagtcaaacaaggcttagaggatttttgtatatttcctaaaaagcctaaaatatgtaaataaattttagtggaattttcagagcacaaataataattgttaagaaataaacaaagttaaaaaggttttataaaaagaaaaaccctaaaatccctccttctctctaatgggccaacttcggcccatctccctccccctctctctcctctccccgcggcccactcggcctctccccgcgcgcgcgccgctgacgggtggggcccacccgtcatccccgtcctcccgccgctcccgccgctccgcctgcgccaagcgccaccgccgccgccaaatccgccgcatcccgccgtccccgcgtgcaataaagtgggggaaatcactccccgtgatcccctctccctttccccccatctttccctctctctctcgcgttcaaatgggcggatttgcccccgcaaatctcgccggcgccattgatggcggccggacctcccgcgccggtttccttcccctccggccgctctctcccccttccaaccctatttaaaccctccctgcacctcctccgtccgtttccgcctctcgccgcccttcctccttgccggattcgagctcgcgacgtcgctctctctctccgccgtcgccgccgagctccggtccgccgccgtcgtcgccccggaccgcctcccacctcggcgccgcctccttcgggttcgccgcatcttcgccgacctcgtccacctctccgtttcggtcgccgacagccggaacgccgtcaaccccgtcgacccgagccgcgccgccgcctccctccgctccggccgcctcctccgtcgccgccgtcgcccaggggtgagccgtggaccgtcgcctcctttcctccttccctcccctctctcggccgccgctccgccgcgccagtggtcgccggcggcaaccatcgggacacgggcgcgccgcctcccgccgaccgcgccagcgtggccgccctcgggcgcgccgagtggctgccgcgtggggcccggccgtcagccgcccacgccctcgggtgcggctgacgtgtggggcccacggcgccggccggtgtgagcccgggtgcacccggtccaccgtggaccgtaaggctgccgcgtgggccccactcccgtggacccggtccccgcgccccttcccctcggctgacccaataaaccctttttaaattaaaatttaaatgaagaaattcgtaaatattcatttaaagagcatataaacttcaaatggccataacttggccatttgaactcgaaattggaccattcaagtctctaatttttccttaagaagtcaagaacccatttttgtgctttgttcttgctggttatatggagtttattagagtaaaagccttttcttttccgttggtcgtgtagacgctgcagctttggaagatccgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcattgttttatctagtcatgcctatttacttttgttatgaccttattattgttattgttattattaccttgttcaccctagaataaacaaaaccccaactagtggacactctactcatggtaccactagtatgaatttagttagatgcttcgccgcttaattaggtaacattaggtggttttacaactctagactttgggatattcatatcacctggacactacggaatggttggattattgtggaattggattcacacctccccctctattcaaaatcctcaaaatggttttaggctgggctcggggtgcatggttttgatagtagcacctcggccatataaggaccggtcttcgggcctctattgcaaagcactaccgtactttcacatgtctagtgggtaaggcttagtttgtggctcagtctggttataaacaaaagtacacggatggagatggacgaagtcgggggtcgatggacatctctaggacaaatgaatgctacacgagctgcggcctggtagttgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttttaattcttaaaacctgcttaacaactaaaatgtggaatggttggcctgggttggcttgggacgagctgggacccagggtcgggtttccagttcggtctgaatcatagtaggccttacgttaaggcaggttcgtgtgggttcacggccttgattaataatcttgtatagctctaggatcgtatttacaaaatagctttgagcaactaagtgtcttttaatgctgtttactgcaaaccctaacccttcatactataaccccccttgtactcccttgcatttattctgcacttgtgggtgtgtcttgttgagtacggtggttgtactcagtcttgctcaatttttcccaaactcagaagaggagttcctggaagatcaaggctttggtgtctagctcatgcctgccgtcaagcgcctgtggtcgtcgccctagtcttccgctgtttcccgtttgtctttgtgtgtgctgggccttcgccgcccatgtaataaattaattatttacgcttccgcttgataaactctgaaatatatcaacttttgggtgtaccttgcttcctgggacaaggaataatacacgcacgtaaggaacgcccgttgggttattttcggtcgtgacaggttaggagaaggcgcgcgcgtgcgggtaggaggcaccatcggacggaagaaagatgatatatacgactttcgttttgttattatacattgagttccgttccgaatttctatcagtcaggtacttggaacttaaaaataaattggtagttgttttcgtcggattactctatatacctaataaaaaaatttgtaaggattccgtgagttttttcgtccgtcgttattttcgctctttcttccttttttttcccttctttctttttttccatccggccttttttctcttttttttctttttttccgtccgtccattttttccgtctttttcccattttctttgcgtccagttttttttcaacggcgtttcttcggtttttttttccattcacttttttttctgtctattttttagtcagattttttgacatgcggtgtggattcggtttttaatccacttggttttttctgtcgccgggatttaatctcaagctgtaccgccgccacattgatctgcctcccgtgcgtctcccgtgcgtttcctgctctaattgattgcaaaaattcattccctactactccctcatcatttgatttcctcttacagttcggctttacttcaccacatttaatctccatttaacattcggcgtttccccataatttaccatttcaatttggatttaattcactagatttaatcttcgtcagccggcgatcttcccctagtcgtttttatcccgacctttttggattcgctccgatttgggaaaaactaaaagaagatatactgatgtttctactgttgtatcactcaaaaaacgtctttacccgttgcaacacacgggtatttttttctagtcccatacaaattagagaaacagggaaattacgaaaaaaaaaaacaagtacataaggatatagctgaacatgcagggtaactagtctaataacaacaatagggaaaaaatcggaacgtagctaatttctcacctctcccaccaatttgtagatcgatggcggccacggcgcgtgcaccgcctataccgccgccgcacacccgggagagatataccggtggagacacgcgtgacaacgatgacgcggcgagctgtggtcaagagctctcaccagcgggagttatggaagaaggttaaaagaaaatagcgggagaggattagatctatatatggaagagggttaaaataaaaaaaaggaaggtagggttaggagaaggcacgcgagtgcgcggacgaggtgccgttggatggaagaaataggatatatatgcctttcgttttgatattatatgttgagttccgtttcgaaatcagtcatgtacttggaacttaaaaattggtagttgttttagttggattactctatatacctaataaaaaaaatttgtaaggattccatgagttttttcgtccgtcgtttttttagctcttcttcctttttttttctcttatttctttttttccgtccggccttttttcgcttttttttcttttttccgtccatccgttttttcgccgttttccccttttttttccgtgcactttttttcgacggcgtttcttcggtttttttccgtccgcttttttcgtcttttctttctttttttgcacgttttttccttttttccatttttttcatctgctttttgtccgtctctgtttttttagtcacgtttttttggcacgcggtgaggattcggtttttaatccacctggtttttttccgtcgccaggatttaatctcaagctgttgccctggccaaaccctagcgtcgccgccagattgatctgcctcccgtgcgtttcctactataattgattgcaaaaagtgattccccactactccctcatcatttgatttcctcttactattcggctttacatcactagatttaatctccatttaatagtcatcgtttccccataagtttcccttttaattcggatttaatttactagatttaatcttcgttagctggtgatcttcccctagttgtttttatcccaagttttgtggattcgctccgatttgggaaaaactgaaagaagagatactaatgtttattctgttgtatcactaaaaaaacgtctagacccgttgcaacacacgggtattttttctagtcccatccaaattggaggagcacaagtatagaaggatatagcacaatatgccgggtaactggcctaataacaacaatagggaaaaaagagtagaaattataggaacgtagctaatttctcacctctcccaccaatttgtagaccaatggcagccgcggcgtgcgcaccgcctacaccgccgccgcacgcccgggagagatataccggtggagacgccgtgacaatgatgatgcggcgagctgtggtcgagagctctcaccagccgggattatggaagaaggttaaaagaaaatagcgggagaggattagatctatatatggaagaaggttaaaagaaaaagaaaggaaggtagggttaggacgtacggggagtaggcaccgtcggacggaagaaacatgatatatacgccttttgttttgttattatatgttgagttccgttccgaacttttattagtcaagtacttggaacttaaaaattggtagttattttcgtcggattactctatatacctaataaaattattgtaaggattctgtgagttttttcgtccatcgtttttttcgctctttcttccttttttttcccatgtttcttttttttccgtctggcttttttcgctttttttcttttttttttctgccgttttcccctttttttttccatccacttttttttcgacgtcgtttcttcggtttttttccgttcgcttttttcatcattttttcctttttttttgcaagtttttttccttttaaagtttttttcatctgctttttttccgtctctattcttttaatcacattttttggcacgcggtgaggattcggtttttaatccacttggtatttttctatcgccgggatttaatctcaaccagttgccctggccaaaccctagcgccgccgccacattcatctggctcccgtgcgtatcctactctaattgattccccactactccctcatcatttgatttcctcttacaattcggctttacttcactagatttaatctccatttaacattcgtcgtccccctataatttcccctttcaattcggatttaattcactagatttaatcttcgtcagccggcgatcttcccctagtcgtttttattccgagttttgtggattcgctctgatttgggaaaaactgaaagaagatatactaatgtttctgcggttgtatcactaaaaaaacgtgtttacccgttgcaacatacgggcattttttctagtcccatccaaattagaggagcaaggaattatgaaaaaaaacaagtataaaaggatatagcagaacatgcagggtaactagcctaataacaacaataggaaaagaaaagaagaacttataggaacgtagctaatttctcacccctcccactaatttgtagatcgatggcggccgcggcgcgtgcaccgcctacaccgccgcctcatgcccgggagagatataccgatggagacgcgcgtgacaacgatgatgcggcgagctgtggtcgagagctctcaccagccgggattatggaagaaggttaaaagaaaatagcgggagagtattagatctatatatggaagaaggttaaaagaaataaaaggaaggtaaggttgggagaaggcgcgcgcgtgcggggaggaggcgcgtcggacggaagaaagaggatatatacgcctttcgttttgttattatatgttgagttctgttccgaactactatctatcagtcaggtacttggaacttaaaaattggtagttgttttcgtcggattactctatatacctaataaaaaaatttataaggcttccgtgagttttttcgtcggtcatttttttcgctctttcttccttttttttccattatttcttttttttcgtccagccttttcttcgtttttttttctttttttccgccgttttccctttttttttctatccatttttattcgacgttgtttgttcggtttttttccgtccgcttttctcatcctattttttgcatgtttttattcctttttccagttttttcatccgcttttttccgtctctatttttttagtcacattttttagcacgcggtgaggatttggtttttaatccacttggttttttccttcggtgggatttaatctcaaacagtttccctggccaaacctagcgccgccgccacattattctgcctcccgtgcgtttcctactttaattgattgtaaaaattgattctccactactccctcatcatttgatttcctcttacaattctgctttacttcaccagatttaatctccatttaacagtcgtcgtttccctataatttccctttcaattcggatttaattcactagatttaatctttatcagctgatgatcttcccctagccgttgagggagatccgtcttccccgtgatctcgtagtaggatgtgcattatcaactcaactctgctcatgtccccttctgtcgccgtctcgatgccacatattttaagatcggtgtttgtgctgattaggggctgttacatactacctccgtcctaaaagaaaatcaaaccctacggatgcgtgtgtccagattcatctctagagtttgattttttttttacgtatgcccagattcattcctaaggtttgatttttttttacatgtgtccagattcattcatagggtttgattcttttttagacggagggagtaagtgaataacaatttctcttgaagataaattgaacggttttgataattaaggtgggtccaatgccctattttagaattgggcggtgtatttaagataaacatagtaattcaggggatcaaatgggctcacccattgtaatattggaactatttgccacgagaaagcccatagctgtatagccgatttcttgcaccattagtgtgcatctcgttactactagttgggtttcgcttgtttcaactataatttacattccagagctaattttgaattttataactaaattttagaataaatttaggtgttcttttaatctctttcatcaatgaccgtgatgttcggactgataagagtaaaagtgtaaaagtcttaaacggacccctttagatagcagaaatggcaaaacacatgaatagaaaaaacacaatacttttaaaactgtataacgtgcagtagtatcgatcgagacgaaatacacatatacaaattttcaatgatgatctaatgctgtatgtttcttgattgtgtataatataataataagacaaacagaaaaatatgctagtgcttttgtctaaaactgcctgtttggaacaacatatttgggcaattggctaagatatgatataaaatttacccgtatgccgtgatggatcgaggcggcacacttgtcatctttcggtaatacagtaagagttgggccagaatagtattgtggctgacgtgtgggcccagcttagctgaaatggtattggggcttaacaatttttgccagcaaccttaatttgtctattattaatacactacgtttcagtactctgcaaggttacatatcccagatacagaaatctgcatgttccaactacttttacccagtcgtgtaggcttcgatttactccacaatctgcgtacagaatactgctgtttccagaaccaattgaagccatgacaccaatgcaacagtaactcatctgcagtatcatgggttattcttccatgagtcacagcatgtaaagtgagctagatgaatcatgatatcgcagcaagcaaaatacagaaagacaaggccaaatagcaggtacttgctccagacatccactcaaatcaccattacggatgaaacagattgaaatgacagttttttccgtccaatttatgttcctacccttaaaagtttattaggaaattaactatgaattaacccagtcacttctatattcatctgcccgatgcaatatattcctctgaacctttgttactgaagagataaaaaagatatcctcaaattaggcctgaaaagtgagctactggtagaatggtagagtgcaagatcaaaactcaagtttcattatctcatcatatatcccaaactactcctgaaaaaaaaaacactgcaagggtagatgatatcaacagtaataatgtgcaaaagctccatctaatgacaatcacgattatgcctccatcagtaactgagagccttcctctctaatcacaccccagaaagcctaactgagggtcttcgtctctaatccgactaaatgaaaaaaaacactgtaagaatcacaccccagaaagcctaactgacagtcttcgtctctaatccgactaaatgaaaaaaaaaaacactgtcagctgtaagggtagatgatatcaacagtaatgtgcaaatgctccatctaatgacaatcacaattatgcctccatcagtgactgagtcttcatctgagaaagcctaactgagggtcttcgtctctaatcacggcgcagaaagcatccctgtgacatgcaacatgaataacgtcatcagaaattcagaaacagatttcgttaataaaaaaagaattcagaaaagatcagttgcaagttgcaatcagtaaagcaattggcgcggatcggttgcaatcagtaaagcaatcggcgcacctcgatccacgtaacggagtgaccaacgatcagcccgagacccatcatgacgtagcaagccgcgtccaggaacctgccgctgtcgccgccgcgcacggcggcgaggtagatgacgtagagccccagcagcgccacggccatgatggcggctcgccccatgttctcctcgctcctggtgtaccgggacgggatgcgcgcggcggcctcgtcgtcgtcggcggcgcacgccgtcatcgccaaccccaggatcggccccatgagcagcgcgccggccagggcgatggcgcacagggccacatcgcccttgctctcgcaccaggggaagatctcggcggcgaacacggccaccatcgcgacggcggcgatgatgcagaaccattgcgggagaagccacatcagactacgatcgaatccggcgagaaaaaaaaaactgaggaaatcaacacggcttaccctaatcgcgaggagccatgggggcgtcgggttgcacgcggctgcgaccggaggcggccggccttcctcgagcaagcagaaccggagatcggccgccgccgccggagtattccccatgccgccgcggccaggggagggatcgagagcgcgtcggcggcggcgagtgtgcggcgagatcggaggaatttttttcgtttttagattttttttaatatttacagaaataatctatcgaccaaaaaaattacagaaatagcccctgccgccccaatggtgggcggcaagctgacgtggcagacggtgggtcaaccgcgccgtctgccaccgtcggccaaaattgcgattaggcccttgccgcccatacagagggcggcaaagggctaattgcaattttggccgccaataaagagcttgcggccgtacttttttcatctgggtcccttgccgccccagatgtaaaacgtacagccaaaagatttttctatgttatgttaataataaataaagaagtatttattggtaaaacttgttaatattgttataaaaatgtattgaagttggttgttgcgcaatttcatatgttaagtgagatattattttgtaccatattcgacgtattagtactcggataatttatataggcctatcgcagtctgggtcgtagaaacattatatggacttaaataaggagaattatgtaacatgaagaaatagtagtacaatttgaacatgatacaactatttgcattgcggttacatagatgatattagattcgaactaggagggaggtagtgtaatagttgaacacaacgacgatgtagtaatgggacaaggaagcatgacagtagaaatttcaatatgccaagttgtccgataatagctaacccctacgttaggatccctctcctctctcaaaccgcgctttagtaatcctgtattgctctggtagttcaagctgcacaacacggctaggtggagttagaacccttctggtgtctatccattctctatattgacatctccttggtggttcctgggaggaaagaatagatgtaaagcaagcaaagttagtaaatattgtgagaaaataaggattcatgtaatcaaaatattcttaccatgaaatcatcgtcaagaatatttggacaaacaaagaaccttcgacccaatgttgtaggatttatggaacgaagaacctgacaacgatcaccacacctgcatcttggacgggcttcccatggagggagtgcgtagttagcacccgccagtcgctctgttgttcacgacattgtcgttcataagccgtttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcaattgcccgtacggaataaataagcatatgcagataataaaatacctcacggtcatagttagggcacctaaaaaagcgccttcctcgaatatcaggattcctcgaagccattagttggcatcgatcaccgcataggcagagaggacactggcaccaaggtggtagtaggtatacacaaggatcgctacgccagtttggatcctcaacaccccggcgtctagccattgacaaaagccggtcggatttgtaatgaagcaagtgggaaagagagtactgaatgtgactgagttctgaaagattgtgaggcctcactcgttaaggcgacttatataggcgcaaaaaatcgagtgatacccctgacatgtgaacgtggtggggtatggtgggtacggctgattggcgccgaaagttacatgcctgatcggcgccgaaagttacattggtcgtatgcgccaaatggcgggcaaatactcgtatcgcacgcgaataaaggaggctgcatcggtgcggcagaaagtagtcgtgcatgcgctgaaaggtatcgtgcatgcgccgaaaggtatcgtgcacatataacaaaaacgtagtcattacacaagcatacagtactagaaagtgaagcaaataaacaaagagaagactgctctactggccctgccccacgccgcgaccacgcttggtcctccgggcctgtgcttgcacgtggtcctgggagtaggtgaaacgatccggtggcacagcacgggtagcacgagtgtcccgcggaggagtggcctgcgcctggtcctgtgtctgcaccggcggtgcgcctcccagctgtgaggggccgatgacgtcctctgtcaagcctgaagcgaagtcgaagtcagaaatgtcgaagagcacggtggaaggcagcaagcggtccgacgaggtcccagcatggtccagtggtggaccctgactcgacgtgctagctgcctgtgacgaagtcccggtgtactgccagaactgcactgagtgcgaggtcgacgcagctgcctgagacgctgaccctgcaaactgggagaagtgggcggcctgcgtcatagcgaactgggcgaaacctacacatcgacaacgggacccttgtaagctaagacataaaatgcatgtaaattgattgtcgaagtaatgttgtttttttaagtacctgtggggggcacaacagaaggcctagccaaggaaggcggggtgctgaacagtgcacgaaaccctgaagcaatcggcaagtgaaacagctcacttatatgtgcgaggcatgtacagaaatagtaataaaaatacttacctccgtgcggagggggagtcggcctaggaacgtgcgcagctggacggggaccagtcggtacgggtggccgctgtacagctgcatctgcccgagcaacgtcgtctgcacgacaggtgagcactcggagaatcgagtgcatcgactccaccatccgcgtgtatgtcgtcaggtgctcctctacgggtaccagaatccccgcgcctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggtcgcggtgcctggcgtagaggtctctagtgctcgcaacatggggctgctgctccaagggagtgaaggtgaccctagtacgggtgtgtggccctccaggccttggcatagctaatagtatacttgtatgtctcttcgatgtgtcggattattgaccttggttcatatgtgagattatcgatgacatgcgcatacatctaagatgcaacaaatgcacatgtaatgttcttgtggtatttctgaacaccaggtagaaaacatgtatgcttggtaacaactgacactgtccaataatccttccatttccccttatatgcgtgcactctccagggacaaccatatttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctaacgaatcaccttcctctacatgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcattgcccgacttactataacattgattgttatgtcacttgtctgtggatcaactctcaagcccctcattaaccatgcttttatagaaggtacactcctctcagccggtctatcaattcccctttctgatacaataaaatctgacagatctaccccagttggcccgtccggacgtttcctggtctatggtaaacttggaatatttgttgtcgactatctgtcaacgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaaaaatacacactatttaactcaatagtcacatataggatctatgaatattacatgaaatcggtatctgaatccggcagggcttcgccccttcttttcttctcctcccctctcttctttttttttttcactggaactgaggagggaggaatgagggctgggggctgggcggtaggccttttataggcagcgaggcctgccgcccggccagagggcggcaaggggccacctgcaaaatagccggccccgactggcttttttgcattcggaccccttgccgccccaccagagggcggcaagggttttcctgcaaaaaaccctccctccgtcaccgcccgttcctcccccgtttgccacgtcagcttgccgccccagaggtgggcggcagggtctatttttgtaatttttttggccgatagattatttctgtaaatatttaaaaaaaaatctaaaaccgaaaaaaattcgagatcggagggggcgtggctgtttcggattcgttggtgagaaaggcccaatttgtaacattagttgggccagaaaagtattacgtgcaggaaaaaagtacactttaactctcttaaaaaagtacgtcgaatctaattcgtacctctcaaccagaaaaccagataagacaacttcccaactattgaaactagtgtaatttaactcccttagtggttttgaagtgtggttttgctaacatggcggtgttgagctggtcttcatcccacgtggcgcttaggtagcattacaacccgttttagttgggcgaatttgatatatatttgtcgacaaattttccatcaaaaatttgacagatgtaattacaatacaatcgtggtataattacactgtaacttgtatgtaattacactataactataatgtaacatgtatgtaactttcaaaaatctctccataacatttatttcggtaaaatggaggttgtgagaacaaatcctttcacatatgtgtgtgatgtgatttttcttcttcgtcaccagaataaattttttaatagatctaacgattcaaaattacgtgaaacttatatacaagttacactgtaattacatacaagttacagtgtaattacatacaagttacagtttaattacactatgattgtactataattgtatctgtcaaatttttttagaagaaaatttgtcgacaaatatataggtggtccccttttatttgggctagatctaacggaacaaatgagctcaaactaatgtgccaaatttttttatttgccgtgcgttgcatttttttgtgatacatccggtattaggtagggtgaaaacggtatggaaatagacggaaaccacctttatcgtttttgtttttatattttttttagaatcagaattagagtcggaaaccccggatacgaaaacggaatcgaatattattgaaactgaaaacggagcaaaaataaatcggcgcgaatacggtaacgaaaatttatcggaatacaaaaatccctcaaactgataaatccaattctcaagtctcaatggtcaacaattcatcataaaacacaatcatataagtccaattgttaagtctcaacagtacatcataaaacacaatctatggaataaattatctatgtttaagagagtaatgctgttgataaatcccaatataggaaaaaaatattattatgtaccctcacatttgcataacaaataatttttaaaaaataacagccaaacaccatggtattcactattcagtgtttaaaaaaaagaatccagggtatttcagtcacaaaatttctggaaatttcgagaaaatttccggaaattttccaaccgattccgagttccgacgaaaactacccttatcattttcgattccgtttccttgaaaatatttccgaatttgtttctgtttttgaaaaattccgaaaagaattccaaccaatatattccgttttcgaaaataggtccggaatccggaaagtttccataccgttttcacccctattaggaactgagcaacgaattgaaacatttggatcgctatataatataattgaaaaagttaatgaaaattgttccttggttttgggtctttttgtgctggagctgatccgaatttggtttattccagtaaattaaaggtgaaatgaaagggagaaatcaagagaaaaatcacgagagaggagggggaattgatttttgcaatcaattggaggagaaacacacggaaagatagatcaaagtggtggtggtcctagggtttggtccgtctgcagagtacaataggtcggatgagataaaaattcgaccaccgaaaaaatagaaaccggatgaaaaaaaacacgaaaaaaaggaatctggcaaaaaaaaaacagcgaaaaaaaagatacgaccaaaaggtataccataagctttacttatttttttaattattattattaggtatagatatagatagatagatatataacatttgttttgttattaaatctatctatacctctgtagttcaacaaatgattccactcattctttcattcatcactcaacggtctagattgtctcgctaagatccaacgtcccagattttcctccacctccccacgaagatcgcaccaaataattcctcccacctgcgcgcgcatacgtaccccctcccacctgcgtggatgccgccgatctctccaaaaatcacgcgctcgtggcaatgccagccggaatcgctggggcggtctccttctccctgaccttcgcgacgatggcggaggcaaggaaaggccgcccatggatctgctgccgaagaatcgtggtgccccttctgcaacaaagtcagaggtgatgtgctcctgcttccgtgcactcctccaatctagtagcgttttcgatgtgcattagacctgctaaaaaggtacttttcgtgttgatctgagttagcgaataaagtagtgtcagctaggctgctaatgttgacctattgctatgcttacatgaattagctatccgagcaatgatagagttaataatgttgctattcttgggttgaggagagtcagtctgctagagagccagttgtgctgagcgtgtgggcaggtgttacaagcacacncatagagagttagaagcgacaagcaagtatgtcatgaaagttatggcggagccagacatttcttgcagttaggatctgagttgatttcctaccagttctaagcaaatggttatcgagcttattcttttattcatcactcaacggtaagattgtctcgctaagatccgatgtcctagatttgccccacctccccacgaagatcgccccaactgattcctcccacctgcgcgcgcatgccccctcccacctgcatggatgctgccgatctctccaaaaatcacgcactcgtggcaatttcagaaaccaaaaaaaaataaatcatgcactcgctattctgccccaaaaataccgcatctcctagccctaaatgccaccgtccaccggatcccctccacctcgccctcaagtcgccacggatccgtcgccggcggacagtttccgtcgacaggtcaccggcaatcgctcaccatcatccgtgatcccccctccctcagtgccgcctcaccgtccaaggcaaccgggcctcgccactgccccatccgccgaccaccgtcgcctcatcgtcaagtcatcgctcccttgatttctcggtgccagctcgcatcaactccacacaggccaagtttcagggcgctagctactcttttttttttcaggggatagtattagttttatatttctgttggatatgaggtatttttttattatgtttgctggagtgcttacttttatatcttttatggtttaaattacaatttcaatgaagcttgattatttgttcttctgtgcatgcaaatggattgccttgtgtatagagtatgcaaaatgttagtttgaagcaatatatattgtgggagatatacatttgttatataattagcaatatattaaaccattctttttattatctgaatcatatatttctgtattgttaaatatatccgtagcgttagcacgggcaaattactagtgtagtctaataacaaaacaaattatagattccgccaagaaactgcaagacgaatttattaagcctaattaatccgtcattagcaaatgtttattgtagcgccacattgttaaatcatggtgtagttaggcttaaaaaattcgtctcgcaatttcttggtaattggtttttttttctacatttaatactctatgcatgtatcaaacatttgatgtgacagcgtataaaattttgtctgggaactaagcagcccttagtatatcctaagtcgcacatgtccgtagcactggattcggtatgctaagaaagcaattcgattgagtgtgcttagatgaggctagcccaaatgtccctgtcacaagcaattgctcttcatgttagcttacctctaaagtctgaaccaccttccatttgcatgccaaaagaaagagggcactgtcgttggttcgtatgcccgatttgattgtgtagctcttaatgctcatagtcataattaagttgtaagcagattgtttgaacgagtctcatcttctgcttgaattgttagcttatatatgtgtcataaccaaaattttatttctagaacttaatgttgacttttttttcattgcggtatatttttcaacattaacttactgctaataacatagacataaaagttttacatgtaaactattttcattactttatttttttttatagttcatgagttagagtcgaagtcaccaccaaagacattatttctctccctgtgtggcaactacttgactcctcatttggcaactacttgatagggctagatgaggcacacctctgtgaagtcagctataaaaaaaatttaagttctcaaagaatatggttatgtatggctaaaatagtggcactctaattgtagtattgaatcaaattgttactcataagcagggacagatccagcgtggccttagagggaggggagggaggggggctcgagccccgttggatctctatggagagagaaggagatagtggagggggaaacaggaagaggaagaaattatatcttaaatctcaggcaaacttgtcacatcacctataaattattacattctatagctcaatgtaagtatgtcaaagtatcattctaaaatattttaacatataatcatccattatttttataatatttaatatacttttatccataaatttcacatcaaagtgtgggccatcatctagtttatcatttatttattatattctcgagctcaatatgcaagcatgttaaattactattccacatcattttgaaatatttcaacatatgagcatccatcattctaaagtatttaaaacacatttatccatgttttcgcagcaaattatggggtataatatattttatattgtgctccctccatccaagaatttaacatactgtttcgagagca

SEQ ID NO: 43627 - DNA, 13556 bp, Oryza sativa
gattaacaatggttaactcagtcttatcatcgtttccaacatactacatgtgcatcctacatcttccaaagaaagtgatctagcacattgacagagcaagaagacattatctatggagaaaaagcaatactctagaaactaaaactattgcttggctacataggatctggtttgcaacctaagaaaaaagggggacttggaattatcaatttggaacttgagaacacggctctgctaatcaaacatctagacaagttttacaacaaaaaagacatgtcgtgggtacacttgatatggaataaatactactctcactctaccatacccccacataaagaaaaaggctccttttggtagaaagacattttcaggctaacccccctgttcagggcaatcacatttgtacatattggctcaggagaaaccactcttttctggaaagacaaatggaacaattcttgtctacaaaataagttctccattttattctcatatgcaaaaaatgaagacatatcagtacaagacttcttatcaatccatgagttcaaacataattttcacataccattatcaaatcaagcaatgcagcagtggcacatcctagagaataatcttctaaacattgacctcaccaatgaacctgataaatggaaatacctatggaactctgatcaataccaataaaaaaaggtctataacatgttctttggacacatcacaacaaacaaaccattgatactgatatggcatagcaaatgtactatgaaattaaaagtgttcctttggctgatgttactggacagtctcaacacaagagaaatgattcaaaagaaaattttcaacattaagagtggtgacaagtgtgttatgtgtcatactacgctcaatgaagacatgtttcatttattcttctcctgcccttttgcacaacaatgctggcaacacattggaattcaatggaatctgacaggagaatttataaatataatcactgtcatggttacggatatggcataccttctatcctacggcttatggaatatacggatatggcataccttcgtatgtatgatacatcttcatatatgataaggaaatcaataagagattatggaaataatcctcacgggtaagtgaaaagcagagtcctactcgaagaggattaggattgtactatatcgtgctgggttcggtatctccgagttctacttagagataaagttaactcatggtataaatacacaccccctgggaggggtcctatggcatcgaatcatagcgccaataccaccaccatagcttacaattcggaggacgtgaagcctactcgccgggagatctcgtcgaaaccatctcgacaagggtctcgctggtaatctcgagatcgactgttctctattgtaatccttggttttccatatcaatctcatataaagtggattagagctattaccttacgaggagccttagccagtataatgtttgtcttcttgtttgcttgatgtcgtattgtgtagatcctcgtaccaacgtacccaataccctatgtatccggtctacgtgtatcccccgtcgataatcacaactgcctataacaatttccatcacaaattcttcattaaattgcttgcaattggatcttggcacatttcgagcagaagaaatgattacgtcttcaacaatatttcggtcagttttgataaatggaaggacagctttaagactgaatttggcttgcatatgcacatggcaaaagaagtagacaaacccctatggtaatcatggatagatagcattctgtaatttcgtttctttttctttttctttctttctgtttcttttctttcgtcctgtacgtaaacccctattattattattattattattattattattattattattattattattattattattattattattattattattattattattattatagcacaataggcgactctccagctgtttcatgtaaaaaaaagtaatggagtaagggagaatgtgagggtagtttgatccaattatacttataataccatactaatacatatggcatgtcttttattcctctcctaaaagaatccaagccggctatcatcgtggaggcatacaactacaggaattcaagtctgctacagtgttgctatttatattccatggtaacttttacctaagaaattacttaaaaataaagtgaattgcatatcgggctgtttttattttgaaagttttactttggatcacctttaaccaatcctctcactttggactatctaattttacatttgttatattttgaacaaaccaaaataccttccctagacatgtcaggtctctactctagcaaagggtatagtctatgcatgtataagaggttggccatttattaataatggtgtagtatataaatatatgtaactattatatgagtggactactaaatgacgtgtcaaatgtgtttttacctaggagagtgggtggtaatgcaccattcgttctaaaatactactgtattcgacatcacctagtttcatccagatgagatggtggtatctagtacagtactatggatctcatctttttgcttatgcttatgtttatcagtcaaaatttgaattttcaaccttaaatttgaagctgattttgagttttttttttcatcgaagtttatttttcagcctttgcttttaggttgctaagaacacgaatataaaagttttattcacaaattatttttcatctgtaaatatgttgtttttcttattcgcgtatgttgatataatttagtgctaccagtatgcttatagagcttattttttgagtaaagtgcaatgccggtccctaaacttagttcgctcatgtcatccaggtccccaaactctaaaaaatacatttttagatacttgaacttgttaaagtgtattattaaggttctaaattttcatgatccctctgagatcttacatggtgctcacgtgacatgctacatgggtgttgactcattttatttatctttttctccattttttctgttcttcctttcttttgatgtgggaaaaagagggaaaaaaaagaataaaatgtagtggaggaaaaaaaaagaaagtttggatctgaaatgttcatgtgacatgttattttagtatccacgtggcacgatatgtaagcatcacgtaggatcgtagaggggtcgtggtaatttggagtcggaataatacactttaccatgttatatattttaacatgttaaatgacatagatgaataaatttagttacatgtgtcgcattttactcattagtattatttttagtgaatatttagagcggcgcaacagggatccgcttctctcatcatttgcaggcactagtgattagcgccacacgcacgaactccatccacacgttctcttcccccaacaaataataaacaatccatggacagaatgcatcatccccccaacattacatcgcctccacaaaaaaaaaaaaatatccaaccaccttttccacttccaccaccgctctcttctccaccgcgatccaaaacccaaaccaatttcatttttatgcaccccaaaataaaataaaaataaaaataaaaaagcttcgtcgcgccgggaaagttggagaacgaacgccatgagcgccgacgaggacgcggcgtcgcggggcggcggcggaggcgggaagaggaaggcggtggcggaggggggctcgccgtcgccgctgtcggtgctggcggacgacgtgctgctgcagatcctggggaggctggagggggacccgcgggactgggcgagggcgtcgtgcgcgtcgccgcggctcgccgcgctgctcagggcggcgtgcctcccgccgcgcctgacgcgggcgctccccgccgagctcctcccgccgccgtcccccgacggcgcgcccagggcgtgggccgcgctccacaagctctccgtctgctgcccgggcctcctccgcgccggcgtcctcctcgagccctccgatgacttcggcctcgagctcgacatcggccccgacctctccgtccccgccccctccccttcctcctcctccctcgaccacgcctccaccgctacctccgcccccgccccaccccccgactcctcctcctcctccgccgccgccgccactacgtggtcgctctacgacgacctctacctcgacaccgcctacgactgctccccctccgaggcggcgcagatctcaaacacggctgcgacccccgcccccgccgcggcgcggcgaggggtggcgtcggggagcaggaggcgggcgcggcggtggctggggacggtgggggcgcacctggcgtccgggtcgtggacgctgagcagggagcaagggaacaagctgctggcgagcaggttccgcggcgaccgcctctacatctgcgactggcccgggtgcgtccacgccgaggagcgccgcaagtacatggtgttccgcggcgtgttccacgacttcccgaggtcccaggtgcgccgcgccctgcgggacacccgccgccccaccgtcgccgtcgactgcgccttctgcggctgcaccgaggcctgggacctctacgccgccttctgcctccgcagcttctacggctaccacgacgacggcgagcccgtcgtccgcgcctacgtctgcgagaacggccacgtcgccggcgcctggaccgagcgccccctctactcctgactgcgacacccacacccatggttcggtatgcccactctactgcttttgctctctcatggatgtgcagccatggccgccattgccaagaatgccaagcaaacctttacttgtgcttgtgataattactccatgtgtatatactactagcaatgtgggtatcagatcatcacctctggagattatgcagggctgatgtgatgtgatatgcatctctttgtcttgttagagatgaatcagatgatgcttaagctagcttaataacgcgattaccgcgcttccgtcgagcgaattctcagcgcgattcggcgcgatcgattaagagtgtaacttctgatgatttgcacaagaacacagttatgatgcaggttgatgttgtatttgatattaggcagtgactcggttacgctctctacttgctgatgagctggggattcagaacttgcatcaactgttcttgcttgctgctgatttgcagtagacctgattgttgtacatgcactgcaacctccttcagctttattatcttcatgaagtagaatttgcaaggttcttgctctctagccttagttctgatacaacctgaaaatgctttgcttgccctttcctgattggatttaaacttatcatcgatctagttcatatacctaatctttggctactcagaggcaactaacctcactcatactgtcatacacactgtcaatcatgcatgcctctcctttctgaatattgtagtagtagcttgcagcctgcagaaagggcttaattttttatgatattatcaatggcaacttggcaatgacagccacttgttgctctttttttccccctaaactaatgggtaatggcagtggaactgtggaagtactaacagctgagtcctctccgaaccgcaggagatagttgcccgcctttgaaccaaactctagggaacgctcaattgcctgacggtttacctgatatagaaagagggagtgtgtaacatacaatttttttggatagccagtgtgtactttgtagcatggtataagattagtttatgagatagtgtatggctgttgattctcctgccttttcgggactgattcactgccggctacttgcctgcctgctgcatggagcgttggagctgatgatgctgcaaaatggcgacgcagaggcatttgttttatccattgcgttggcgtggcagccgctcggtcaccatctgacggacagaaacttatcatgttggttcttgtatattattgtatggtatgacaaattactagtagtacctttctgtcattctgtgtgccgtatccaggggcggaccggggctagagtcccatggaagttttgggaggaagtagaacgtacgagtatgaagcaatgacgtttcggtttgcttaactccggggggaattataattcgttttcgcagatgatttaggtgaaagaaatcacggtcaatgaatctctaaagaaaatttacatggaactgttgtaggttttggccctgtttggatcggagggctaataattagccctccaaattcttattatttaagagtattaaacgtagattactaaccaaacccattctataatccttaggctaatttgcaagccgaatctagtaagcctaattaatccatgttttgctacagtaatcatccgctaatcatggattaacataccttcttagatttgtcatgcgaattaacccaggggttatgaaatgagttttgtcagtaatctgcgttaagtactcctaaataataagattttggagggctaattattagccctctggatccaatcagggtctgtttctaatcgggagaaattttctgctatcaagagagggtgggacagggctgtctgggtaacggtgcttctacgagtttggtgacaaatggtctggattttttatgttttggccccttttaagaacttattttataaatagatcattagaaaacttattccagaaatggattattttataggtaccaatgaacctagcgccgaagtataatgatgttgggcattggcgccgtccccctcacacccgagaggccaagacatagaggggtcagtgcccaacattatggcgttgatgacttgtttgtaaaatattttttgaaaagagtcaaaatgtacatatttttttatcacaaataggcctgatatcaatatctttggtgttgaggacctatttataagaaaaatatttagattttaactctttttgaattttctttataaataggtcctcggcgccaaagagtttagcgccggcccctttcatatcagcgacttagctatcacaggggctaggatgtgtgccgagacattgaatctcggagccaataaccctgaacccgagaaaaagggtctactcctgaaataagtttttttcaagggtatatgttcaaataagttttcaaaatgtaaaaattccaagacgaatggtgggtgaaaattttagctttcctaagacacggaagacggggaacctccttcacacactggtccctcttcccctccatttttggtggctctctggcaacacgctagggggagggggtaagggtgggcattcggttagaccaaaaattttgatctcggtcttcggttttcggtctttcggtcagttcaattattgaaaaatgaagaccgaatttcaacacaaaaatgctaggaccggcaaattcggtctcggttctgaccgaaattcaacaaccgtttcatatatacaaataaatcatataatttttcaacacaaaaatcacaaaaaaattctaagcacgtctcagtaaagactcttattgggatgcatgcctataaggagtagggatgtgaaaattagagtttaatcatattggagatttttaattcggtcttttcatttttgggttaacggagagactaaccgaatggatcaaacaaaattcagtctttcactgtttaggactggatttctcggtctcagtcttttcgccttttcggttcaatccttttctgattctactccctcaccaataggctaggcttccttcaatccaaatatttgcttgggctattcgttgaaaaaaacggtgggttattgtgtatgattaattaagtattaattattgtaaaactttaaaaatagatttttgaaaaaacttctaggtaaaatggtttacagttagggaagtgcgctcacgtcacacaaggcttacttttcccataccgtgcaaacgaacagagccacatggtgttgcctcaaagtaagccatgtggcgttgcctcagagaacttcggtactagtttcggtgtccatctccttctcgtggtagtgatggagtgtccatcttccttagagcacccgcaatggtaaagtaaggtgctctctataaaacatgtacatctcagcaatagactagattaatagtaaaccacagcaatagtatgtttacgtgggtatctatagctctctcatgcattgcctcgtttttctttataaactatctccaggttagtagatagctttgttatctctcttcatttaatcttttccaagtaggaaaatatgctgacatggatctcttgtagagagcctatagataaccattgtgggtgcccttaatccttcttacgatggtgattgattcaatccactctagtagtggaagatgtttttccctatggtcaaaacctattttccgtgcgggtaggccatccttatgtctgaaagtatctgagaaaatcgttatttttatgtgcgggtggcgcacccgtatgcgaaaattctgattttcgcgtgcagatgattatgtcgtccgcactgcacgcaaaaaagatattcgaaaaaaaataaaaatccttaagaaaaacctagctaggtgtgtcgtcgcctcctttgccgggcaccttctagtgccaccgtcggaccagcgcaggggatggctctgccgctgctatcgtcgcccctcacctcctccatcaagctctggacccgcccttcccgagcccgaagggagccactcccgctcgctgccggtgcgctcgagcccgccaacactactcctacccgccaccactactctcgagcctaccaccgtggcttaggagaggaggataagaatgaaggagaggatgtgggaggagtggagaggctggagtggataagaatggagaggataaggagagagaatgagggagtgggtagaatttttaaggtagagggaggtaggctggacttttcgcaggtggacctcttaataggcccgaatgagaaaataggtgtccacttgcagaaatgtatttccgtatacgggtcttttaaggagctggatgcgaaaacacaagttgatttttgcagatgcgatcagttatagcccgtctgtaacctataggtatccttatatagaaaaatcgtttatatagaagtgggtgttccatacgtgtaatttgctttgcaataattttgaccctagtttctaacatctcctcgttgggaaaatcggtatgtctcggattagcccatagcattttacaagggtttgtttgtaatattgtatgttcctaaggacccttttgtaattctatagtataaaaaaataaatagcaatgcacataattctctagtatagatattttgggtggaacattcccatggtggattttttaaaaaaaataatataattttcattttgttctttattaaaattaatatattctaagtggccataattagttttcttaatattttttatggttcttgtttagagttcaatatttttcgtgaaacatctacaagggcgtaacaaccttttagttgcaaacttgatggtcattggtcaacaacattacacagtgataaaaaaaaatagaaatacatactaaggaggatggtcaaagagaactgcaaattttcagtggcaaaagtgataatacatttataatgagtggcaaaaggaaacaaatccctttctgtttttagaagaggagccatcaaatttctagccattggatgtcaaatccaccgtctctaatccttgcaaaatgatatatatatatatatataatatccgtctctctccttcccaaaccctatcaacctccacctcccacctcatagccgccatcgctgaccgtggcccttcaccttgctgcttactaacattggtctaatggcaggaagctcccatcggcctccctttgccacttcccaccacccttatgttccccttccaaccacatgttttctattggtggagctctttaattttctttggggaaattggtttagttgtgctattcttccccgtctttagtggttatctccattgatttgtcgtcacctctaaccaattggcatctctcgcctagtctccaaccaaactcattgccaattcatcacacatggctttcgttagcaggaactcctctccgacttctgtgtaaatcatcattatcactccaatctctctttagatctagaacctaccaccctcaactccaatgctgaacctaagtccaaatgtcaataaaagaagatgaaggcagcacagagcagatggtgataactcgagtagggatctccacacgaatcaaaggtcagaaaattgcatcttttttgggttattttcatctaggatatcctatagaatccatatgcattctataaggatatcctagatgagcacacttaatattccatatctaaattcatctgcgatggacaaataagaaatacacattgcttttataagaaatcaagggaagaaacagaattaataactcatcaacagaatttgttagttctagttggattactaatatgcattttatttatttattttgcaaaaaaaatgcggtacacatgatttcatcttgacatatataaaccctatttgctagtgtaagtttgatgtgaccatttgcttcatcattcctgcatataaaagtgcattcatccagcatacatttgaaaacagaataacacagatagtagattgatatgtagaatcataccattatatatgttgctgcttgtattatctaatgaggccaaggtaataggaaagagattaagagatacgttaagttggggaacttgaactcattattggattgtatcggtactatctatgtctattgttcccgtaactgccatagttggagtaggagcaaactaaaacaaaattgggcaaaaacttagcaaagagaaaattgttaagtcaaaaataggaaatttataaaagtgacaacaagcaagttgccatgtttaatactgtttattttaattggctatgtgtaatcatgttgaattcaattttatctaacccaagccacctaccctaggacttacatactctctaattttagtgtgtgggtcatgtgggatggtccctctaattttacaacttcagtttgaacgaggacatgtgtaacagaaatgacaaaaatcagtaatgcttctccccctccatctatttagctatttccattctcattctctctctctcgtttctctccatctatttctctctccctatctttgggactctttcacaacttagtttgacggaaatgtgtgtaatggaaatggcatcttaccaaataccccttcatctatttcacactctctaccttccctgttctctccatctatttctcattctctctctctctctctcttattgtattgaattgcattgtgttgtgttgtattgcattacttcattgcattgtattgtattgatactatgtctaataatctcatcggcagagcaggagcaaaacaaactaaaatagtgcacaaactcagtgaagataaaaattattgatggatcttttgtgaagatgttaatgcactactagaaaatagtaactttgttctatcgaaggttgttaagtcaaaaatacaaaatatgtaggaaattataaaaaagacaatgtgttatatgttggcattataatggctttaattggctacgtataatcatgttgaattcaatttccagctacctattattggactttctggtatgttcttggtagcttatatactatggactaggcacacttccgaagatcctaaattttactatttccaagaaaaaaatatccatcaatctttcttagaaaaacctttttaaaacaacttatcaacttcgtaatgtttaactcattttttgtgcccttgaataattgttataaactaaatttcatctatgttagaatggtgtgtctaattttaatcttgaaatttatattctttcctctgactaggtttctgtgctaaatataagttgttttggaacttccatacactttttcatctttatcattttgtgtatgtgccaataagtgataccattctcataaaagaatgaccgtgttttccaacataatataaacaaaaggaaaaatcgttacaagtccacactattttatatttaaaattatatggtttaatatgcttgtatctagaggagcctataaaatgatttctttcatctctatctaaaaacaaatattagtatcttacaatggtacacttcaaccatcccatattataagggactaaaccaattttcttaaaagaaatggaggaagtagtcgaagaaaaataatgtacaaaaggtgatagatgaaacaataaagtagtaaaaaattgataggtgggaaaataaactaataaaaaatagatgatggggaataaactaataataaaatggatatgtagataataaagtactgtctcatgataaaaaaaaatatattatggaacaaggagaattccttttctcttttaacacaaacaaacatggtaaagcttggtttttatagaaaaatcattaacatgtggtggcgattacaattacagtagcccactgtaacatgttcacattggataaaatcaagatccacaccctatttttagtgttcttctacaatataggaaaagcttcaactgtgacacataataaaggagttccaaagctttatctctaatgatctgatctctccccctcatataccctttcacaactttattttgaaacatgtaaacgtataaacggcaaaaaaaaaaaatctctccccgtctatttgactgtgaaaagtagtatttctcatttttctctatctccaaactctctctgttgttcccatctgccggaggccggagtgagggagcagccggcgaggagggaggccggcgttggccatcggcgtggacgacctcgcccaagacgacgccgacgccgccgccgacgacgacgactttcccgtgtgcggattggccaaggcggtggggttggagggaggggaggggaggggggtgacgcgcgcggccggtgcggtgcggtgcggcgcggtgctccccccgccatctccggtcggatcggatcgaaggtacgcctcattctcttcctccgttccgcttggatgatccgccgcgtggcgtagattggggggcaagggattaatcggtcggtctgtttatttttccctcggattaatcggtccaactttttcttgttactgatttatttgatgcgttgtttgtgtggtactaatggaggattgtgtttgtgaatgaaattttgtgatctagctttgtgttgattagacttggaggaggaggaggaggagaggggggaggttttgggtttttctccttccctggcaatggcagcggctgcggggatgggtggcaacggcaatggcgcggatgacaaggcacgtgatgtcacggatcagtccaaggctcttggtgggaacagctgcgaggaccgcgcgctcccctctgctgtgcgtgtcactgtcagtggtgatccggtggggacgtttggctctt

SEQ ID NO: 43628 - DNA, 783 bp, Oryza sativa
gtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttccatcaagggtgaggaaatgaagtccatgtacaccacctacaatccgcagaatgtggtggccaccgcccgtttcctgttccacaagaagaatc

SEQ ID NO: 43629 - DNA, 3731 bp, Oryza sativa
  unsure (1)..(3731): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatcccgcggaaaaattttgaggtcggaagagcgaagccgccatagaagaaatgggagaagaccacagcctcgtgtgtatcgggggtcggaaaagcctcaccgcacgctggccgccacccgatgatttccttggcagggagaacgccgtgcgccaccatctccttcaggttctcctccgtcacgtcggatggcgcccattggccttcaaagttttccttctcttccgccattgattttttccgaatgcgttgatttgattcgagggatggctagggagaggtgagggattgaggcagtggatcacgggaaggattttgatgaacttttcgaaggtggattcgagtggaatggtgaaccctagtttgccggtgcagctctgtactgtagcagggagtggggaaaatggcgagagttccggcggggaagatgaagtgtcgcttggatcttgggatttcttgttaagggtatcggaggtgcaaatgggcttaggcctgaacagtacctcagcccagtacttttgacagcgtggcccattgtgctccttagggacttaggcattttttgctttggcaatttatgcgcacaatagtgttgcccaatgctgataaaatcctttttacgcggtcatataattctttggaattattgcaatgcaaattaaaaggtgcccgacagaaaggtgttatgctgtttttgtaagcttttttaggctacaaaagctgtctgggttaacttagaatgacttgtttttaccatagtcatttccttggtatgttatatgcctgttttcattatggtaaatagtcaaagcctaggctattagacttattcattaccataatttttataatttttggtgggtaatctttagagttttctattcggatgcccgtcaagtgtgttcattcgtgaaccttttagagtgctaaccactcggattccttttattatggctaaaaagcagtcggctagaatgcctctttaggcgccgcgtatgcttttgtcatatgatgcacgattgtgctattattttgttctcaactatatgtttagtttgttaactaatcacatagttgggagctacacctaattaggtgcatctattcgatgcactatattctttatcttttcgccctttacagtctttgtcttcgttactcggcagatcttggcatgaaaggtttgaagcactcggattattatctttgagaaggctatgatggttgactgcaaaggtctcgggggctactgtggagattatggatatcccatatctacacgacgatggtatttggactgaatacaggataccaaatatagatagaatatcttatttgtgtctcgggtttgtttctcaacttgtacatcaaggaaataccttgagacttagtcggttacgactgtattttatctgtatctgcatatttcgttagggatatagattatcttttgtaacacggactccttcccatatataaggggggtccgggtgcctctaggggtacacatgttgattttctccaaatcatacaatcaataagacactcggcggattcatccccggacaggagtagggtattacttcttgaataagaaggcctgaacctgtataaatcctttgtctccaaacccatacacttctccagcttgatagccaccccctttttattattgccgaaatctagtttcgacagaaatttttttataattcgtatttttattgttgttagatgataaaacatgattaatattttgtgcgtgacttctctttttaatttttttcattattgttttaaataagacggacagtcaaacattgggcacggaaaccagagtttgtctttttttgggacggagggagtatatataatggattgcctgcatgtgtgtactaaaattttgtaaggcctggtttagttcccaactttttcttcaaacttctaacttttccatcacatcaaaatcttcctgtatacacaaacttccaacttttctgtcacatcgttccaattacaaataaacttccaattttggtgtgaactaaacataccttaagatcaaatctagctttcatttgtgtgaccatatgtgtgtcatatgccggatgagagcaaattcttttgcgtgttgcactggcgagagcaggcagaattgtttgtgcacacgggatcaacaataactagcatcatatccacacctgctgcgggaggacggcagcgcctacttcggcatgctatcgctcggcgcttctgcaagcgcccacttcactctctctcctattttctttctcctccatgtaggagtatgctgatgtggagcttcttatcgccaacctaattagctctattatacttgctcttagcttaagaaatggtaatatttagtatctttcagaggcatgttaggttctctttctgtaattaattcgttattagtcgcgtgctccgcgaggagaaaacccaaccaacgggatgatgacagacagtaaggagtaaggatagaagataaatatgtagattaagcgttttaggtaaaataaggtggtattaatatattattacttgagttttaattattataaacttaaaaatagattaatttgatattttagagcaactttcatatagaaagtttttgcacggaacgtactgtttagcactttgaaaaagcgtgccacgagaatctaaaattttatccaatttttgttggagaaaataacggtgcgtatagtgccgatttcttattgtttgggtgataaaaaaatagaaaaacaaattttaaattgtgtactcgaattttttcttcttgctcagatttttacacccagtactaataggcaaacacaatgttagaagttccagataaaaatgtaaggatggagcctctacaattaatctataattttgcaaaaaaaaaaaaagaagagaaagtgttaaatttgtgatactatcatacaatggcttcaatctcttttttaccgggatgaccaaagaaaggacatccaatggcattaagagagagggaataaacggttacaagaaaatttttcatcgacagttggctatcgaggaagggtatacaccagagtgcacacccgaaaccatgcgaatggcctcaatctcaggtttcgtgataattttaccaatgtacctattgacgacttccaactctgaaaattggtagatacatgatgatatgccactaaaacagaattgttcttgcaggagagcatacaggatggtgttcagagtagtagcacccatcactcaaagctgagcatggaaggctgtggagacagaaccatcatccaccttgatgacagcattgttcttcaagaagtccgagtaccatctagcagagcgcctgggctgccttgtcagttcttcgctgccaaatcgacggcaacaatgccgaaatgcgccttgtaatcgccaaacatctcgtactgatccatgaatgaccacacgcagtatcccttcacgttggcgccattcctgcgatcgatcggtcagtcattcaaaccaataagatcccagagtgagatcttgtgatttttcagtagaaaactctt

SEQ ID NO: 43630 - DNA, 1997 bp, Oryza sativa
ttgtatttcagaactcttatttatttatttacttttgtaaaaagagatccttaaagttaacattggagactaattgagtgctacaagtaggactactgaccgttttcctggatataaaacagcaaatttccatacttttcctgaagatattcaagcgcgagctctagcccccgaggatctaatgaggtccctggtagaaactgcctcaagagtaacaagcaaaaccatgttacagtctgcagatgttatgaaaagttcaatatattcagttcagagacagtgttgtcgtttatcacctctcgagtaggtgtgctattcttgctggctgacaaaaaaaaaagcacacatgaataaaatgattgagcttcataaaattttaagaacgtatgaataatgaaaagcatatcagtatgaaatttcctaccccagaacaaagaagaaatatcgtcagtgacatcctgtagcggcgcctttactgcgttactattatcgctcacataatttgaggtataatgattcaacccaatgaagtcgaacgcattagtaaccagctcagattcgtagtcagagaataatggaagacgggaaccggcggccttcttcatggtctctgggtaatctccaaacaccaaaggatgcaagatcctgcaatttggttgcatttagttgtgtcaggattcagagtctactaggaacctatgttttcaaaagaaaaactcaaagcatggacagcagagttcgctgtagtggctggtataacaagcttacaaccaaagctaggaaccaactctctccgtcccataaaaaacccaattctaggtttaaatatggacaagtcccataaaaaacccaatcctaagtttgaatctgggggatcagggtttttatgggacggaagaagtatttgtttcactcttgctatagtaaatacttcagaaatatgatataacatgacataccatccatacatgaaatcctttactctttcagtggcagcaatatcttcagttgactctgtgagtgggtagaaccacatggagtatatgttcatgccgacaacgcccttctgtgcagcctgaaacaatgaaaccaaaaacagagaaataaaaatcatttttcttgcttaatggagcgatacgcagatctcctacatgttcgaaaaaaaaatcattttcttgacttcataagaataattaagaatatacagtatacagggccattcaagaaaatattcagaagaagaaaattgctaatgataatgcacactcacttggtgcttttccctgtaaagtctaacagctgaagcatgagctagcagggtgtggtgtatgaacaagtatggctcaaccgtggaatttcctagtgtgcagttgcttctgccaaacggatacgagcaacgatttggcgggagatacccatcgtcatagccagattgagccatgacatttggctcaatggaagttgtccaatgcgcgactctgtcaccgaactcgcggaagcacacatcagcgtatgctgcgaagtcatccctgcaacacatttgcaaggaaggtgaagcctgtgaggataaaagtttctaatggttattgtcattcaagataatcttatcagcatggagtgaaagggaaattactgcttaatgcttacacaactttggggctaacccatccaccgtactcatcttgaaggctctgtggaagatctatatggtacagaacagcatgaatctgaatacctattcatgaatcaggagcagaaagcctaatctcagactcaggggtcaccagtcatgcattattgttgttaagaagatatttggttagtaacaactaatgcgaagttaagagtgatgtgcattaatgaatacaattgtttttttttcagaatttggataggtcaaaatgataggataatcaagatatactaacctgcttttactagctcatttatcatactattgtaaaactgcaagccttttggattaaccgctcctctcc

SEQ ID NO: 43631 - DNA, 17095 bp, Oryza sativa
agaacaatgcaagatcatggctgattaatctgatatttgatggttttatctctaatccaaacatcataccttgtacttgtgatagccatcacatgccacatcacctgtttctcctcccggattcctccctgatgcagcagatcacaggtcaaattggcacagacaggtaaaaagaacaagaacaaccatatatttgaaaacacattttttccccgccaacttaaagtgcagaggttaaaagctaggccgttatagtttatcatgtacagctctctcaaacaaacttagcaataatgctccgttgtgctttgtgtgcctttgacatagcgactggtttatccattatctgaagagaaagatcaaacttatttgagctatcaaggaaaaaaaatgtgaatttccccactctcagatgaacccagtgaactccaaactagaatagcaaacaaccattactattgtgacattgtgtgcaaaaaaattggtctcctgttgcaacaagtaattaggaagcaattaggaatcaagccaatccaagttgagagggagagagggagtacagtacatgagtgagcgtaggtgtcccagatgcttggtgtcctcccatcctctgcagctgcaccctcatactgaaaaatccaaaaccaaaccatgcaaattcaattcatgccctgaattgaatctgcaggtaggagcagagcaaccagtagcaggaaaagatcaagctgacaaaaaaaaaaagagatttggagagaaagagacatccctctaaacattttcaaaaggaaattatgagcatttgggaattgaacacaggatctcggggttgaaaccacacagcccttagcactacaatatcaagtgcatcttaagatcaagctgacagaactcagaatacctggaaagccgcagtcccggctccaaacgtgaatccgtcagggaaatcgtctcgcgtgaactgcagcgacctcacgccttgaacaacaagaagcagcagcagcagaagccatggcgagaagaagaggagcagcggatgcagaggacgcctggtctccattgcgtcctctccagatgcacagccacacatcagcagcttcttcttcttctttctcctcttttcgcttgctatcgttccttcctctccaataattcactagcctcgatcgtgtcgttttggtcggtcaataggatgatccggcaaccaaaaagatgaattttgttttctattttactcgatcgaatgtttttgttctcagctgcatatgcgtctcgattcgtgtgggtgctgtaccaatcgtggcaagaagatgattgcatcgactaacaagaggccaacgtttaaagggagtacaacccagtatgaaccatccaatgttacaaaagcatttttgttgaattttgcgtggacagatcttgtcgatctcatcagtcgaattgcgagccacaggatactcgccaggagattcgtgctggcctggtcgttgtcctgtccttttttggcttcttatcagtgtgtctgcccgtctctggtactcgacttgctacgtaatcatcgtattcgtgaatactctctccatactcataacagaagtcgttttagaacaatgtttaagtcaaaccttgggaatataaattatgaataactcttaagttgttgagtttgaaaatataaaaattatatgtataaatttatcttgaaaaatactttcataaaagtatacatatatcatttttcaataaatatttttatagaaataagaagtcaaaattatgttttggagaccgtgtcgctgtcctaaacgatttgtatggagggagtatgccttttcatttttcaatccattttcgtccatacacctatttgatcggaatcatcggatgcccggtagcgatttttctagacacagttccataaatatactttcttcatgctaaaatataaagctcccatcggttcgcttttttaatcaaaaatgacacagcttattaacaatcaaaaaataatttggataaaacttttatatacacattcatagcgatttaaaagaaaaggtcgtaaaataaactacaatgaaaaaccacaaaatcaacttcaaaattaagtttcaaaattcaaattttagtttaaaaacggtggaagaagcgaaacaatgggagcctaagacaaccaccctaaacacaaagacgaaaagaatttaatcacctcgtctcattggttagatcacctagatacatgcaagtggtggggtttgatgatagaggacttacatgtgctagttaatgtatgtatgcatgcactcctttatattatgaaatatgatgaaaagataattatgccttacatttcaagatatgagtacattgtaattggaaaataaatctgcatcacctttatatctcacggggtaaaataatgttcaaaaataatttattgaaagcccgtcgcaagttacaacagaaaactttactatagcacaaacaatattgtgtctcatcgttatagttttcacatatcagcaataggaacatcgaaatatttgtggaataaaacggaacatggtttttccgggattgcctgcctcgtctagtgcgcatggccggcattatattgcaacaaccatgcagcatacaggcctccactcggcacggtctacgccagggtcgcgtcgcctcacctcgccaaaatgataatccttgagttggaaaaataacagaacattggagccacggaagcaacaaatttcaaacttgacatgtataatgcatttaatgttatacagacaaaataattcaggtaaatctaatcagtcaaattgacattccaatcgaactacaccgagattacaagtgcctaactaaatcaaatcacacattaattattcaaaacaagaccagattcccaactcatcgtactcttgtaactaaatattttcgaaactcaaggatgaaataaaaaaaaaatgaagccgcagccttaaaaatatgtacggtcccaacaaagaaaatcggcattctttgtacaggatacaataattaatgtgcaataagatcatatctacaataaactgacacattctggctcacgagaaaagcttattggctaaaatttgacacgagcattcggtttatacaaaatcctgactgtaaaactccataaatgaatgctgaagaaatattaaacaaatcagagcttacaagcaaatactggagaagtacctatcaagatacacatcacacttgaaggcaaaacaaaatggcaaggaaatgcagtaaaacctgaagggtaaataaagtcctagcatgctaatagtgctaaatttaaagcaatcccaagtttccagctagaaagaaactcgcctttcaaaattttgcgtaaacaacaagagaagtagagcagaaagtggctagagttcgagtgaaacaggccaaatatttgaaactgcagattctttggtccaaatctctgagagggagagggagagagaaatcgagagggcaagaagatatcaagaaccaaacaagcaaacatatgacaactatatgctatgttgattgaacattatacgcaaggcaaaagaagcagaaattcacaaacccagctaatatataaacagcacagttgaaatgaaaagtaagcttgttttctacttcacttcatcttctatatttctatggtgaatccagtcatgcagataaggaagagaacatatgcacatgcctttccatactgaaataaactgtacagttgaaatgaaaagtaagcttcttttctatttctacagtaaaatttagccatgacagatcatgaagagaacatatgaataggccatttgcccatttcataccgaaatttggatcgaatctggaagcagcaattcacaaggctgtacagcaaatcaccgttgtaacaaatccaatcttaactaacttccaacagtgcaaatacttacagaggagaatagataagcaatgccttgtactggaattgccaaacaataattgcaggcaagtgtaaacttcttaataattatggcatttcagctacagtagagaatattcagggaatatttaaatacaggcactggctatgatgaaaagcaaaacctggtgtttcctgtgatttcccatttgtagtttcacttacactgaaaaactaagagggatgtctgcaaacgtgaagaaaacaaagtagttgcatttccatcagtaattcagaaaggaaatggcaatattttaaagtaacaaaatcagaacttagatgttacccaatatgtgcacaattcagatgttatctgaatccatattctaaggctgtgttcggtagtaagggatgggaactaatctctcccgcacataaaaacggagcggtccattagcacgtaattaattaagtattagctttttttttcgaaaaatggatcaatatgatttttttaagtaactttcgtatagaaattttttttcaaaaaatacaccgtttaacagtttgaaaagcgtgcgcgcggaaaaagaggggagtgggttcccaactccttttgccgaacacagcctaaatgtttctctgtttcataaatgcatccacaattacccccaaaaaatcactaaaatttccattgaaaagcataagaggcaaaggatttcaagcataagtaatacattttcatcagtacatatattcactcaatcctgaaacatattaagagcaatggaattcagttacaacataagagcagaggcattcaggcacagatcatcactaaacctgaagcataaagaaatagttgcattttcatctgtacatagtatgatatcaactgctgattctgactatccatggtcagtactcagaaataaatggaaggacgcagcatgtatttgcttgtattagtttcaggggtgcggtttttgtgtgtgtggaacagttacaaaaaggttggcaagattcagtaagaattccacatgtaagagtaagaaagtcattaatgacaaaaggaaatgtatctttttgcataccgttgaagtttactggagcagtgagtaaatagagagcataactaatccaagcaacaaaaaaagaatcccacacgtgagaaatacatacaagcataccagcatggcctttctttcaggaaaatagagagaggaaaaaggtcaaagttgacaagcacaaaatattctagcaatatgattactgagttgaccaattggtgactaaaccatcacaaacgtataatcagtgttaacatagttgaatgactaactcaatatttttccctggtccaaaagatttcatttccgaaaaatagtcccaaaccaaatgctattgaactagctgatgcttgaggaacctgcatttcaaacatatagcagtagttagccatgttatgccccagcaaaactcagcaagatttaatatgctctagtagtagaagagtttgagacatttcgatggccaaataagctgtaacaagtgtaaaggagcaaaactgatgcaacatgaagtggctctacagtagtatgaactccataaatgactactccctccgtcccaaaatatagcaacctattggattagacacaacctagtaggtctaatccagtactaggttcctatattttgggacggagggagtatgcaattaggatcaccaaacaaatgaacagaagcaactcaaaacttattagaagcatacatgcttgtcttgaagcatcacacaagactttaaccatcttagttgttatattgaccacatgtgacagtaataaattgagcttcttttaaaggctatatattcttacttctttacttttcagttgagtatgaacagagcaaagccaatgattaataaatatgctgaactgacactattaaaatatgatgtgtgtgcaactgagttcacctgagttgctcttattgagtatgcatcatggagatatccttcatcttacacgtgcataagcatgaggcaccacttgctgatttacatcttcttgatcttcagacaatccatagcctctttggttccaggcagcaccatgtgagggttggcttggggaagccccatattcaggcggtgccccttgatttccaaaccctacttgtcctcgacgagcgttaaaactgttctgaccttgcagagcatgatttccaggagcctgagcatcaaatccctgctgtcgaggctgtgtgtgaaatcttggctcaccctggggagacccaaaacgattatgctgatctactgcttgaccatactctggtctgttctgatagtgaaaaccaggtaatggtggtggtgcttgaggagcaccaaactgtgcctgcggtggctgagtggagccaacagcatgctgcgatgactgaggtccaccataactaggctgttgcacttgtggagcattgaaccctgtatgccatggatgagatgtgccatacccaggctgctgagtctgaggagcactatgcattggttgtggtggttgagggtgaccaaaaccaggctgcatcggtggacccgagctataatcagtttgttgcacttgaccaatgccaactgattgttgccatggacgaggagaacccatcccatggtgtgttccttgagttgcatgaactccagaatgctgccatgtattgggagtactgacatttggaggttgagtcatggagacaaccccaggttgtcgtggatcaggggcgctaggtccatgctgcaacgggcggccaccaaactctgatttatcaacttgagggcctccaaacacaggttgctgaggtctcaaaggcatcccctgaggctgtatcgcttgggatccaccaacgccaggatgaagtggttgagaaccatatgtcggttggccttggtgaggcatgtagctaccccgtgtctgattggatgcaaatcctggcagcccctgaggtgaattgcgagggcgatactctggccttggctgaggaggcaatggcactggtttctcttcaaaagctttctcaatctcttcctgccggccagcgttcttaaaaatgtcaataacagaatcccggaactcaggaggaggagtgacaccgccttttgccatgtcactcaccaactcccgtgctttatccaagtccccttccttacacaatgcattaaccagggtctcaaaggtggttgtgtttggcttgatctccttgtcaggcatccttccatataccttcaaggcatcatccatccggccagcttctgtaagcccttcaaacatccgattgaagaaaccaatattgaacttcgggccatgctcccttccgtctgccatcttatagaaatactgaattgtatcatccacgcggcccaccttgaagcatgaatcaaccaggtaagtgtaggtgtacacgtctggaagcaccgacttggtttccatttcctcaaaaagcttctctgcctcttcaagcattccattctcacaaagcttcccgatgatgttgttgaagcagccaacgtccatctggacgttcttcctgggctgccggtggaacacctcaattgcctcatggaatttgcacttcttgaagcactgattgaccatgacattgtaggactcgctgttgatgccaatgaagctcggcggggtgtggttgtcgatcatggtctcccagaggtcattcgcctccttgtccttatcatgcttgaagagcgtctcaagcagcacattgcaggtggcgggggtcatcctgaacttcttgtccaatagcgactggtaattctccatggcctccttgtccattcctttcttccagtacccctccatgaaggaggtgtgcacgacaccatcgtagaccaagcacctcccctggagctcctcaaagagctcgaatgccttgtcccagttatcttcctcgatgtaaccggcgatgagattattgtacacgagggagtcggcgccctggccgcggttgagcatctcgcgcaagagatcgagggcgtcctggatgcggccggcggcgacgaggcccttggtgaggtggcggtaggtgacggcggagggcgagaagggggccttgtcgagcatctcgcggtacacctgcagcgcggagtcgacgcgggcggcctcgcagtgggcgaggatgagggtgttgtccgagacgacgttggggacgatgttggatcggctgaagaagaagtcgaagagggagacggcgtcgtcgtggcgccccgcgcggaccatggacgccgccacggcgttgcaggtgaagacggtggggcggacgcgggaggtgaccgcggcgcgtgcagcgacggaggcgccgtcgaggtcgccggatcggatgagggactggacgcggttatggaggctgaggcgcgggccgacgagcgcggaggtggtgtccgggaggcgcggtgcgttggggtcgcgcggcgggggcggggcggaagggtcgcggcggagcgcgtggagcggcggctcgatgcggagcctccgcttgcgcctccgccgctcggccgcggcctcctcggcggaggagaaggcgaagccacgggcgtggggtgcgagcggcgcgtggggagggaggaggtggtgcgtggcggaagcggcggcggcgggggaggcggtggaggaggaggaggaggagagggaggggtgcgggtggagggtggagaggcggcggaggaggaggagacgacggtagagcgccatggcgtcgcggtggggggcggcgacggcgggagacgaagtttgtggcggtggtgagggaggcggcggcgatcttcaacaagaggaagaaaaagaaaaaaccctcttattctgtagctagggtttagtgggtgttactgtatgaatgtatgatccattttccatctcccggtgtgagcctcctctatatcggccagcaacgattcgttgggccgtcaagttgggccagtgctacagtttcctactccctctgtacaaaacaaaaacaaaaaaaggaaaacgtacacccaaggtccctcaacttgtcattgtgttacaaaatcatcccccaaccgcaaaaccagataccggacgtcctcaactaacaaaaccagatccttcggtggtttttgaccccggttttatcctagtggcggctgaggcagcgtgagccccatatgttagtgtgaacacatcatcctcctctctcttttcctctcttctctcccctcctcatctctctctccattctcttgtacgccggccgagcaaggcaggagaggcgtcaggcgtctgcagccggcgatgggcgacacgacagcgatgatggcggtgacaggcgacgcggcagcagtgggaggagccgttgcgggagggcggcgagggaggggcggtgtgctggcggcgggggaaggagcggcacgcgggctcccccaccggccgccgcccatgaggcccacaacgcggcggctggggaaggagctgcgggcgggcggcgggggaggagcggcgggcggccgacggaggagcagcgcgcgggcggcgggaaaggaggaaggcgcgccaaccacacgccgacaccaacgaccaccatgcccgccgccacctccatcgcctccaccactaccgcctactggctcgcgcgagcacccggcaatcgtctccttccggtggagcctcacggggctgtggttctccacctgggccttcctcctcggcttcctcgcctccaacatcgcgctcttcctcaccctcctgcgcgtcgccggaggccgctcccactagggcccatgcccgcggcacacgcgctcctgatggccaccgtctcctccgtcatcttcgctggcatgctgctctctacgctcaccgagatacgtgacacacggtggtcgtggcgcggctggagccgcaccacgccgttccgctggctcctctgcttcccgccggggacacgctcctccggctacatcttcttctagtcctacgcacactacctctcccgctaactccacgccgcacgggggatcttcatcgtgctgcggcgccgctgtggcggcgccgcgagggtgttcgcgcatgcggcctccgtcgccatggccttcctctggcgacggcggagacggagacggccgctccccatccgcagccgcgctcagttgccgccgctgccaccgcctctccgccaccgcgcgacgggggcggcgacaggaggagcgggcgtcgtggcaagcgagcgcgcgggaagaagctgggcggcggctgcgccggccccgtgctcagcacaacatcctcctcgtcgccatcctccgtgctcatccgcgcatcggcctcgcgtgtgcaacaccgaggactatgggcgccaccgcgcccgggcaacttcatcgcgggcgtggacgcagctagttgtagccggggaagagccacctagtgtcgaagcagcgacaccgacatcctcccttctcctccgtcgccgcccccgttgcctccgccgacggctgcggccaccagtgcgacgccgccctcctttcccgcctcgccccagcgacctcctccccaccttccagccaccctgcagagaggagaaaagtgagatagagatagaggaggaagagagaaaagaggggagggagatgagctggcattctgaattacgaaagactaggcaaaaactacaattacaacggcactccaactaacctaagctaccatgatgacgaaacacaggatagccaagcccaaaactcagcaaacgccgttcatatgaacaagtaaaaggttgaaagaaaacaagacccccacacattggcaaagacgtgacgttatcgatatcacaccacaagaccgggctactccgacttcgccaagaaacactagggcaacgacggcaacctagcctgcgtcaaagcacaactcaacaaggctcatgtcatcgttggtatacatcatgcattcatgcttgctgacaccgtagctctgacttcattagcatcagtctcgttcatacatggtcgagccagactgacatgcctcgctgataaaaaaggcttgctactccactctagagtgaaacgcggctgatgatgtccaactcgggtcatcgttaccaagctcacaaacacgcagcaactttgactttccaagaaaacaatagtaaaaatctgcctagaaccaaaaatagcttcgactcaccgtggccaccttcgggttcgccgcatcgagctgcaccctggttgcccctccactgtcgccaaccaccaccggaaccccatcctcttcgcgtgaggtgagcaccacccatggtgagcaattaaagagagggctaacagggtggtaaaaattacatttattaccgataaaagtttgtcgagatttcttcaagaaaaaagagatataacgaacaatcaattaaaaatagaaaatgtcttactttaattttaatttgtttcgttagaactattttcgaaacaaactattttctagttgtttttattgtctataaaatgacatgatagtactatagtaggtatttcgtggacagagatagcaagtacaagacacttagctcgtactgccgctaattaacatgccatttaagtcattattagtagtgaaacggtaattaacccatgaacactccatagaaaagccccgcaaaaaagaaaaaaaaatactccttagaaaaaggtgtagaggtgacgggctttcctaccaaaacttagccctacggccctaccaatgttttggtagttaaaatagtacttgtgcttggtttggatcgaaaccaatttattgataatacccatgctagatttgatatcaatttatgttagctttatatagcaaatcaaatataatcttaccctataaaaaaagttgatagtgccaaaatttacatactcaagttttggcactgttaaagaatctatctattatattatattattaaaggaatagaaaaatgagcctccacgttcgctctcatggcctagaaattctcacattaatcggagaaaaagaaaaagcagagtccatatagaaatacaatttagaaatagctgaaattcggaattaaaaaataaggaatattagaagaggagactagagtccatatagaaatacaatttagaaatagttgaaatttgtaatttaaaaataaggaatattagaagaggagactagagtccatatagaaatacagttaggaaataactgaaattcggaattaaaaataaggaatattagaagtagagtatagagcccatatagaaatacaattaggaaaataacagaaattcggaattaaaaataagaaatattagaaatagagtatagagtccatatagaaatacaattaagaaaaaaaaatagaaattcggaattaaaaaataaggaatattaaaagtagagtatagagtccatataggaatttaaaactaactaaaattcgaaataaacataataaaataagaattagagttttgagtccatataaaaatacaatttacaaataactaaaattcgaaattaagaaaaacatggaaagaagagtttaaagtcaatataggaatacaatttagaagtaactgaaattaaaaattaaaaattaaagaatattgagaattgagagatgagtttagagtccacatagaaatacaattagaaataataaaaattcagaaataaaaataaataatattggaagaagagcctagagtctatatagaaatacaatttacagaaaattcggaataaaaaaaaagcaaaattaaaccatataggaatatatataatttacaaataactaaattttaatattaaaaataattaataactaacgcgtatataaaatagaatatgaatattacgtttcgttaagttattgcaaaatttaaaattatgatgttattctaatatatttgaataatataaggagaaaacataagaaaatatagactgcgcgggccaacatgctatttggtcgactgtcagcattttgcccttgacgctcatgcatcccagccgtccacgtcccggaggaataacacaccctccagccttctcctcctcaatccaccgacgccgccgccgccgccggctacttctccggctactccccatcgcatgttccgatagtccaagagcggcggcaacgacggctggcttctccagcgaatccattcagctccggctggcctcgacctgaccctgcccccggcggcatcctcgaccggatccgtctagcggcgacctccgcaatggcggcggcggctcgctgccccggtgaccatcgcgggggtgggcttctcccacgacgacggcggccgcggcagcagcagcacacagcgagcagccggagccgggcaacctgccgccattgtcaaggccgacaggtaataaacaggtatgcgcagcctggttacagtattttacgcccttctgaattttgctgcgaaagtaactgagattatcgatgatatgaacatgtacatcactagagaatattgcgggtcccgtgattagcgacattgctgtgtgcaacgtttgttccttttaggtattattacgttcctttcatgtatctttggacgctgtcgattagtccagtgactcctatcccaattcctcttgccacacaccacttatccgctgcagcaacctcgcaatcccctcggcgctcgctggttccagccaagctgcttccgtcctccttcacttcatctgtgcaacagggtaaagcttccagatcttgctttgctgtttttttttattagttcatatccatcttattctactacaaaaatacttgatctgtctccggtgccgttcactgatttcgttttttctttgttgttgtttctcgatgattttaggttattcatccggccctggtggttttgccgtctgcaaacacctgtcttccattcgcatttcagaagaaaaagaaacacacacacaaaaaaactactcgtcagagttttcttcctaatttcccatccaaaaccagtagttttcattgaaaacaaaatcatttgttgttgtactgtccccgtattttgttcgtagcaattcccatccaaaaaacaaaatcatcctagctttttactttcaccttgttcccatcggtccttgtttagatcttcctagtctaagtttaccaacatttctccatcttcacatccaatatctctgtacctaccaaaattacaaagagagagaacagggagacagcaaattcaatccgatggcggaagtggcattggctagcttacgattggcagcatcaccgatcctgaacaagctcctcgctgacgcttcaacataccttggagtggacatggcgagtgagctccgtgaactggagaccagcatcatgccgcagttcgagctgttgattgaagaagctgagaagggcaaccacagggccaagctggacaaatggatacgggagctcaaagaagccttgtacaatgccgaggacctgctggatgagcatgagtacgacatcctcaagcgcaaggtgaagaacggaggcgaggatccttctccagatctagagcatgcctcctccatcggttccatcattaagaaacctatgcgcgcagcatcaagcagcttgtccaatctgcgaccgaagaacataaagcttgtacgccagctgaaggagctcaaggccatcctagcgaaagcaagggacttccgtgaaatgcttggcttaccggctggtagcagtgtagagggggcacaaactggacatacaaaaacagtggtcgttactgcagcgacatcaaccccaccaccaaaggtgtttggtcgcgacgcggaccgcgatcgcattgttgatcttcttacccaacacaagacttgtgctgaggctagccgtttcgttgtctccattgttggacctggaggcatggggaaatccaccttggctcagtatgtttacaatgacaagacgatacaagaacattttgacgtcacgatgtgggtttgcatctcacgcaaacttgatgtccatcgtcatacaagggagatcatcgagtctgcaacaaaagagaagtgtcaaagggttggtaatatggacgttctccagtacaaactaaaagaaatactgcagaaaaaagagaaagtcctgcttgtgttggacgacatttggttcgataaatcccaggacgttgaggaatgggacctgctacttgctcccatactatcttctcagaatggggcaaccaaagttctggtaacttctcgatctaagacacttccacctgctcttttctctgaagatgtcattgatttggaaaatatgaaagatactgagttccaggcactcttcaaacaccatgctttctctggagccacaattcgagacctccagatgtgtggctggttcgaagagcatgcagtgaagattactgaaaggcttggaagatctcctttggcagcaaaagttgtaggttccaacttgaaaagggtgatgaatatcgatgattggaaaggtgctctcactataaagatagacaatttaagtgaacctaagagagctctgttgtggagttatcagaaattagatccatgtcttcagagatgctttctgtattgcagtttatttccaaaaggttacaaatacataattgacgagttggttcacctttgggttgcagagggatttattgatgcacgtgatacgaataaaagaatggaagataccggcatggattacttcaaagagatggtctctggatcctttttccaaccattttctgaaagatttgatagtacggtgtacattatgcatgacctccttcatgatttggcagagtcactctctagagaagactgcttcagattagaagatgacaaggtgagagaaataccatgcactgttcggcatttatctgttcgtgttgagagtattatacaacataagccaagtgtctgcaagctacaacatttgcgaactcttatctgcattgacccactagtggatgttgggagcaatattttcgagcaggtagtattgaatctgaagaagttacaagtactttatttgtcgttttacaacactagaaagttgccagaatcatcggtcagctaaagcatcttcggtatttgaacatcaagaagacattgatttctgaactaccaaaatcattatgcgatctttaccatttagagttactttatttgcgtccgaaatcgaggttacctgacaaactctgcaatttatgtaagttacgacatcttcaaatgtactctgatggattggagctgtcacggattcctgacataggccggctaactttgcttcaacgtattgatagttttcacgtcctaaaacagaagggacatgagttgcgacagctcaggaacatcaacgaaattggtgggtatttatcgctcagaaatcttgagaatgtgattggcaaggatgaagctttagagtcgaagctgtatcagaaaagtcgtcttgaaggattgacgcttgagtggaatgatgcgaataacatgaatccagagaattgtttacatgttgagattcttgaagccctcgtgccaccaccacagttggagcacttatcaattagaggttacaaatcgactacctatccaagctggttactcgagggttcccagcttgagaatctagaatcctttgctctttataactgcagcgctttagaaaggctaccatccaataccaagctctttaggcgttgccgtgaattgagccttaagaatctcccgaatatgaaggaactatcatttcttccagcaggtctcacaacgttgtcaattcgtaggtgcccactgcttctcttcgttaccaatgatgaactggagtatcatgatcatagtgagcatatccactaggacagagcaactggttgcacaatttgctttggttggggtgatgggcccatttttagatgcactgtcatcggatcattcatctatgaagcagttggcagcattgatggactctgatatatcaaaaaatcttcaaaccattgaacgcgctctagaaagagaagatgaagtagtgatgaccaaggatgtcatcaaggcatggatgcgttgccacgagcagaggatgagctcatttatgcaaggaggattgggctaccattggtcccaccgtcaggacttagtgatctctccctta

SEQ ID NO: 43632 - DNA, 5993 bp, Oryza sativa
ctgcgagcctgctacttccctttcgcatttaaggttgaactcttgccctgctttagagttggcacacggtgcagaattcatgccagcgtcccttaagagactcgcaataagttgttgtgtgcttgcacccgacttgttctgtggccactggccgcatctgaaagatattttcatacacgactgcagaagctctgtgtcgttgtttgttggtgatcttagctccctgaaagaattcacactttatcatttgccagatttatgtgtgcttgaaggcctgtcttcccttcaacttcacagcgtgtgtttggtagatatcccgaagcttactgctgagtgtgtgtcaaagtttcgtgtccaggatttactgcatgttagcagctctgcggtgttgaacaacatcatctcggctgaaggtatcacagttcagcgtctctcatccttcaaaggtgcaaggagccatccgtttcatttgaagaaactataaattcctcatctgtcaagcagctgcgattagaaagttgtcaaatgagttccctgcagggaaatctgaagtgcctctccagactggaggaacttgacatcttcagttgccccaatatatcatgtttgccagatctcccatcctcccttcagcgcatatccatagtggactgccccaatatatcatctttgccagatctcccatcctccctgcagcacatatacatacgtgactgtccactactgaaggagagctgtagagtacccgatggggaaagctggccaaagattgcgcatattcgttggaagcgtattgactgaattatgcttcagattcacaagaacaaaggaacagaaaggtaacggtttcatcaatgcattatgaaaatataaatttatgcaagatcattccatccattattgttcgtctaaatacttctttcggttaccagttaaatcgctctcttgtcctctggcagtgctgttccttcgccccctgcattgcagacctccagagtctcacacagctgtttggctatgaacgagagggaccggttcgtattgactgatcggtctgagcttcttcttcttattcttgtgtggttgcatttcgctggctgctggctatggtctatatgcctatggactattaccgagatgtatctgtgtatttggatcttgctctgttatgtttcctgtttgttcttttggactgaattgcttgtagtagctgttatctatggtgtgcaacgtctactgtattactgcaccggtgaagctttgtatgggagtaccatggtgcttttgaactcaggctactgttatcctctcttggagtgtttccttttggacttggtttctattgagtattgactgtaagcctgtaactattatctcttgtatgatgagatgcaagataaggcaaacctgcaatagctctagtcaacttggccttgcattgctgatgacctgatggaaatcgttttattttacccattcgttctaaactgtatattgtagtcacgggtttcctgtatatttgaggccaatttttctagactagctgaagaccaattaagtctcttttatcctcatgtagctttgagatcttgaaaggatggaaaatatgtagtgcaaaccacatatgtggtgtaaatctagaatataccgtcggatctaaaaatggacgtacgagatttggtcatgtcaccaaaggtaaaaattttattcctagattaaccataagtaaaactttaaatggaagtaaaatttttactcttgacatgaactcggacatctatttttttattcaacggtagtttttccagggttccatcacatatgtttgcaatacatttattttccaagagtggcaattatatgtttgcaatacatttattttccaatagtggcaattatgatgaaagggaaaggagtaacgggttattactgctgtcacgtaagtaccattttatttgtttgttttgatgcgctcgtcactctactgcaagatatgaggaagagaagagacgtgatcctattctaactggtggagcttcagcgattaaacatgaaatcgaagtctgtcactgtctctgtttagtgaatgtctccttcaatttggcaagtctcaagtggtttaccagtaatttggcaatttcaccggctgttgctgggaagagtttttcccatggcaaaaagcattatcactgactgccgagttaggcttgctgttgccaagttgttggggttagcttaagcaaattcatgtattttattcaccggattagtaagtgattaacaataagggtttggttttcaacaaatccagctcagctaaaccttaagtaaatgtcattaagtacttagaagttgttcttcattactagtatctggacagtaataagtacttaatgatgaccatctaagcatactaaggttagtatctggacagtaatgaagaacaacttaatttagcagtaagttcttcattgcttagtattcctatacttaaccattatcagtgcataagtactccactaaaccatttagtacttatgcttagattttattgtacattatccagtggtgtggacaaccagattaggcagtggtttagatttggaactcaattatcctctggagtccctactttctacagcatttccctgtttgcgcactttcatggatgatcctgcttctccaacatcttctgattttgattgttgttcaaaaggatgattcaatggctgccccctcaggtattgtttggataatgggatagggaaatgatttcccacctattaaaaggtatctttaaatcctaacaatttattcttccatttaatcctaacccttcattcatttcccaatcccaatcccaccctccatttcccattatccaaacacacccttatggtttcgaccctggatgtcacctaggattttcgacgaaaaataagagagtttagagacgagacgtttgttggtcactcataattagcaattgagtgccaatgagttgcttcaaacgatatatcaaacgtaggattggatgcaaaagtgaatgcaaaattaacgggaacataggcatcgtatcacacacgagtcagggcactgtcaatcgggaaaagcccctaatgaatcaacttgtacaaattttctcaggaacagaactaaaatgaatcaagaattctataccgaaattaaaaaaaataaacaacggaactacaagttagataaaatactagagcaccaggtatgtcctgggtattgtagtacaagacaaacgcatccagacatccagttctgccaaaatgcatcccagaaaaagcacctcaactctagaaccaactttatttcttttcagcatcataccccccccccccccccacacacacacacacaacaacaacaacaaaacaaaaaaaccactaagaaaagcatcatctaaaaacatgttattttcagaaagagcagagtatatgattttagtaaaaacaatcctactagctatcaactttttagaatgatgtaatctaaaatgttgctgctatgtctacaagtctggcagcaaataaaccaaaaaaaaaaaacatgttgactcataaggcaactattgctgctatctgtaacctccaataagaaataaagggttcttgatccctgagcgagacatgccacttcacatttcaccttcctattgctatgattacttacataacaaactatataacatctggctcaatgtagctacatattcggacagcacgacaaaaatccactggttaagtagcaaccagataccaggacggctggaaaccaatagcttcaataagttttgggttttcgaactcgtgtactcctccggggatccacagccaccaaaacagtcttttcattcttcatattgccgggatctttctcagttttaattttcttcgcaagcacaggaagcccatgtttcttatttggtttctgtccacgcttgtctccagagatgatttgcttggcaactggagctgtttcttgaacttgttcatagtccactatgtctgcacttgctttttgtactttggaaggaggcataaccagctctgaatgctcctctggcttgaccttctcaaatagctgataaccttctttggctgcttgattatctatgaggacatcatcagcgctctgcaaagataaccaaaccatcaaatgaaaaggtttttgcaaatatgttgatccagcacgagtccctatttcttacaacagtttagggagtacactatttagctttgataaataattcagtataaaaataggaatcattatgattacgaggcaatgtcagatctatgaaagatcagcaaatcattacaaatgatggtatcaagcacatgtatatcgcatatcacactatcgccttgtgactgtatatcgcaaagcaggaaacaccatgacgttacacagatctactgcatattcaagaaaacaccatcatgctcagcttgtttttcaccatatacttcgacataaaatatttatagttgacttctagaagattatgaaggactagaggtcccacacccacacacatgcaactagaaatcctaacatgacatgacggagatctacatggtttattggatgggcaaagagttggtatatcctatgttcctttttattaggaaccagctactggtcaaagtgttcttcatacattagttctaaaatatcgtgtgacaaaatagagaagaataagatgctatagctaaacttacttctttgtataactcccctacatgggcattggttaggaaattatctttaccacagaacatctcaattgtgattccatttagatctgattgtactgcatcttcttgtgcatcatttttcttcatacattccaacacacagtcagtggacctaccaaatacaggtggaaccacagcaagtgatctatctaagtcatccttctgaagcaaagtatgcatacactttgttttctgatgagaacgtcttccatccttcttacaacaggtcatctgattctgaatcttttgaggcaccttaacctgtttacggtctaagcattgtgacaacttcttgtatttgctgcgagcattgctgaggcgaccctgaagactaagaattcgggactggacatcatcaactgtaagaagaatctctcttaaagaatattgttcaaataccctgtcattctcaactaacgcatcatcagtgctttcgatgtcctcaacaactgcgtgaagagcgacaaatagagaggattagcaactattaagaggaacaattccacattaaaatatataaaagagttcaaaaatacacatttcctgcctttcagcttcattaatataacatcgtgcacaatcaatccccaaaagatagaaaagtaccataaaagataaactaaaagagataaacaaactaaatgtgacagaaactcagtctgatatcaagttcgatggctgctccgatagatactgtatacagaaacaattttacccaaccaatttttgcaggtatgcagcttgcacgcaagcctgcaactctagcatcccgaggaacaggctaaacgtgtgctttagaaaaactgaaattttaacagtacaggcatactgaattcagaccccaaaacaatgcacagtgcgataatctgaccactgacaaaaaaaaaggggcaaaagcacgtacgttaatgctctaacaaccacttgcatttcagattgaagagtgactgcaacaaaaattatattttctccttctaaactacagaaaataatcttgagcacacaggcacaaccatgtaacttacctgaactgtcaaaaccaccattaaccaagggaccatccgtttgaactccactgtttttgttttctgcaaaagatcaagagtcttcgttacagtcaagtataaacacgaaccccatgcaaaatatgatactcattcaagacaacaattttctctaccctataaaacaaggacaggatgtcga

SEQ ID NO: 43633 - DNA, 8990 bp, Oryza sativa
  unsure (1)..(8990): unsure at all n locations
ctgttctacatagacttcttcaccaaaatgacaaccatactgagcagtataatgctcaaccaactatgctttttttttttttgcctctaaactaggctatcttagcagtggtttcaggcttccagccaagaaaatttcacccagaacagactagctaagtagaaattaaccatattttgcatcacaattgggcataatagagcagctttctggaaccatttccacatcaaagataactatacctctacacttagcaagaaagaacgagtaggagcaggaggtactaactggaagcagcgcggaggcagaggaggtggagcacttgcgagccgaaggtgaacgtagtcgtctcgtagcttccctcccagatcgacgaaccccagcaacaaatcgggacaaagcttcagcacacaagcaagccgatgcagctcgaccaaacaaaaatcagcagagagcgaaccagcgaagcacacctgcggtcgacgaagaacgacgggtccagacagacgacgtcgtcttcttcctcctcctcccttcccttcttcccttcctctcgccgctcgctcgcgctgccggagtccgccatcgccgccggtgactgcaactgaagtggacgtggcggcggcggcggcgagtcggcgacccaaaccctttattcgctcgtgggctatacaaaggccagagtcatgggctcataatcaagttgggcccaaactcgattacacaagggccaactaagtaataggcattaaatgacgattttgctatatagtgatttcctatatttgtcgcaattttttttctaaacaattcacacatgtaaatatattataatcatagtgtaattatattatataaaaattatatgtaacttttatataattataaaatcgttaaatttgtttcaaggtttatacaagcaagcaaggaagaaatgacagtgcgcgtataggtgagggtattccgccacaacttacaagacatacacgcttcatggaaatagtatgctactacgtatcacttatcacaggatctttgaaaagttacatacaatttgtattataattatatacatacaatttacaaataattacattgtattatatttacatatatcaatttttttctaaaaaagttttatgacaaaatgtattagctggtcccttaaatgaaatgggccgtggaggtgggccggtccagtaggagtggaacgttctagagggccctggagaggggcaagcccgtaaattcgccgccgcgtcgcctccaccttaaaaccctaaaccccacgagcgcggcggaggcgatcgaagagtgtagaacttttgctcggtcttttttgcttgcttcgcaagaagaagaagaagagggcggcggcgatggcgaggcggctgatcccgtcgctgaaccgcgtgctggtggagaagctggtgcagcccaagaagagcgccggcggcatcctcctccctgagacgtccaagcaggtttcccccacgctgttcttccccccctcgatctctcgtggtgctactgctgcttctccttgctgcttcgagttggctgcgagtgtgatgcgatccggtgaggggaggggagtgtttagatcttgttccatgcgcgcgcgcgtgggggttaagttgggagcgtggtgttcttgcttagaatgtttgatttcgattgcctcgtttagggtgctgatggctagggaacaatttgttgaaattacttgttcgaatgatgcatgattgtgcttagcggggtcagattgcgtttttgtaggccgcaaactgttaatacattttgcaattgtagtaacagaaatttggttatgcctatgtcattagtctctcgtaaagaattgattttttctattatttgcgcttttggattatataatcatgctggattgctagttacactgttactgttttattacactagttgcatcaccttgctaatgttgattgtttaactctgaatgttccgctgaatccagctcaactctggtaaagtggtggctgttggccctggcgaacgtgacaaggatggcaagctgatccctgttgctctcaaggaaggagacactgttctcctgcctgaatatggtggactcgaagtcaagcttgctgctgaaaaagagtatgtgaactatctctccattgcttcacttgttagtgagaatgtacctttcggcatattgctagggcaatgtaattaccactcgttgcatactatcatagatgatagatcttgtagtgctctcatagtacaataatgtgtatgagccccatcggttggcctaataagccaaagcaaaagcatatatttgaattttcaaacttgaatttgaagttgattttaagatattttcaacgtaatttctttttagcattggtttttaagttgctaggaacaaatatataaaagttttacctataaattaacttttattccctaataagggaatatgggcaaccaatgaggctctcatgacctctatcggcagcatgctatagcaccgttgtttatggctaccatgtacgaagtagtaattactctctccgtttcacaatataagtcattttagcatttcccatattcatattgatgttaatgaatctagacatatatctatctagattcattaacatcaatgtgggaaatgctagaagacttacattgtgaaacagagaaagtacttgtgagtgctacagttaggaattgatcgaatacttggtggtggtgttgctgaagaaccgggaaccacacgtgcttcctcgtttaggctgctttcttctggtagttcaatatttagaatgcttgctgttgctagctattggttgaacgttgagtgggaaaatgatctattatgatgatttttgttcatccaatattctgtatgttcctgatagttatgctgatactgttgctgtcagtatatgatataaattatgttttaccattgctctaataatctttgcatctggaattccaggtaccttctcttcagagagcatgacatcttgggcacccttgtggactgatttggatcgtcatgaacgccatcagtaatcagttgcgctaatgcaaggcatgtttttttagtattggatcgacgggacacaatcctccagacacaactgtcttttatgatgtcgtagaattttggctaagaacatcatgaacttgcaaaagattgttgcttccttttatctgttgcgatgaaattcagtaaacgttaacgcatctgaagagcctcttcctttttaatctgctctgtcttctatgcatgtttgtgttctctgtgtgctggttggatatgtgtcgctgtgacccgagcttaatgcggagagatcgataagcggatgtgactatgattccctcgttaaatagttgattgattgaattatataaccgctttcatcccatttgattggggaaataaatcgcgctcatcgctcatctatcttggatgaaatagttgattgaaccctcttcacctcttatgcttcaggctgttgaagtcgtgaattatcgcatgcaactttgctgtaacaaatgtcatttcaaaccaggatttaacttaaattacaatatagtataaatcacggatgtagtaaactaggatatgtccatatcccatcaggctctaggttgctatattctgagacggaaggttctaggttgctatattctaagacggaaggagtatgtggttttgtcatcttttggaactatatttttcaccattctcattgtaataaagtttggcagaacagacaaatatacttctagaacagtttcaggcattttcattctcatgaaagctgacataaatccaatcacaaaaaaaccgatcagttgattggaactgtcgtctgttcgggaggatgtaataatctgaaataatgcggctagctcatgtctattgatattatcgtctatcacaattagcagaatcatacaagaaccagcaatcagaattatcaacagcgccagcacgccgcgcctcaataaaatccctcagtttggcgtctgcagatctttgaacaatatctggctataattcatgatcgtttctcataggcattcagaaatctttgagcagcatctaggttcagctctttgtaaacctggcacagagaacaatatcgtgagatctcaaggcagttttgcgtggtggtggttattgaagtgatggctgggagtcaagtccatacaagtttcttatgggcttcttcaaatgtcttgcagaacaactctgcctttgttgctccaacctgagacagtaaccaataacatattagtgcgcaatcagatcggcctgtttcaaggagagatgccactgagcactcaacagcgccattccctcttaaccaacaaaatatgtaccatacagcctcaaaaaacagtgcatgtaggatgtagcttacagatgtactatttatatttaccagctttaattgatggacacctcaaatttttcaaaaaaaaaaaaatccaggacagccatgctcacgatcattttgccaaatatttaaaatctcttaccaaagttcttaaccgcataacagcagacttttatgacaaatcgcatccaaggagatctttgatttattccttactggtttacttattcatataaccgacacatgatattaaacaatctttttgaaacttccatattatactgagcaggtagttttgtgaaacaaagtgaaatatataaagaggaaatcccacctttttctcagcaaccatcttcaattttttcatgaattgatctgagaaacatgcaagaaaattcatcaatatcagtatatgtaagctggtattctttattgaagggcagcatatgagaaatacatctacaactgcaaccaaagtcttcatccccttatgcactgttcatgcaagtcccacaggaagtaactgacctcaactcaagtcatattacaaatatcaccaagctactgcactagagaatatatttgtctattctaaaaaaatcaatactaccttcatccccaaatgtagctattgtccaggtgcatagctagaaatagctacaatttgtgacagaggtagtattattttccaatcttcatctccacaactattttgaagatctattccttatgatattcaaaactgcacattgctcagaacacagcctttccttatcatttcagtgagatacatctatagacttctcccatgagagggacttgtgctgcaagtatctcatcaatttctacaaccttgtgccaaagtgtacttaagtttgaaggccacaaaaaagatcagtttgtgcgagtgtctatttcaactctttgagtgttctggttctcaattgaatactggtaactcagactgttgttacagctcagtttagccatccaggaaatcaagcttccatatctactccctattaatctagtttggttatacacagcttcagttgttcaagtcaagaacaagaaaatcctaaatggggaattcaatacctacctgacccaattcataaagagtgatcaaatgatttctggacctcaaattgaagagaaattgatatgtgctgtgaataggagtccagcaacatgccaagttgatcattaatatggaattaagtcccatggaagtcatgagtatgtcatgtctaaccatggagaatgaggattgtggtgtgaaatgacaaacccagggcctcagaataaaggcccaaggctagttagcaattggaagaagtgaataagttccccatgggattcacatgaacagggatgaagcaggaagagcaaactttatggtagtgacacaggacgtcattccagcataagaatataaagttaaatgggtattgcaggtttagttttctgctgtaataattggtaagataagattaaaagcagagcaatcaaatatttatcgataagccttcagtaccagatgactcatttttgttgccccttgttgcctcctgcaaacaatagctttgttagaaataattacaaaatacaactaggtagcatttagatagttaaattagttcatacacacctgagcccgtgattgctgtgtgctgcctttgcttgatgcccctgattcagcctacatccggcgaaaaaaatttcatcagttcatgaccatatcacgagatcgtcaaacaggaaaacaagcactgaccatatttacttcagatcattcttcattgaagcattgcccattgatgtttccatttaaatttacttattattgcagcaaacattgttaccgttcaacccagttttctatttatgaaaatgagctctaccatctagttctctctcaaccatagcctccaactcaatgttatgcagagagaaacacaaacatgcttgcaaatagcctgttaaaagttattcctaatattaacctacacacttcaaggggctaaaattagtgtcactaaaaatagcctgaccacataaatggcatgggaaacacaattgcatggctctgtaattgaagtagcatggttatattgagatatgaccaacttagtgtatctctagcttttagaaccatctgaagtacagaaataaaaatcctacagctctacatcttcaaaagaaaattccagatgtactgcattctagcatccttatattgttaaagaaaaaaaaagagttttcctctctctatctcattttaactaacatcactcaggcaattaccagtgcactatcatctctacaacttctactgcgcaaacaactcaggctagaagacaggttcatgacgcaattcgacggatcagtataaccaaagtgagattatctcaacataatgcgtaatccagtctccacgcacatcagcccaaggccacaaatcaacagccacccaaatcaaccaacccatgccctaaaatcgagacccctcttgctcccccaactcaagcacctgaactgctagatcgccgccgaaacgccgattcgcccccgccctacacgtgctggaaacgagagagtagggtatgagaaagggggggaggggaggggatggaaattacgcagtagtcgcgagatcggacgacggggaagagctcgagcatccgccggaactccctctcgtccatggcgccgcgcgccgccgctactccggcgatgagctccgcctccgcccgcgctcgtagggttcgatccgattcgagcgagctcctcctctcccgattcgttgctctctcgctctcgaagcctcgaactcgctggagacgagacgagacgacgacggcgagtccaacccagacggagccgacgtctacgcggcgcagtcgcttgctggattatcgggtccaactctgtttcagattccggcccaaaataaacctctcaggtcttgggcctcttctgggctaggcccagaaaggacacaataaaatgggcacgaaaccaagcttaagtacagatgaatttttttcatttttaattttaatttttttaatatttacataaatattataccatccaaaatatttacacaaatggcccctgccgcccaagtggagggcggcaaggtgtgcgcattttacacttaggtcccttgccgcccttgtaccctctacaagggctgcaagggggtaaatacaattttcgccctgccaaaaatgcatttttctagtttttttttcaacttgtctgtccctcacgtcaccctgccgagggcagtagggtctatttctgtaaatattttcgctggtgcaatatttctataaatattaaaaaataaaaatttaaaaatgaaaaaaaaaattcaagtaccgatattgcgggagcaggaaccatcgacgtgctcaatgcccacttggtttattccatgagtttctgagacaatatttatttactactccctctgtttctaaatatttgacagcgttgactttttagcacatgtttgaccgttcatcttattaaaaaaacttttgtaaaatatgtaaaactatatgtatacataaaagtatatttaacagtaaatcaaatgatatgaaaagaattaataattatttaaaatttttgaataagacaaacggttaaacatgtttaaaaaagtcaacggtgtcaaatatttagaaacgaagggagtaagttatttgtgtcgaagcacaccatacacatttggcaactggcataaaggctagttcccctcctccatggaagagcagaggcagtgaagtgggccaagaagaagctgcataagagggagagagagttcgcaggaatctggaggctaaggagagagagttggtgaggaaattcttgcataagagggaggttgataacgaactaccctgagttcttgcacgagtttagggttgaggactgttgaatcattcgtcgagaagtaggaacaggagaagtagataagtcaggtggtggcgctggagacctcgggcggcggccggattcggcgttgcaggtctagtgtcagtgctcatgggagctggcggcggtgcgtcgtcttccttgttgccagtcagcaccctctcccttcttgaactcctccccttctttgtggggagtttcggttgggttgaggcggctgctggtcagcaggggaagctcaggcggccgaagtgacactgtccagtccggattctcctttggtcgaacttggcgaggaggccggcgggtggcgggacggaggtggcctgggccagctctcaggggaggagcggtgggatgcagcgagctggcggcagggttctgcggcaagttcagaagtcaaccagcagagaggcgctggtgcggtcttggtggaagccacgcgctgccaatgcttgtgtggtggttactgagttggtgggcgacaaactacttgagaggttctaggggttccaggcgaaagcctcactcggtgatcaccgggccggcaacggctacaccttcgnnnnnnnnnnnnnnnnnnnnnnnnnnnnnnnnnnnnnnnnnnnnnnnnnnnnnnnnnnnnnnnnn

SEQ ID NO: 43634 - DNA, 6235 bp, Oryza sativa
  unsure (1)..(6235): unsure at all n locations
ggcgctgttgtgggtacctctccccctttcttggcgagttctcattgggtgaaaaccacatctttcttagatgggcgatagcggcgtccttgatgtcgtgacctccatgggggcatcgtttttggagtcttgcctttgtggtgttgttgtaggccgggcggcgatcagccatgcttaggggggtcattttggtgctcagttccattttcagtggattgtgcttgtgtggttagcgtgtggttcttggaggtgccttgtgcacgtccgtacttgacaacttctgtcgtgtttttcttagtaactttactcctctttaatatactcggatggcctccttcggcctttcccggtgaaaaaaagataagtcaggtgagatcttgttcatcctttttatcaattcattacccctgaggccctaaattaccaatcagtgttgtccatttgtcattgtaatttggtttcttgaaacctttgaagtctgaactcccttttgcatttgcagaagttccttgctggtatccgcatgactttggacttatttcaaactgtgggaactgaaaacaaatatagactccaggcctctcggaagtgatgatgagagctgctctcctacacaccatgaaaattatccacctcaatgtctcaatctcattgttcgtgctgtatgaatctagtaatgagctggcttttcagcatattctgtggtccaattctagtcacatttgagaaaatcaccaggcacgctcattggtgctattgcgcactaccatttgttgtgggatacagacaattcgtatgcggttggttgtattgcaattgctcgcctattcatttttttttaacaatataaatagatctcctgttctgcttattttgaattgctatgggttgtattgtcgctggtagtggcttgtgtctgacgatagcctgattttctggtaaggccactcgagcaatcttctttcccgatcagatcaggcagtggacggctcagatcgatctgtaccgtatgaactatgcataattggcgaatacttcacattctttcttgatcagatcaggcggtggacgtctcagatcgatctgtagcatatgaactagtatgcgtaattggcgaatacatttcgttggcggaggaggtcaagtcgtggcgaacgaccactctctgcaacaaactctattttccggtttcatgaaaatggagcagtgggcttcccctgctatttctggattatttttttaataatggaatagataacatcccggtctttactcaacagagttacagccaattgttacaatctaatactcgaacaaagaggaaaaaaatatttttgaaacagaattatagatgaaatcaagatcaacaccaggctccaaagacaactctctaaacgatcaaatagagtccaagagagcataaacatatccattcaaggcaaatctaaaatgcagtcatgcacaataaccaaaatacataacggggcatgcttttcaacagctagctctaattaatttatgcccgggcatgattttcaacagctcaaattaatttatactccctccattctaaattgatctacatatttcataggtacactaagaccaagaaaaattaataattctctcatgttatatttactctagcaacaaactcaatgcatgcaccatccccaatatttcctagccaatagcaaatcaagatattgcatatgggttataaatacttgtgtgtatggatgcatgcatcaatgtccatttactccaatacacaaataacgaatagactctactaaatgaacacaaatatgtagatcatttaggaataaacttaaaaactatatgtaaatcaatttggaatggagggagtaataatttatgctcgggcatgattctcaacagctctaattattttatgcccatttagtttcactccaaaggggcatgcatggctattccaagtccataggattatcgctgtcttcagtttcgtctttagttcccaaaccaaatccaatatccagttgcaatggctcatgcaagtccataggattatcgctcctgctgattgtttcacccagccgcttgtgaggatattgcgcatgaaatttcaaaggtctcttcaggtttccctttacacctgcacccagtaaaacagcaaaacaaagggcccatgagttagtgcatatagcctacacacaaatgtaggtacatttgtatgagagtgacaaaaagaaaacctacaagagcataaaccaatttagttcaagaatgtttaaaaaatgcaagagcacctaaagtggtcttctctctccccactttgatgggggcagaaatcttgtttctgttttcatttctgacaatttcttttaataaaggctcactttgtttaattatgtgcatgttcttgatatagcgtgcactgacaagaaaattttgatatgaaggcaatctagaatccaaaatgcagttgcatttggctgggtttgtgttccacatagcttgcatttcatgtactctggagtacatcttatctggaactnnnnnnnnnnnnnnnnnnnnnnnnnnnnnnnnnnnnnncgaggggaaaggattttgctagtaataactctgatgcggattntatatcattatagattatgaaacaagatgttgaacaccaagatttggtctttaaataagttggttgcaacatcatggctggagggaggatccttgagcttcaaagcacctggttggaaacatttgctaccaagggacccagcttcaacctccaaatggccaatcagttgccatgagtttatcattgaaaacaatgtgcagagcctttgttcatgttggttgcagacaagcatactgcctacactttgaacaggttcagacttgttcagatttgcagctgaagcagtgcaatgaatcagtgcaaatgtgcaatgcatcagtgctaacaggcactgtgctgcaacaggggaacacaacaagatccagtacagttcatgtcatttggctggatggagatccagacttgggctgcctccaagaaaagccggtaagagtgtggcatttgcctccatgacaaagttggattaggcagaggccttgacaaattgtcgcggcaaaacataaaagatggcgaaaccaagaacaggctaaagaacaacccaggattggatccatatatcccatgcattgcaggataagtgaatggtgctgaagcttcagttggaattgacgttttacaggctagctcatggtaattcaggaactttacagagctcagaaccagcaacctcaagcttacgttatgccactgctttcagcaacttcttcctcacaagaacttcagggttttggtcatctccttgacaagatagtattcagagagagctgtgacaaaactactatccatgataatcaaagcattcaaaaaccacatcgaatccctctccaaaaaacctacatcaaatcagcatgacagcgtatgaattgaagcccttcatcaataatgctgtttactgtggcagtgtggtattctttcctcctccgaaaggatgtagtcattcagaggaagttgcatgtacttttcatgactactgatcacctaagcacttcatcaacatgcgcgaagagcagcattatttgagggtaatgtcatatatgactccttcaagatttgagatggttgttcttgtcccatccacctctttgacatgcattccatgtttttcagcttccttgagcactagaacatccatgctggtaatcaatgagagcagcagtgtcttagttaaggaacacacaagttatttttaaatgatctatcaacacttgaagtagtacaaaatcaattaaagttagatggagagtaaaataacccaaaaaaaaaacatgggatgacttattgagagttgggattgctccagattttactggaatttgttacgagaagctccaaaaggtcccaactaagtgaaagggacaacactaaatagcttaattattttttaccacctttctgtattgcagttttttaaacagtacaatctggacataccaagtattatgctggcagtatgtgcaagatgtcagtacagtaatcacattctggcagtaccaagtaaaatatccacagtatgctgctacctgttctagcccagttaattgtaatcaaactactgcaagccaacctgtatattctatttgctcatgaatgcaactggagtactggacaatcattttgcagaggacaatgaactgtcaggtgcagagtatctcaaacaagcgacaagctgacgagagaatgggtgacataacaccttgttgccatgaaaatctgcagaacttctgtagatctacatgtcactaggaaaaagatttgcctgtgaccatcctctctaagtactaattaacgctagatcatatttcagatgtttaatctgctttacatttgaatccatcagatcaatatattttggatgcagcattttgattatttggtgctattgatgcactcctgatttcacttgtatatatctttgatcagttctatcatgactactcagctacctttcatactaagatattcattattccatgtgtagcaaacccagacctatagtacaagcaagttaatcggtatattaaaaagaatcaatagctaagtcagtccttgttcttggtagacacaataaggataccaccaataaaaatgtacctattccatagttttatcaataaaaggtacaatcatttatattttgatcagaaatgagacacgcattaaattggctttcctaacttggaacagcattcgggtacacgatttcacaaaatattagaaactctggtaaaatatgctcggacaggaagatgatgagttattgagttgagaaaacacatacactttagctcgtgatacataagccaatatgaatctacatttactagcctgaatacgaagaagcctctctacagtatcaaagagacaggaaatgctagattgctgaaagctttctgcgagtcaaggttcacaaaattcacaagatgcaacaatcgatatacgattatatgtcagaaagaatagaaagagaaaggatcagaactgaaattaaatcacgggaaagtaagaaagaagaaatcacagcaaagtaagaaagaaggatataaatatcagctccaaggatgagatcaaatccagaaggatgtttctcaatgatattgcttatatgaacatagtttccccactctagcttctctgctgtcaacactgcaacaaaagtatcagttctatttgatatctggaagatttatatttcagtgattcacataatgatgaaacataattaaccagaagttaagaagtggtaacctgcattggcattcccagaacatgactgcatctctatattcttctttataatctgtcaaacaatctttggaataaatagatgcaacatttatatagaataagtagatatgcaagtggcacaatggaatcatccttgaatattttataatgtatgactatgacaccactttctagaatttgaagataaagcagctgcaccgaataatatgtgaacacaatgtgaaagtctcaatatcttctgtattttgtcaaactaagtgacatcactggaagatattcgtaaggtttgaagcttgcctctagaacttcatcattgtgatcagtcaagacaacttctttgcaaaaacggctgcacaatatgccagtaatgcctgaagcaagtcacaagctcacaatactgtcagattttccaagatcacaaagtgaagtaaacatgagaggagaatgccctcaccaaccccagatcctagctcaattattgaatgatccttcacagtctcaggatgttcagacaagtaggtgttcatcagaactgcacctggccatactaactgtccagtaagatcataatcagctgccacaaatcattagaatgtttgtaagtgttggccccatgataaggaaacagcaaaaatctggcgttatgaagtgcaatgcagcattgtgcccagagcaaaaatacacccaaacaagttaatgtactgatgagaggttctagtttgtaaataagattgttcatatttgtccactgcacaaatagaaataaacttgagtatatcatgctcagatctaacttttgtgttccacggaagagctatctccagataaatgatagattgatagttactatgttacacaaagcagcat

SEQ ID NO: 43635 - DNA, 4188 bp, Oryza sativa
gtttccctttacacctgcacccagtaaaacagcaaaacaaagggcccatgagttagtgcatatagcctacacacaaatgtaggtacatttgtatgagagtgacaaaaagaaaacctacaagagcataaaccaatttagttcaagaatgtttaaaaaatgcaagagcacctaaagtggtcttctctctccccactttgatgggggcagaaatcttgtttctgttttcatttctgacaatttcttttaataaaggctcactttgtttaattatgtgcatgttcttgatatagcgtgcactgacaagaaaattttgatatgaaggcaatctagaatccaaaatgcagttgcatttggctgggtttgtgttccacatagcttgcatttcatgtactctggagtacatcttatctggaactgtactctataacttgtctagaatctcaccaaaggcggcttccataattagaggggtaaagagtctagcgaggttcaaaataattacagcctaaactaacaagtccaactagcactatagcagcagccacacaggtttaaaatatatgagcaatcacaactttgaatcaggtttactgtcatatgcaacacaaagttaccgaaaagaaaagcaataagcagaaagaacaggccaagaattaattaatcacctgcagctgtagtgaaatattgggagatggtagactgcgtgtaggagtaatcaaagtcgtcgacgatcctctcggcgtcatacacagacaccgtttgaagccttttgttggccatgtcaaccgccaacaccaccgccttctcatcagaggcgtcaaccttgcccatgacgtaggcaacattagcatctgtctacctgcagctttgccatggccggtcgaccctccagcttaggcaggagctggacattgcagcaagtggcgtcgaccgtgatgtcactagaatctaccatgaagcccttttgccagcccttgttgtcgcccagatgagccaccggtttgctccatgtggacagatcccaggaccagcaaccagtgtccgaatcaaagcaagtacgcagtctgacaatggtgagaaggccattaacgatggcaatgtcccggcaaagcgatgaggtattgaagctcattggagagttgatgagctctggcggcagtggcaggtgacttccaggacagccatgggcgagcacgttgcagatgtggattaattccccgcttgagatcaatgaaggccacctctccctgcccctcatccagagtaattaccttgttcgtcaaatggaccaggcacagatgtaggataccagcggcggtggggcggtaaagatggtggccgttgccgagatcggcggcggcggtggtggagttccggcggtcggcgatgtaggcgcggacgtcgaggaggatccatggtagaggctggtgtgcatccagagggtcgccgccatggcagggcgggcgcagagtgaggtgctcggttctactccacctgtaggggaagacggtagccatggctcaggaggcctctcctcccgccggcgatcgtcgtccgcccgcccgggctagcttaagtagagcagagcagaggagtcggagtcggagaggacatctaaatcgatctcagcaatcctatcaagacaagttggaattgacgaaagatggtttggatagaaacggattgccggcctgatcaaacacacagcatagtttacagtcttaactaagcaaagtattttcagagttcagacaaatgcattttcagagtagagaagagtgtattcaggggctcttttttcaacttcaaactttattttttttcgtttttcgttagcatgttttttaaactattagatggggtgtttttttaaaaaaaaattatatataaattgtttaaaaaattaaataaatcgaacttttaagtttataatagttaatacttaattaatcatatgctagtgagttctcttgtttcacacgaactgaaacatcttctccaataggatgaaacgaacgggccaatccactttttttttccaaattacaataacaatatcagcacgcatacaaaacactagagtcgaacgcgcggcaccagtggtgcaagaggggaatttgttgttatttagttatacaaagttaaggaagaagcattatggtagaagagtaatcttgatggaaaattaattaacaatttataatatatatgaccaaacatctttaaagttataggaatttgacatgatgttgtgtgctgtatgaaaaactaatattaagctagtatcaaagatcatgtgctatgaaaaataaataatagtttgaccataattgtatgtggtgctctgaaacaacatgataaggaaaagccatgtgtggtatttaggaagatgaaagagcaagatgtgaagccaggtgattttcagggagatatggttcaaattttaaatctcgggaatcagatggttgttgatggaatgcactgacaaaattctcaaccacccagacctatcacagctactttcactaatcagcacacccctgtgtcccaaacctaacgaagaatgaatcaatagatagttccaattccaccagcaagtatccaagaaaaagatgtatatgtatcccagtttgtaggagatagatctgggatcagagaacctgaaatgcattgccctatcgcttgcatttcagattttctgatggtcagcaccaatgcctgtcgcttgctaaccatcagagattgctaacaaaagagctctatatctatctcagtttggttgcactgcacatttgcattttaatgtatattcccaaaggcttatcagattagccatgaacattgtaccatcatatgataatgctgcatgggacagcatcacctttaaattccttgtacagcatttcattccaaagcttgaatgctttgtttatatagcacctatcttacagagctgaggtactataaaccattttgcaaacaattataaatgaattccaagaaaggaagcaattaaatgaagcaactgtgactttttttgggacaggttggagctgccagatttttactgtgattaaaatgcagcaccaaaggatgatttataacagatgctatattgttgtagaaaataatcaggaaagtgaagctatgttattctagaagataagaaaggaaaattaaggcaaaatagcaccattcaacaggactgactaagatcaaagatctataaagcttatgttgctagacatgaatctaactgggaaaaaacatgtctcccagattagaaacaaacatgtatcccagcttaatacatttctatttttccataacaacagtaatgtaggtcatcccagattagcaacaacagttggctgagagctatctcatgcatatttttatgccatatctttaccctgaaaataaggagcatagcaaagcagtagacatccagagtaataataattaagagttataggattccaaccataagtgcttggtcatagtctggattgcagtttcatgtaaagcaaaaggattctacgaagcaaacgccatatatatgacagcagctatttacattagtggccataatgcagaggttctaaacaaatggcgttgcttctaagggtgggtgtgcatactggtgacatcctggacatataaccaaaagggacagtaatgtgctgcatgttgtttccttcttcatccgctagataaagagcaaagaaaagtatggattagcaaatatgtattgagctatgtgtcctatgatatatagaattgagatgattgtttatgtactgaccttttcttatgtttctgctgactgtcatctttaaatagtttcttagcagctgaggctgaggctgaggctgcaggcctgtttttgttcaggatacagttagattatatttttgctagaatagaaagttgttgtaactgaggaatgatggaaaaatatacctttttgggggaatgtttttggtaggcggtgatggggatgctgatggagtatcttctgctgctattgctagtgcctttgccttgtaggatagtttatgttgtcagtgtttatagtttttgctgaaagcagggataagtattaattaccttgtcctgagtagcagaagatagctcaacagacgatgcaatctgcggaggttctcccttaatttttgtctcagttgt

SEQ ID NO: 43636 - DNA, 1685 bp, Oryza sativa
  unsure (1)..(1685): unsure at all n locations
tggtgcattaataggtggacccatatggttttgaggtcttgtagcatatgtcacatgaataatacccccaggagctgttgcttgatatgcctttaatagtcactctgactataaaacgtgctcgctgcaaagaaatatgattttatcatttttgtcaaataagaaaggacaatattgcagtaacaaagcctgaggtggcactgaccgcatgtttgtgtgggttgagagcaaggatttgtgctatggttttttcttctggaatatcctggttaaaccctgtggtagcagttcaacccacttgataggttgaaagtttgcgctaaagctacagaaagaagatatcttaaataataatgtatcgcagggaaaatgtatatgtaaatggatgattgtgtaagcattaaaacaataatataagcttgtggtgtcacctttcttttaactcaagcacttcaggcatatcaaggttaatctaccatttgcatggtgaacttccatttaaagttagtcctgtatataattgtattaataaatatgtactgcagatttacagaaggcatgaaaagattttggtacaaatttatagagatatacctatccctttgtagttcttgacaactgttccaacaaaaacaataacctgaggtttcttttgaccagcattgtataattcttctgcattgaatgcagctgcagtatttccccatagtgtgataggcagtgtagaattgctagttttataaaatgattataaatttttggtgatcaatattagtaacttgttacaatagttagtgtggataatgtaaggtaaaggcagtttataacaaaagaaaatttcagtctatactgtagcttaccttgcatcccaaatctgcattgttcttttcaaagtttctgtgtttcttgattttgggcgtagagtgtctgttgcaccaatttcagttatgacacccataatatctggttaaagagaagatatatgtaaacaataaaccactaatgtataagaagtaaacataggaagacaaaaaagggataaggaggttataccaacatagaaagcatttttgtccacaagagacgggacgtcttgaaaaggtgtcaatgaaaaagttatggcagggaaatcatcagaagcatcaatgcattcttctaaggttgtccatttagtgaatgagatcatcaaagggttcgtaactggcctatatgttcagtttgcatatctgacagagaaggagtcaaagtagtaaaccttcccttcctgtagaagagtcctaagcttaatcatggcaggtggatagatttgaacatggatgctattgccctgcatattgtgtatataaagcaccttgttagtaccatatttgtatgtaagtattaataaagaagaaatgagtgttaattagactataaccttttcatccagcaagacaagatcagtgtggaagatttttgtttcatcattcagatcatggtagtcccattgcctagatactcttgccttgaactgtttattagtgtccccatacataaggtctgaaataagcacgtataccattggaagcctgtaattaaatattgaagatatttagttttacgtatatataaagcatcaatgtaatgaactaagcagtgagaaaatagcannnnnnnnnnnnnnnnnnnnnnnnnnnnnnnnnnnn

SEQ ID NO: 43637 - DNA, 1295 bp, Oryza sativa
  unsure (1)..(1295): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatattattgttttaatgcttacacaatcatccatttacatatacattttccctgcgatacattattatttaagatatcttctttctgtagctttagcgcaaactttcaacctatcaagtgggttgaactgctaccacagggtttaaccaggatattccagaagaaaaaaccatagcacaaatccttgctctcaacccacacaaacatgcggtcagtgccacctcaggctttgttactgcaatattgtcctttcttatttgacaaaaatgataaaatcatatttctttgcagcgagcacgttttatagtcagagtgactattaaaggcatatcaagcaacagctcctggtggtattattcatgtgacatatgctacaagacctcaaaaccatatggttccacctataaatgcaccagctgctccaatgtaggcataccagtgccaaggtaagaatatgctggcacaatttcctccatgcttatttcacagttatcaaaactgctataactatttctattctgcatgtagatacaaggttgtgttgatcgctgctgatgatactgctcaagctacatttatcctctttgggagaatagcacaacgcctcgtacgcaaaccggttgagactctcattgaccaaaatccacctgacagtgaatatattccagatgagattgtagctcttttcaaccaaacctttatctggaacatcagcttcacacaagatactattatgaaaaatcaagaaaccttacaggttaacaacattatctcatccaatgctgaagtgcagggcctactgcctatctcaccaagcagttcacaacagacattagctattatgccagcagactcaagcagctctctccaactagcaccagcaacaagtgaaggcagtacaggatcaaagatagaagcacaaacgacagaaagtatgttaccaatggatagtccatcgacaccaacaaggtatactatcagttctgcttcagatcagacaccaactagcaaagctaatgcaccagcaccaagcaagaaaagctatgtcctatcagtctctcccaagccagctcaagataaacagatctcattctcacatgatcctaaggtttctattctaacatcgctactt

SEQ ID NO: 43638 - DNA, 8636 bp, Oryza sativa
tgcaaccgagaaaaattgagccaatgacagcacgcggtctgcaccattccaagctgacaaccgcactccccgagctgacaaccgcactcacgctcgtttgcgcgcaagatcaagcatgcacagttgtgcctcactacataggcacattccatggtaggtccgaaagcaatgctaaccatatggcctacacgccagcgacaccaaagccatagaccaactgcattgacaatgcatcgcccaccgtcaaacacaccgaaaattcacaaacgcaattgaacgacaccgcacaaattatcacggataaaggccgcacgatctagggcctgtttggttggtgccacattttgccacacttgaggtatgttagtttgaccaaatgtggctagtgtttggtttgtttctataactttagcataccacactttctactcttttggtcccactagtcatagaccattttcttagccaaagtttgccacaagtgtggccatcaaattttgagccacacaatttgcatcttgccacacctttggtaaaaaaaactatggtaaattgaggtgggcatccaaacagcccctaaatcaaacggatagggtggcaagcagccacaaaagcccaccaaactcaccaggatcctagtcgtggttgacatgtgaggagtcaacagcatccatggcagcggcaaaccgtggtggggaagagcagaaaacatcaatgctttgggctcctgcatgtaaattctcccatcgccgccaagctgctactgccgccaccaccgagctcaacacacccgacaaccctgaatgtcctaaatcgaactttcccatcagctttggatctggatcagacagagagggaaattgtgaagaaagaaagggtgggtgagcttgccctttccctctggagctcaccactgaggaaaaaccgctggtgtggacgccattgatgagccaccggatccgctggcaaagaaatcgcggctgccgcatccaacacccacagcctccccttcgagtctgcgtcagcggcggcgtagcaaggagagcaccggcagtgagggcgctgcgaggacaccacccatccacaacatcgatccccttcgagcggagaatggcagcaacgtagggaggacacccggcggcggccacggcactgggaggacacccagcggcggccacggccaagccaaatccaggcgccgcgcaggagagagcgagagagatgagaggggcatggcggctgggagttttttccttttttttttacgcgcctgggattctcgcgaaggggagagagagagagaaagaaaaggaaattttgcgaaaatgcccttcagtttctaggattcagggcgcagtccttttttcctctttttgtctcctttgtattgaatttcgtaggatgcaaagggcctaaacgcaatattttaaaccgagaaaagaacagagaggacgtataacaaaatatctataaaagagagggcttttctgtaaaatttgcagaggcgacgcggacgcatgaaaggccgtgaaatccatccgctctccagcgcgcgtccacgcgtcgcgaccccgtgatggccacggcagcgcaaaacgctgagggcgctgcatttcccagttggtttgaagactttagatagtcgaacaaacaggcgacaaatcgaattttcgaaaaaaaaaattgtccgtgcaaattaacaaatgagcaaatcccaaactggcttaagctagctagtaggctagtagccgtggcatctggacatgatgggcgggtcggcgaacgggccgtcgagcacgccgcgcgccatgatccggtacaccgcctccgtcatgtgcaggccgtcccacgagatgcgccgcgacgggtccgcgcactgcgtcgcgccggggtcggagcagtgcacggtgaagttgccgttgtacggcccgccgccggcgcagcacgcggtcagggcgtcgtcgaacccgctcgccgcggggttcgacacgagctccatcacctcgccgtagtagtcggcgtaggcgatggtgacgcccgggtgcgcggcgcggagctcggcgaggcggcggcggaggagcgcgttgtggagggcggcgaggccgtcgttgagcccccggaggcagcccgtggcggggtcgcggtcgccggcgccgccgtcccggaagaggaagaggaggcgcgggacgcagccgagcgggaagaggcccgggacgtagacggtggtggcgccgagcccgacgagctcctcgacggcgccggcgatgtagcggacgacgcgcggcaccagcgggcgcacccactccagcgtcttgttctggaacagcgggtggaggtagtcgttgccgccgaactcgcccaccatgaacaccgacctcgccatcgcctccttccgctctgcaaaccattttaaccattttggttcatcaccaccgtcattgctcaaaatttcatgatttttttaaaaaattaaaaaattcgaaaattttgaatgaaaaaaatgaatttgaacaactttgttggtaggctaaaacaaattcgattttttggcctggagtttcagaaattacaacgcgttccaaagttggtgttcgctttttattaagataaagatgaagttatggcatgaaaaacaagaaaaaacattagtacataattaattatattttaattattacaaagctgaaaaaataaattatataatattttaaaacaatttctatataaaaatttttcacacgaagtatatcgtttagtaattttaaaaaatgttatcagaaataacgagatctgactacagtttatgggctattctccgtacgttcgtgattaacagtgccgacagtaatgcagttcctcgcgtacaaacaaggtacactgacctacagtctcaacgaaatgctgctgattcaatgattcatcggcccaacattccaacaaaatcatcgatataattcgctcatcgtcgtgttacattaacagtgaacaaattgaatcgtacacgcagcatgcgtacgaattaaacagcaacatcaacatcaattccagttaattattaatcatatcgctgagattaataatcttatctagtttcatattataagacgactgactaagtcaaactgtttcaaatttaatcaaatttataaaaaacatagtcatatttttttacctaagataaatttattataaaaatatatttaattattaatttaataaaactaattttgtaacataaatattactatatttatatataaatttaattaaatttaaagcaatttaaaagtcaaagcatcttacgaattgaaatagagggattacttaattagtataaaattggcgatgattacccttgttctgtggaggcgagcatggcaagaaccttcttgaaccagccgacctggacggcgagggagtagggcgtgatgccggcgacgctgaggtgcttcttcttgaacagcagctggttcagcgcagtcccgctcgccaccgcgaagttggcgccgtaccggaagtcctccctgctcttcccggccaagtacggcgtccagtacgggaaccccagcctctccactgcatcaatccatcacatcgtcgtcatcgtcatcgtctccggcggcggcggcggcgctaggtagagatagctaagctaagctcatgggtggtttgcgttaccgatgaagtcgacgatgaggcggccgtcggaccagcggccggtggggcggcggaagaaggtctcgccgtagggggagcgggcgacggggcccggcgaggtggagtagtggatgaagttgccggtgtcgatcagcgagttgccgaaggtgaacaggtggctgtagcacccgccgctcggcgccgtcgccgtcgtcgtcgtgacgttcgccgccgacgccgtggctgcgcacaaggctaaggcggcgacaagtatagccgccactgcgggagcagacaaccgcgccggcctcgtcgccatggttggagcttggatatgcaaaatggcttctccagtggcgcctctcctttctcgatttgagcctatatatagagagattattatgactcggctcactgcaaaaaaatgcttacgccaaattaattaccaaaatgtttcggttagaatgtggctttcatcgggaagaagacaattttttaaaaaaaatattacaaaatttcgaaattagcttttcgatcgagctggattcattggttatgatattttttaagattgcggttgactttctactgcgtttaaaattttccatttgttttgcaccgtatttcgtcaactcatgcacagtgatcaccctttaaagtaatgctaagaaggatttggcagttggggggtcagcataaacaagaatctcagacggattaaaaatataaaatttgtactataagttgtaattgatgtggcgatttggtgatcgaagaactgaagagaaacaggaattatcatctgctgccttgcgagtatagtatgagtgatagagacgcgatcacgcggtcaattaatttcgtacagatcctctggttcgacgtggcgtatatattaatcatttgtgcagtagactgcttgttttattctaattaagaaatgacgttcaagtgcaatccttctgaaaataaaatataataatcatatcgagtgttattagccttactccctccgccccataaaaaacaaacatagaaatgaatgaaacactttagatatacatatattcagatttgttgtaataatgtcccgttcatttttttatgggactgggagtatggttgaagagacatcacctgcaaaacattatgaatagtacgaacgattgattttgcctgtatctacgcggctacgcccatgccttcggccccaacaataatgggcctcacgtggccagcattacccttttggcccaataagtacggccccacacgtaggccgcaatacattcgggcccagataatatgggccgcatgtgagcccgcgattacgtttcggcccaactagcggtctacgaggcccataggcgggtgagccatcgcacctatagacttgccgttctcgcgacgtggcctctcccccgatctctctctctctctctcctccgcatcaccaccaccgccgccgacgagctccggtcgccgccggcgagaggcgccgcgcgatccgggagatgccgccgctcacggggcccaagtccggggacgctctcttcggcagcgtcgagcgcgtcgtaagttcccgcccctcctccccccctgtttgcttcacagggagtcagaaacccccactggatctgggccctgatctgcttcgttttgctcgcagaacgcggagctgttcacgctcacgtatggggccatcgtgaggcagctgctcacggatctggaggaggtcgaggaggtcaacaagcagcttgatcagatgtatgtgtggttcttctcttcctcggtgtctaattttctggttcaattttagggagtttcgtgggtactttggaccgatcgtgttataggagtaggaattcggaaatattcactttttgccacccctcaaattacagtgaagcagctgcaatggcctcagtaagaggatctatgtagactttgctatggaattttgagcaaactaagtaacgttcaggtagtctgaatgattgaagtatttgtaaaggtaacttttagtaaacttcttcatgaaggtgtattacagcgatttgggatttagaggttcaaccttatacctggataatctgactttccaatttagtgcagattttacactgcgacaaaatggtaattgatcattttgatatgacatttcacgggctcacggcaccttatattcacaacactttcatgtgtcatggtccaatgtggggaaataatatgtacaaatttattatattccagttttggaacttctttacttagttaagcactaatggggttagtgtgccacgacaattaatatctccatatgtaaggatgatattaactgaatcttgactttgaagtagtagataataaatcaagtggttatctggcgaatattgggattcttatttagtaatcaatatctatggcttgctggctgcattttttcataatttactactaccatctgcctttgccttttatctgtttcctaaataagtcacagctatatttattttcacttcgcaggggctacaacattggaactcggttggttgatgagttcctggccaaatcaaatgtatcaaggtgtgttgacttcaaggagactgccgatgtcattgcaaaggtatttcgttaaacttgttattatatggttcagattgaataggaacattatcagtcggtaacattattacatgtttccagagcttattgcccttattcagatatcccagacttggtggtgcattaagatatgggtgtatggtctaaagtttttttgtctctccttaaaacagcttggattcaaaatgttcttgggtgtgactgcaactgtcaccaattgggatgctgagggtacaagctgcagctttgtattggaggacaatcctcttgtagattttgttgaacttcctgatacttgccaaggtcttcagtactgcaatgtgctaagtggagttattaggggtgcactggaaatggttagtttttcagctacctctaccttctccttccctcttcatgttgaacgatctatagatgcatgacaggatgttgtcgttttcgtatcagaattctcatggtcttgttatacatatttaagttagttcataatgactagatgactgttaaggtgccatcagcaaccaacctgctctattatgtggggttatgccctcgtgtttctcaccataatagcataccaaaattccctttatcagcacatgatatttttgtacttgtttatcagtcgagagaaatcttttacaagtgctactctgattgaattgcaattgtcatataggtttctatgaagacagaggttacatgggtccgtgatatgcttcgtggggatgatgcctacgagatgcgagtgaagcttaccaagcaagtcccagaggaatacccctacaaggatgatgactgacttgacgatttcgtggatagtttctcagttctcacatgatgcttgtttgctcgtctggatttcccttcttttctttcctctgtgactgtgattctggttcgacttggctggatgctacatgagatagctgtgcattatattttacacttgcactttgcacggcagcatgtattgtagaaatctatcataacttctgaatttgtttgctaagtttgacaaagcgtttacgatccatatgagatttcttctagctgtgctgcccggaaatctatataaagaggctttttagcctgatttcatggcacaccttgttcagcggttgtgcttctccctgataacagattgttagggaatggtctcatgtcagtgataaaggcaccgtgtttttaactacagatgatctcaatcctgacgataatggggttaccccttctctgtggtgagctgcggttaccgagtaaaagcaagaaaaactagataatttttttatcaaaaagtagaaaaaatgcttaaattatttttaaacttggtcaatatacatgtgtttcttttttcagttacatggagacgcgcaaacattactacacatacaacaacacaccagagaatgtcccccctaatacacacttaaagagatggaagtttgcgtcatatctctggtctcactaaatagaaaattctgttgaaagctcacttatgtacataatctttgtgggcaacaggatttgaacctaataggagtatataggtggctccccttaagtacaagcaacgataaaagaagctcgcttcgcggtttccaaatagaatcagctctactcctcatcgttgttctatatgaaatcaatcaattcgaatattcaaattctaaaatttaattttaaagttaattttaaaatgttttaatagtaccttttttggtgcaaacttttaagtctctaagaatatactcataaatattttttggtggctaataatcggacccttctgttcaaaggaacggttaaatggttaatgaataccccgtgttgctgtggaaaattaagttacataattgtacaaaactaaaaataatttgatataattttgagcctaaaagtaattgagattgcatgtttttaaaagagaagaaagaagagacaatttagattatagatctatctttcaaatgttagaaataattaggatgatataacttatcgatagaagagaaaaatggtactacatccatattttaatgtatgacgccgttgactttttatacgtttgaccattcgttttatttaaaaaatttacataattatcatttattatattttaacttaatttatcatcaaatattctttaaacatgatatacatatttttatattttgtataaaagatttgaataaaatgaatggtcaaacgtataaaaagtattaactaaggccgagagtgcgagtctgcgagacagtaaaactgtaaaaattccccaatctttcacccacccaaccagagaagtcgagaggaactcatctccttccgcttgacttgccccattcgattcaaac

SEQ ID NO: 43639 - DNA, 6579 bp, Oryza sativa
ggcctccagtactacaagggcggccgagccatcacccgccgcgagagcgtcggcctcgtccgggagccccacaacccccacgacgccaacgccatccgcgtcgacaacgcccggggcgagaagatcggccacatcggccgccgcgccgccgccgccctcgccccgctcctcgacgccggccacgtcgccgccgcccacggcatcgtccccaagcccgcctccaagaggctctacagcctcccctgccaggtccacctcttcgcccgcccgccccacgccgccctcgtcgccgccgccctcgccgcctccgggatcgacctcatccacgtcgaccaccccgagttcgccctctccgagtccgccatcgtgcaggagcagcagaccaagaggtctcgcggggatgtcgataggctgttctctcatgtggggaagggagggagagctcggattgcgcccatggaggcgccgcgggatgtggtggtgtccgaactgttcgagcaccagaaggcggcgctggggtggctggtgcaccgtgaggagtcatgcgaccttccaccattctgggaggaagataatgatgggggatttaagaatgttcttacaaatcagaagacgaatgagagaccgccgccgttgaagggtgggattttcgctgatgatatggggctagggaagactctcacgctgttgtcgctgatcggaaggagtaaagctcgcaatgtaggtgggaagaaggctagaggggcgaaaaggaggaaggttgaggaggcggtggaggaggagtcaagaacaacgcttgtggtgtgcccgccatcggtgttctcatcttgggtgacacaactggaggagcacacgaaaaccggtagcttgaaggtgtatttgtaccatggagagcggacaaaagagaagaaagagctgttgaaatatgacattgtgattaccacttatagcaccttggggcaagaacttgagcaggagggctcaccggtaaaggaaattgaatggttccgtgtgattctggatgaggcccatgtgatcaagaactctgcagcacgccaaaccaaggcggtgattgctttgaacgcggagaggcggtgggtggtcacagggacgcccattcagaacagctcatttgatctttacccgctcatggcatttttgagattccaaccattctcaatcaagagctactggcagagcttgatccagctccccttagagagaaagaataacggaattgggttggcacgattgcaggtaagtttggaaaattgtttgccttgtcattacatgtcatttttttgtaattcacaattcacatgaactagtaactatacttaggtagtactttaataatggtgttggaaaggatctgaaagagtcacgtgcatacctgcaatttctgataattaaattcttcttatctgcttattacagagcctcctaggtgctatttccctgcgcagaaccaaagagacagagagtggtagcaaaagcttggtcagcattccgcccaaaactgttttagcttgttatattgagctttctgcagaggaacgtgagtactatgaccagatggaattggaagggaaaaacaaactgcgggagtttggtgacagggattcgattttgcgtaattactcaactgtgctttatttcattctgaggctccgccagctctgcaatgacatagcactatgcccattagacctgaaatcatggcttcctggcagtggcagctcccttgaaggtatggcattttttcctgtttgtaattctggatttattttgtgatgatataatatggccataatacactcatcaaaattaaactgtgctgtttagattgaaccatcttgttgccaaagagatttcgcacactaagcattgtatgatagtagtatttcttttgatttttcttagaactgttccatcttactgtagagtgtcaaactagcaagttgagtgtaattggtttatctatttgaatcgacaaattgcatcagtacattgctgcttgccagcttaactttacaaacttgctacctatccgtcattttctccaatgggtcaactgctctgttgattatatcaatataacttagtaaaccgcagaaatcgctgcatagccagtgaaatcatattcccatattcctttgaattattttctctagtccatttctgtttatacttctacagataaaagttccgctttctgaaatgttttccttgtttatataacaatattagcagtaaggtcctcactccttacatttttttttggtattttcagggattactttatcttatatccagaaaatagtaaattctgtttttttaaccttttcttttatactgttttgattgatatattaggatttattggaagtccaggttatttggtgagtcgcttgaattaataatcaccatttgtatgatatgatttatcacttttctggatttgttttttaagtgaagacaagcacgcgtaaattttttccattttcagactttgttttgttagggtattggactcctaaaaacaagtattgatgagatcgtttgttttctatcctctttcaattcttatagggttgcattgcttacatttatcaaccacgcgctataacagcttgcatgttgaaaatatcatttacagagtaactgttacttatagtaaacatgttgcttgctgtagatgtgtctaaaaacccagagctgttgaagaagctggcctcattggttgacgatggagatgacttcgaatgtccgatttgtctcgctccaccagccaaaaccgtcataacgagctgcacgcacatatactgccagacttgcatcatgaaaatcctcaagagctctagttcccgctgtccaatatgccggcgctcgctatgcaaagaagacctctttattgcgccagagattaaacatcccgatgaggattcctcagtcaatcttgatagacctctttcttccaaggtgcaagccttgctgaaactactgaggcgttcacagagcgaagaccctttgtcaaagtctgttattttctctcagttcaggaagatgctgatcttgcttgaagggccacttaaagcagcaggctttaacatactacgactcgacggctctatgacggcgaagaagaggtcagaggttatccgccaattcggatgcgttggccctgattctccgaccgtgctgctggccagcctgaaggctgcgggagccggcgtgaacctgaccgcggcatcaacggtgtacctcttcgacccttggtggaaccctggggtggaggagcaggccatggacagggtgcaccggatcgggcagaccaaggaggtgaaagtggtgaggctgatcgtgaaggatagcatcgaggagaggatgctggagctgcaggagaggaagaagaagctgattagcggcgcatttggtaggaagaaaggaggcaaggagcacaaggagatccgtgttgaagagctccagatgatgatgggaatgaaatgaaatgcaataggtgcctcttgctgacaataggtagtagtagcgtttatcatttcgtaatagtgcctcagtgtcagtaaacaaagtgctggcttcaggaggcagtaggagacattcatgcgtgcatgtatttttgtggttaactgtggttaacatgcacggcatgtatgtacagtggtgcattgcatccggcatcctgtccttttccttttgcttatttttgtataccatattagcgggctaaaactaaaagaaagtttatgtatgtatatgtgtattcctccgaattccgatgcaatgttgagaagtatgtgaatggagctagggtgaaaaggtttgcgatttgggacttgggagcatgaacatccaaggcatagtgctgcatgccccttgtgaagggatggatgcaaaatggtcgaccacccatctacaatttttcacattttaaaatgtttaaaatatagagtggtgtgggcgtgtggctatgtgagtatacatactttgttagataaatacttcctccgtttcacaatgtaagttattatagcatttctcacattcatatgtctagattcattcacattaatatgaatatgagaaatgttagaacgacttacattgtgaaacggagagggtaggaaataaaatctttagcctatgaagtaagtatgggcgctccctcgatttgttgtctctagagatttcaatggtggttctgttctaagaaatgatagaaggaaaaaaaagcaatatttgatagtttaagaagccttcacatctaatttgtgatttaattgtttagtgatgcgtttaagattgaggtatagtgcagggacatatcataatattacacgcgtttggcgttgtgggctgctttctctgccctccctaccaccaccaccagtgggctttgggcacgaaagaccgcggcctttctaccaccgcacaatttgccaatgggccaacatgaccgcgaatcacacgccacatccacgcgatttgctgggccgccgcccgtacgcgggtctcgctcgcatcgtcgccaccaaatccgtctccttgaacaatcagctttagttccaggtagccacaaagcggagttgggcgaggctgaggcgtaggtgatcatgagatggatgagatccaaggttgataaaacaccgtacggttaccacgcgattatcatgcgctgtaaccttttcagttttcaaaatcacggtatataccttaaccgttaaactgtagtgtagggtgatgataactttacgccaaacggtttggtagacctaaatgggatctcgcgcgaggctacagcagtgaacttagtgcgccgacctggcgtggcagcgccttggtttacggctttcgccgtgcaagtggacagctttggctgaaaaaagatctctcgcattccttgtggttcacatcgatttcccacgcaatttgacggatcacgcgtcagtgctgttgctgctgctactacgtcgtcctcatatagttatcctttgcacgctgctgctagtcagatcacaagcaacgttctatagatcacggtttggggatcgaatcacttgaacatgatcgacatgacgaggcaatcaatcaatatgcaataagtaaactgattatattgagatatactccctccgtcccgtaaaaaaccaacataatatcatatgtgacacatcctaatacttatagacatacatatgtccagattcgtaacactagaatatatcatatccagtcctagatttattttctataggacactactttactacttccccgttctaaaatgaaactatttatattttaaaaggaagtattgcttatttaactccagaatccggatatgtgtacaaggctgttcaaattgatgccattttaaaccatacaattttttttggcaaagttgttaaagatatgcctatatatttaggttttttttttgccaaactttggcaaatacataagaaatcatgctaaaattttgatgatattatcaacttactaaaattttggtatttggtaagatttatattggctataatctgaacagcctctacgtgtcaaactctggatagtttttttttagcttatgaaggttgcatgttgtaggcttgagaggacagttgtaacgctccgcttttcgtgagacgttaaaaactaatttggcaaaatcttatatgcgaaaatttccgttctttgtgggcgagtctaagttgtgccaagatctcaattcaaatccgtccttgatccctctcgtcaccatcaaaaattgcctcctcgaaattcctcttccaactcaagtctccaaatcaaactctgaaattctatccctctctttgaatcatcgccaaatacttccccagatccaaaatatccaaaaccccatcttgaatcctccgtctactccttcctctcatccagatcccaattccaaaatctaagtcaaattccaagttcaaattctcttcgaatcaatctcctccgaaaaagtctattatgcctccctcggatttttgtgggccattttctcctcggcccatctcctctcagccgctcctcctcctcctcctcctcctcctccccctcgcacgtgcgttgcgcgtgtgcgctcgctctctccttcttcctcgctctctctcaccctttctctctctctctctcattgactcccgccgacgccgcccaaaatcccagccacgctgccgtttctcgcgcgcatggccgaccggcaaggacgccgctcccacgcgcctcgcctgcccgccgcccaaaacggaagggagaggcttccctttccaccgtcctccctcactttttcccttctaaacccggcctctctcctctcgcccttgtcttcttgcgcgcggaggcagaggacgccgacaacgtcctgccgcgcctgtgcccccaccttgaccgcgccacgccgatgctcccgcgcccgtgattcaattcccgccgcacgatccaccgccttcacccgcccttcgcatcctcgccgtcgccacgtttcgcgcagcccacgaaaacgccgcacccgtgcaagagtgggagaagcag

SEQ ID NO: 43640 - DNA, 9039 bp, Oryza sativa
gctataaaaacccgagcccccctaaacgcctcgagccacccactcgtttcctcccacagcgccattgcagccgaaccaccatccccgaccatgactgccgcggtcctcgcctccctccgcggtcgcgcgtgctggtgaagccggcgtgcgcacgaggagatgacgcggactccggccgccctctctccctcggcccgagaccgaggtgatcccgcctgtgccgtcggacacccttcccggcgatctcccgacgtggtagcctccgttctccctccccactcttccttccccctagcttgcgcgattgctagcctagaccttcccaaatgcgcgaggacgctgcctcgagccccgccgccgcccggcatggcatagccgccaatgccgtccgctcccggaggccgccgctcgtcgccagctgtcctcggtgctcctctgtcccatccggcgccgaaaacggattaccttgaaccccggatatgctcccaccccttttaatcgaacccccgttgctccggtgaagtttcccccttttctcgccgccggcgtacgccgccgcgattcgtcatcgccggcctccctccggcgaatccgatccggtggctcacttcctctcgtccgtcccatcgttccggtgtactccctctctctcgaatcgtcgcgacgagctccggtgaactcggccgccgtccgccgtccatcttggccgccccttcttcctcctcccgccggcccgcgtggctgccacgtaggcgccacgtcggcgccacctcggctttgaccgagccgagccggtcagccgcctccttcctccccccctctcgcgcgcggtccacggtgcaccaaccggctgcgcgtgggcccgccgcatccctggtccatccagtgcacgcccgtgaaccgcgctcacccgaaaccctagcgctgccctcatgcgccgctcccacggagagccgcgccactgacaagcgggccccacccgggaccccgcaaggtggatacggtccacccggacccatccccctctctcctcccgcgcgccccgcccgcttgggccgcgccttgcccggccatgggccgcctccccgcgcccgcgcccggcccattggctcggccgcgccgtgcttatcccttgggccgtacccgagccgcccaaagaagtctaaatcccatccctccttccatttcttatccaaaggattaataaatcctttttttttccttcctttgtcccataaatcaattccttattcccaaaattccacaaatcatttcctttggtcccgcgcgtcagtgactgtcaataatattcttgagaatattatttctataaattccataaaccatttctcctattccagaaactccaattaaacttccaaaattcatatcacctaattcgcaactccgattgactccgttccacttccagtaattccgtaaaattgagatctatttattggcactactaattagtctaaataggatctttcttttggtcctttgtttaggttttcgattgtttgcgtatagttgcggttatcggattttcgtcgatcgcgggtttcctcgaagattcgtgaagcttcgtgaagaccttgagcaaggcaagtcaccctttgatcaattgcccctataattgaaaattcattattattttgtttgcaacttgcattattagaatcacacacttaacttgcttggcctcggtttgcgtgccaaaaccgacggacctacccagtagtcgcactaatttccgtaggtcatactaccctgattccttgtcgctccacccttgtggtacctcggtattcgtgttctctgagcacgtataccaaatatcccacatacaccattgtttgtcgaaaacttgggaaatgggtttgtgaagccttcaaaacccgacatgtggtgtcggtgtatttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagtttgatttgtgaacgcctaaaatggcctatgtttatgtgaggatttgatccttctatgtggcatgaggtaaccctgggtcggcttgggaaaggctttgttgcgaacctctgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgcgggcatcatagactaggcttcccgagtggaagcggattgttgtgctgctaggcagctggactctgggagtccgagaaaatgaaaaaggctctgggagccgattaatcaagtggaatggctctgggagccgataagtaatgatctgacccgggaggtcggtacattaccaaatgagctgttgaaaaacatctcttaaagtcgaatcgagacgcaagtctcttttcggcccaaacttagaaagaaataaatcacttagtgatttcaaaatgtcttcaaataaaagatttgcaaaacaaccttacctctcttccaagcttgcattaaacacctaagttctcgtgacttgctgagtacgaaagtactcacccttgctctatataaatatatatatatatagttcctccgccctgaagagaaggcaaagtgaagtgaatattagggtttcgtcctggttcccagccgtcgcctgtggtgttgggtgttagaccgttggttccgctgctgctgctgctggtggtgtttcctcgtccgcgtcgtcggttgtattctcgggctgtctgagctgcaacctaagttaaggtaaataagtcctctatttattttaaggattgctatgattcatatttgtcaccgtgggtaccagcactatgtcctgggactggtaccgagatcgcggtttcgtaggaagcggttcacgccgttttccctacaacacgctcctatcaggtgccgttgtacggcggtatcagattggggtgtgacaacagttatgcaactttttacaaactatggatggagattcacaaatagacttgaataaatgtgtacttcttatctcggtttggtcttttattttgttgggtgtgtttaattttattttgaactatactcttcgtttataataattgactgtagttatgatgagcaaagttcgaaatatttcattccattatcttaaaaaaaatatgaagatggtgttagtagtagcatatgttcgctctcgctcagataaacacaaacaatagtaggagtatcgtcgtggacatggatagcacagtaaaggatcagaatttcagaagatatagacgtgccagccaggggccccttgcatcacatgccgatggacgcaaaataatgtgtgttgagttggtggctaaaggcgccaaattcatcggtgctgcacactgcactacactgtaacgctggcagtttgcatttgcagccgaccaagtcaaaaaggatggcatccgcaccttctaatctctcactttctcatagcaaaagacaccaaggccattgtttctctgattctccaggccctgtttatttttttttccaaggggtaaaggtaggagctctgccgatttcattaaggatattcggctctattaattgttatctgcagctggttagccatgactaaaatttaaatctaatatcttatcagcagcagtagtgcagctgactggagaagtgatgatacaatgtaaattaccctgagattatttccaggcttaccttgattatgcttggggagagacattaccagggagacaaatgatatttggggccagttccctgacggttccaaactctgtcacaccatgtagctgtctttttaccatgtcaacagctagaacatatgcaggagtagtaaacaatattggtaccaaagcatgctgggagtgggttgagaaatccagaggttctccaatttccgctctgcgttggtggacacactcttgttgtactgtgataatctgtgatgacttgttccgcagcagtttcttacgcatctgctcttataagctgatgatatctgcgtgaactggcaaaagaactaatccaactatttgcaaacaaatattcaacatttacacgacacatagctttgcttagtttctttcacccttcccttaggagtccgctcggtttagccaagttattgcattctttgtacccccacccatgtaaccgtctcggagtgtgtacaaattcttgctgttgttattgatgttgttcttattgttgctgctatcctataattcaccaactcgttttactcattatcatcgaacaaatccaacggtaaatcgatcatctactgtagaacccgatccggatcatccaatcgaatagcaatcagctccggttcaggcagccacaaatcctccgctccaatggcgagatgatcgtgagatagatatgggatctcgcggccactgcagtgcagtgagctagtgcgccgctgatgtggcaacaccttgggcgagttttaattagtcggaaatttttcttcaaactttcaacttttttatcacatcaaaactttcctacacatacaaatttttaacttttccgtcacatcgttccaatttcaaccaaacttttaattttgacgtgaactaaacacatcctcaagtggacacagctgctttagctgggaaaaaaagaaaagaaaaaaaaatctcttgcgccttgtggttcacatcgatttcacgcgcaatttgacggatcacgcatcagtgctgctacgtcgtccacatagttaatccttgcacagctgctgctaattaatcagatactcatgagatcacaagctagcaacgtttatagatggcggattttggatatcgattcgccttcaacatgatctagacatgatgaggcaacaaatcagacaatcagtaattgcttctttaagacattgaattttaaaaagggaaaataagaaaaaaaaacaatgggattttaatatgaatataagtatatatcaaaaggaggattataagacatgggaaaaatacaaaaacgaatatttgattacatcgcagaaaaacatatgaatcagatgagagagaataaattttcaaatgatttgagtttttactaacttttgtctaaaatctgtatagtatcgtgcattctatagaaattttaacgaaaatgataggatttaattctttgtatcaaatacatttaaagaaaattcccttataagtttaaaatctctaatttttttatgagatatatatgggcctaaaccgatgagatatatgtgaagattatattcaagtcaaactcgctatccgacttgttacaacaaatcaaagttgtacacctttcgtctaaaaaaattaacttttaaagataaatccaaacatgtagtggaagttttttttatgtgacaggaagagtacgtgggtacgtgtgaaggtttggtaatagcatctacttgctaggattaacagaaacaataacaatactgtcttcgttgacacaggaaaggatcagaattcagaagatggatatagacgtgccagccaggggccccttgcatcacatgccgatgcatgcaaataatgtgtgtttgagttggtggctaaaggcgccaaattcatcggtgctgcactacactgtagcgctggcagttgcatttgcagccaaccaagtcaaaaaaaaaaaaaaagatggcatccgcaccttcgaatttctcactttctcctagcaaaacgcacaagggtccgtttgggatagtttctaactgttgcagtttttttcaatcaaaagatcttccaaataatttattttttttagattttaagaagatatagttatagaatctagaaaataaactagaatccagaagctggaaaacccagcttttttttagtttctgagaaactggctaccaccagttacttttcagaattttaagctccctaaacagtcctgaaagccggtgcttctcagattctccaggcctgtttagcatagattttcggctcaattgtcatctgcaggctagaataagacatgtgttcgctgtatagcaaaaatcatcgaggcaattaatctcgcgtgaaaaacatatatagtaccgatcgatatcggattaattagttcatcatattacttctgcttcacgctttgggtatcactatcagcagttaacaacaccgtgtgttaggtcagttgagtatacgcagaggtgatcaagtacttgatcaaggccacaattaattcgagacactgttgggtgagagtgttgctacagtgctaaatgatacctacccactatacatgctccatcaaacagttgaaaggatcataacaaccagcttaattaaggccctgtttggaacattagctcagggctaattttgagagctaatgtttagtcatgaattggtaggctaaacattagtctagggtggtatgtttggatccatgggctaattcaaggctaaaaggtggaaagggtaaaaagagaggagagagaaggagagacagttgcttttttatggtcccacacaaaattagcccctatagcaccctttggaggggctaatgttttgaggggggctaattcatattagctcaaaattatcccacttgtttggatcctgagggttaatttgaggctaaaaggtgagggctaaacattagtccatagaaatttaaaaaaatttaaaatataagtcacgtataaattactattcatattatcatctgataacaataaagtcctactcataaaaaaatttaaataagacagacgatcaaagttggacacgaaaacttatatttgcgcttaaaatgggatggatagattactacttatatgtaagtagagtcaacaatgaagccaaagatgtctcatggaactaagacgacgaagagcgtatatttggttgttggttaatttgtcgaggtgtgttttatgttcaacagtggtggagccagaattttttcaaacctagggctcaattagttgaatgtataaagttttacctttatcttctagtttttaaaaatttaaaataaaatttcaataaatatttaggatcaggactagtgctacagccctagctgccctactcgtgtctccgcccctaatgttcaatagtagcaacgtctgcgatgaagttcagatgaccacccagtcagcccgggagctagattcactactaagcatagaactaacaacttttctatttcgtatacagctaattataacttaaaacccgttatacttattaatgataaaaataatttatgtgtaatttttttatatatgtgtttttatttactcaaaagttaatactataaataaattacaatgaaaaaaaatcaaaatcaactttgtaattaagttggagtagatcctaatcaaaatcaatgtgagttggaaaactcaactaaagaacttagccttaattgcttttctcgtttgatctgattccgtgttctaaccgcccaagggaaatttaatcatccagccctagtatcattgttctgaatctctctacacctgtaaagtgatcaaggaaattaagaaacacggtgcactgatgcatggttcatcaactaactctcagggaccagcgatgatgcagacgtaatatactccatcatgcatgtgatactagcaattctctcttccattcactctctcgtctagtacatttgagttaatcagtcagtttggaatcactttacaacgaagttaatcacagacaaattcaacatgcttaaggacggacaaagatgattatcaaagacattaaactactactctttgtcatctgaggatactgtagttttatactgcaattgcagcaacattatactattaacgagacctgttttgtcattgcgagatccactccaaaattttcaaatgctcgtggttttgcaaacaaattgtaaccgaagacagacatgggtgtcagagctgtcgccgttggaaggtgacatgatcgcagccgtccactccatcggccgctggctaaccaaccaaccccgtccgccgacatgctgctgtccgcctcctgccgacttgttcttgtcttcctcctatgctcttaactctgaattttgttaagagatagaaggacctgtagtaattatttatcaataaaattttatcaaatttgtcatatcaaacatctcgccacatatttcccacaatcagagccctttgaatcgtaggaatgaaaaaacggagaaacagaacaaatataggattctgacaggaatgtaagtgtaaaacagtggatgcaaaacacaggaatgatcgtttgattggatcacaggaaaagcacaagaatcgaatgaaagagatagactcaaagaattcttaccaagaggttgacctcttgctaagttcccttcaaaacctatatgcaataagccattccataggaattttgtaggatttgaaaaacttcaatcatttgaatcaaagagctacataggaaaatttcctataggatttcaatcctatgaaattcctttgattcaaaggggccctcagtttattggaacgggatcttgtcacaactaatgctccgttcgttaccaggggttcccaacctccctccctcgtttttcgcgtgcacgcttttcaaactgctaaacggtgcgtttttttgcaaaaaagggtaccgagctcgaattcgcctatagtg

SEQ ID NO: 43641 - DNA, 1200 bp, Oryza sativa
cagtctaagtgcttctagctatgaagttaggcatgtatttgtctttgtactgttaggcatgtctttgtactccgtatatagttggcattattctttttggatgaatggtgtatgttgtaaccaggtatatttctctaagggtcctttgaatcgcaaaaataaaaaactgaggaatagataaaaaaacatagaattttgatagaaatacaagtgtaaaagatatgattaaaaacacaaggaagattgtttcattgaagacaaataaacgcatgaatcagatgagagactcaagaaaaatttcccatgaggtttgacctcatgtaaattttcctccaaaatctctatcaaattatttcatataattttaaaagacacatagaatttcatagatttttttataggattgaaatccccaattttttttatatttttcaaactaattaagggcttctatgcgttaaacttgattaacataggacatgacagattgtagcaagttgttaccggcaactaatcagacccaaaatgccactagaattcgcctctccagtttaattaggatcaaatactagtagcactagtttacagtacacttcagtccaacaaagcgacatgtatcattttgaaacttttttttaattgaagacccaacatattattacttgggtgtgatttcgacatgaaactaacgattattttggtctatatgattataatcggttgcttcttctccaatccgtgtccagctttagttctcactcgagctgtcgtgatataaaaatcagctggattgttagagcagaacacccgttactaaaaaacaagggcaattttcttttttcgtccaagaaaaaacacgaaacagaaaaccgaaaggaaagcgacagcaatcagcatccgatgcattttcttaactagatgcgattgcgtatcgtctatgttaattaaagtgagaagaaaatcaaatcccgtcattaggcggcgaaaaacgagcgtcatttgatttttgttttttgtttttgtttgtgtttggcgtagccgtgtggtgtttccaacacgatatcattatcaaaactagtgcgttctgctccgccgtcacgagctgaagatattgacctgacctgcaggatctcaatctcttcggtgcccggctggctggcaaaaggttactttctggcaagcataatactccgttcttcc

SEQ ID NO: 43642 - DNA, 4346 bp, Oryza sativa
  unsure (1)..(4346): unsure at all n locations
ggctgcgaaaagtttactttctggcaagcataatactccgttcttcccaaattaatcattacataataaaatttaaaatttctccaattgatcgtcatataactgaatggacaaagattttatcaaaatacaattaatacatgatgggagaatatgtgcatgctaagatacaattagcatagtgttttaatcgatgcatgtattgtggaagaatatgtgcatgatgttttaattgatatgatttaattatccttagtcttggtgcataaatatatatgatgatcaatttatgcatactattagtacagtatattccttcctcggtttcaaaatataataaacttttcttttaaaaaaaacagattttattctaaatataacaagatgtaaatgttatttttgccactaaattacccatactacacgtactattctttgactttattatagtccggtcatacacctcgccgtttcaagaaagcaaataagtatttttactctttttaatactcgtgtaatcgtataaaaattattatatttttaaacggagcaagtactaatactatagtgggtttgttgtttgcttcagctattttgcgacaaccatcttctagcggctgcagagaagttgcagccgcaacaatatgctactatagttgaaatattcaagaaatcgttcggcatttaaatcgagcaacgtcaacaaaaatgcttcggaagaaaaaagaacaataaaatgccgcatatgctgaacctgaagggagagaatatatcagatctttcattaattgcaatggaaatgtaccagtactactctcccttttttaaaaaacttttaagaaagatttcaagtactccataaatgcaaatatgctcaagtgtatacactttcggcaccatcatttcgtttatacgttgaataagccaaacggtatatttgcgaacaaaaagtaatttatgaatagaatttttatatacgtgttctttaacattttaaaagcaaaagctgaaaaataaacttcgatgaaagaaaccccaaaatcagtttcaaatttaaagttgaaaatttaaattttagctgataagtataagatgatgcatttttttccatggccacacatgggacacagagatagtgaacacagatgatcatagctgggaactttcaacgccacaagtgcagtgcttcgaactttgaagcagccaagagagcccccccaatgctgtccattccctccatatttaaacgcaccccccgacgtggtacacacatgacactgacggtgggcccatacctaaccgccgcagaactggggcccacccggcagtcacccgtacagtgctaacgcaagtagagcaagctcctcgaagcaacagcacaactgctgcatgagtgaatcatggccgatgaatgaaatgaatgaatatgatctgtttggatttattttttggggggtcaaaacagccgcaaaaatagtttatagtgttcacacaaagcctgctcattcttactctgaacttgaatttggaatccatccacaagaatggaccggattgacttctatccaccgaaattcagccgtccaaggtcattcatttggaccccaactcccaaagggtggaactcaagtttccttccaagttccaagaagcagcacaaaggtactcccgcgctaataaacggtgtgattttttaaaaaactttccatgtataaatttcttgtcaatttttttatatcaactttataattattgattcatttatttgtactcccttcgtactcgtaaagaaagtcgttatggacacaacagaattttgacttattgtttctataaaaatatttattaaaaagttatatatgtatatttttatgaaagtatttttcaagacaaatctatttatataaattttatattttcaaactcgacaacctaatagttattcatgatttatattcccaaagtttagcttaaatattgttctagacgacttcctttacgagtacgaaggaagtgccctcgaatggtcattacaaaatcttttggatattcaaccattttagggccgcatcaattggcctaataagacaaagcaaaagctaaaatttgaattttcgaagttaattttaagatattttcaacgtaatttgttttcagtattgacttttaaatcgctatgaacaaatgtattaaaaaaatcaataaattattttttatttttaacaagacaaaaagacttacggagagtatggtcctactatttttgacagtgtgatcttgaccataggtaacttcatagttaatttttcctggcatcaactagaattttgaatttaccaagaaactttcacttgaggctatgtacagtctgatacgttggcgttccagtccaagtcttcgcaggggggacaagctacgctgaattcagcgaaaagacagaccccaaaaggtctttgagcctgaaaagcagggcgcagagacccaaagtaggcagcaaacatcctcattccgatggcagggtagaaagcaatttgcatttcaaccgaggaaacaccaacacaaacagcaaatttaggggctcaagatcaggatcggtattgcagaaactcatctcggattggcagtagcactatctttacaagtttttttgacaaaccactaggaaaaaaaaaccagccatcgtgatcaaaaggttaaaagagagtgcaaaccagcaacacagctctcaagaagtgtttgtggtgtgtgtgtgtggcactggaagcaagttttgaaggaaagccttattgctgtttatgtacttggctggactaactttagccgaaaaaagaagaaaaatttggatggaattgggagatgggagtctatgatcccttggtgctggatgatggaattggtgcctcatcttgaccaattccggttgttgttgaagttgctgttattcctcggcctgccattaggctgccaattccggttcgcttgtttcggcaaattttgtggatccaccatttgtatagttctctgcttctttgctgcatttacacaaaaatataaccatgactcgtcgcatatagaaactcaaatcaatgaaatttactgatcagcaaaaaatagtagtagtactataatattccaaacagaggacaagatattgtggttcaagtaaacaaattccatgatccagttgatgttgcaacaagtgataatagacccaatttcatggcggaacacataccgttatcaaattcttggtagccttcctgaagttttctctttgtcacctctagctttgcactattcgtgagttcaagctttgcattcttcgcgagttctagctttgcccgaactgaattttcatcgtgatggctcgccgatttctacagccatggcaaagaattaagacctcaaacaagcatttgcatcaatcaaataagcatgtatattttgtcgataaagcaatatgctcacatcagatggcataggttgcgatctgccttgagctggcgaggcatcttgatgctgcttagtcctcggttgaggtcgcccaggaccggactctgggtttgagggccttgcaagcatcgccgcgatgaattgctctctcgtctgcccattgctcagttcctgtggtctcgactgcctcatcgcagattgttcttgcttccagctctggtctggatcatattgctgggccattggcggcagcggccttctagctggttcttgattccttgtatacagccggccattatccctgccgccattgctcctcgtgtctacagataatccacaaaacaatcaagatgtcaaacaccagctaagaagccaacaaccatcacaaaaaaatattgaacaagggtctgatcactcacttccatcatcatccataccatcgaagaacttggaaccttggttttcctgaggaaaactcagagggagctgtgtcagatcataccaaccagatatgatttcggatggatgtgccgacaattccaattacctcagataggcggatggaagtgctcggcgtagcgaagagagcgccctcatccatggaaggagaagagagcccccgttcatcctgctccaagccagagggatgcatggattgaggagtatgatctgtgtatcatatcattgcagaatgcttaattctctactaaatcatgatacagaggttgaaacttagaaacgatgaactgttcttgcttgcttcctacctacaatggcgtcgcggctgctcatccactcatcgactatgcgcttccaacctctgcattcgattcgcaaannnnnnnnnnnnnnnnnnnnnnnnnnnnnnnnnnnnnnnnnnnnnnnnnnnnnnn

SEQ ID NO: 43643 - DNA, 3589 bp, Oryza sativa
ttgtgcttccggtagctgctcaccgccttcccaatctcggtaacctgcaaagacgaatccgcatgaacacactagtcaacacatgagcttggtttggcatggctgcggcggcggcggcggcggtctcaccgtcaaggtgtccaccgtgagctccagctgctgcagtcgccggagcagctcgagcaacgtcgcctccgactgcatcaacatggcagaacagattcagtacgagaagtggaggatggtgagagagagaggaggaggaggaggaccttttcttggtcgttgaggaggatggccttgatgcgctcggtctcggcggcgacggggtcgtcgtcgcggcgagggacggcgccgtcgtcggtgatgacctcggcgcggtcggagctacagaggctagggacgctggcggcgccctcggggtggaggaggagctgggccgtcggcgcgtcggcggcggcggcgcctccgcccgcggggggccccgccggcggcgcgccggggaccaggtgcgccgtgtagaggcgctcggcgatggcgtcccgcctcgaccggagcgcggcggggtggtcggacgccgcgacggcgatggccgcgtcgatggcgtcgaagatgctgtccccggcgccgcggaagaagccgagccagtaatccatcgacggcggcgccatcgccggccgatcgccgccgatcgatccgccgccaagaaaccacagattaatttacgttctctttcgattcgattcgatttgattctgttcttccgttaaaaaaaaaaaaaacaaacccccagagaaactcctacagattgccactctgcgacgcaagaactcgccacggattcgtgggcggcattaccatctatctactcaacgcacgctggattggagacgcaacgcaaccaaagtgaagaaagaaagaaaaggtttttccttttctttttcttggtgttcctgggtgcgtgactaaattctgattgatccctcgtctcgtcgtcccccctaccctgtgcgtgcctatctatcccaatccctctcgctcaccaccaccacgccgagaggtagaggagagagaaagagaaagaggggacacgccaaattgccaaccgagagagagagattgtggtggtggtggttgcgaacttgcgattgctcgcagattacgagccgcaatctcatcctgctttgctccagccgatcagctgtatcacctcccgtgtggccgtagcaatttaccgtgccggtatgggaatgtgtttttcttacttgctctagctattttttttaagcgaatcggtgagccgctaatttcattgaatatagaaagaataactgtacaaaagaaataagctacacacgcacaagatagatcttttggtttagactaacttgaaattaagccaatcgctgagacttctcgcgccgccaaggcccattgctctaacttgagcttagcctacaaacgaaattgctatgggcacacacggattattggagtttgaactgcttgtgttgtggggaaaccactggtggaagtgaggggaactgtaggggagagagggagagattgagaaggaacaatgtagctatgtaaatggaatatatttgctttactttctcgttagtgcgtaactttaccacttgtcggaatccgctacatatcgggtattgttttggctagttgctgtctgtgttgcaaattaggaatttttgttgaaagagagttaacggtcgaagatagtcattgatgataagtataagacgctggatgtgtttgattggtttctcatacttgtctttttcgtgattagtgattgtactatggtaatttctcattacctgtttgagataaaatcgagaagaaacgatgtagttacataaatagaatatatttgctactttcttcttagtgcacaactttaccacttatcggaatttgctacatatcggctattacttggctagttgttgtctccgtagcaaattagaaattcacgtactcagtgagttatttatcagagatagtcattgatgataagtatgaagcgctcgattgatttatcttgccttttttatggagtagtgattgtagtgtgataacacctttttgagatataaaaaaattgatgtgccttttaccacttgttgaaatttgctatatatcagctaattagttgttgttcgtacaccaaattagctaggaattattgctctcggagagttaccgatcaatattgatgataattaagtatgagatgtcaggtgtgtttgattgatttatcttacttaccgtttttatggagtagtgatcgtatactacgatgatttctcatcacctttcagataaaatctagtaagtctttttaaagagaaaaaagaacttgtggtgtgtgatcaaatggcgtctaaacattcaagacaaatccttttctacacaataagttacatatgctattggttcccgccaacatttcaatactagattatttgtctctaatttgtgaaaaggaatctactgaaaaagaaaataacaggtgagagagcacatgtattattttagtggagctaattcatttcataacaatttcaatgtccattctcgcataaatgcggcatttaatttcgtatatttggagaggaataaatcatgatcgagttggttaggatcagaggacgttaatatcatccaattttagttggtccagtttgtacgagggaccaccgtttgccgaacagcaaacaagttcaattatacttgtagtatattccaactgcaaaatgtactattatttttttttgcggggatgcaaaatgtactattagtagtacgataattaggattaataccaccgtgaatatctttgcatatatacatggacttggttagttttttttttcatgcggtttgacttcgtgcatcttctgctcaacacacagtaatggacgcctaaggttaaaaaagatctgtagaagcagtctgtcaaacatgacatccaactatccgagaagcaaagcaatgctagtactctgctttgaccaaaagaaaaaagaaaacgaaatagtgaccattgatcaaggcaaaaccagatgcaaaaatgctggaataccagtacagtatatttcagtactatattattatacttcatccattttaaaatatactaatacaattaaacaatatcgagtgtaatgaatttatattcgttgcagtaatagtttagtgtctaaatatggtgttagataggagtaattaggagtggtagtacagtgctgtataaattgatctttttacagggaaacgaaccactgcatgaaaaagtgggaggaggccgattagagcaggtacaataacaggctataagccagctgcaaatatattttaaggagataactgaggagagagaagggtagtgggctacagatttgtagccagctgtagcacgaactccaagacgcagtgtgtgtatgataggtgggaccatatattaatagtgtagtatgtaactattgtataaatgagctattagattggctatagatgaattggagctggtagtgggctatactattgaacttgctcttatggcgag

SEQ ID NO: 43644 - DNA, 787 bp, Oryza sativa
  unsure (1)..(787): unsure at all n locations
nnnnnnnnnnnnnnnnnnnnnnnnnnnnnnnnnaatgcggagagatcgataagcggatgtgactatgattccctcgttaaatagttgattgattgaattatataaccgctttcatcccatttgattggggaaataaatcgcgctcatcgctcatctatcttggatgaaatagttgattgaaccctcttcacctcttatgcttcaggctgttgaagtcgtgaattatcgcatgcaactttgctgtaacaaatgtcatttcaaaccaggatttaacttaaattacaatatagtataaatcacggatgtagtaaactaggatatgtccatatcccatcaggctctaggttgctatattctgagacggaaggttctaggttgctatattctaagacggaaggagtatgtggttttgtcatcttttggaactatatttttcaccattctcattgtaataaagtttggcagaacagacaaatatacttctagaacagtttcaggcattttcattctcatgaaagctgacataaatccaatcacaaaaaaaccgatcagttgattggaactgtcgtctgttcgggaggatgtaataatctgaaataatgcggctagctcatgtctattgatattatcgtctatcacaattagcagaatcatacaagaaccagcaatcagaattatcaacagcgccagcacgccgcgcctcaataaaatccctcagtttggcgtctgcagatctttgaacaatatctggctataattcatgatcgtttctcataggcattcagaa

SEQ ID NO: 43645 - DNA, 849 bp, Oryza sativa
ccaacaggacggcgccagagaggatggcgccgtcctcctgccaccgtggcgcacgcgaaccgacgtggcaggaggagggcgccagccatgctggcgccgccgcctccattcctgtttctctatatagagttgcaacggggtcatttttattttattttttacggatgttttttcacacttaggatcacgatacaaccaaccacaaaaaaaatttaaactcgaactaccacttaactaaggctgaaaatagctagcataccacttagtctactttgcaccttcactaaaattagaccataattcctttagtaaaactctttgatcagcatgttaaacataatgcactctaccactatatgaaattacttaatctaattcaaaatataaccacatgaaatgacatatataagttaaacagtacatagagatgcaattttttttatttttatttcatttttttgatatttttttcacgcttaggagaacataggaaccaaccgtataaaaaataaactcaaacggataaaatatgtgacttgtagaattttccaaaactctaccgaaacggacaaaatatgttatctattaaaataggcgtaactttctcatacgcactcagaatcaggcaaataatatatgcacggacatctacagaaaatgttacatccgattcttcccagctttgctgggttcggcgatattaaaacctccaaattccgcttgcaagattgtgttttcgaggagagaagtaattcggtagaactttggaaaattccacatgccacatattttgtgcgtttgagtttattttttacatggttgattcctgtgagttcctaagtgtgaaaa

SEQ ID NO: 43646 - DNA, 912 bp, Oryza sativa
ccgtagtagtaggaagttgggataattcttgtctgtttctgtctgcacttcgaatttttcttcttcggattttttttcattttgattgaattttcaggggagctgaacttcatctgcaaattggaatattcaatttgatttcagggcgtttgggacgcatgatttttcacagggttctcatgtagtgctaacttgctagtaggaagttgtttgttcagttgtgttgtcagtcttcacaagccacatgtgtggttatttataaagctgaagagttcaccaaaaataaaaaggacattgcgtcgcctctgagcatcgtcaagttagaagttaataagagcatcgtcaatcacatggttttaatttttttctcctctttttttttcaaacaagagtaatagatgtggttagcagctgcatctcgttggtgctacgcatgtgctcggctttgacttcgcaggattgattgaatcgatcccgggaacagcgggctatacatgtagctagcgcggttggtatctgcaaatctgctaacataagtaagagcaagtttaatagtatagtcaactactgactttaaattatctatatctaatttaatagtttgtttatattatctataaaccattaatatatggtcacgcctcgaaccttttagctctgctcatttctagtaacggaataggggcgcagcccttgatcaaaaaaaaatatggtcacgtctctcatacacacaacgtattggagtttgttgtgcagttggctataaatctgtagatcgctttccttctttcttctcttctctactccacatgtgcttacaactgactttactccctccgtttcaaaatgtttgacaccgttgactttttagcacatgtttgaccgttcgtcttattaaaaaaattatgaaat

SEQ ID NO: 43647 - DNA, 4488 bp, Oryza sativa
  unsure (1)..(4488): unsure at all n locations
tttaagtgggagtatttagacatcgtgggtgtgggtatggggcaagagaacccgatgtgtcgggtgggtggagtgtgtactccctccgtcccaaaaaaaaaagacaaaccctggtttccgtgtccaacgtttgaccgtccgtcttatttgaaaaatcaatgaaaaaaattaaaaagacaagtcacgcacaaagtattaatcatgttttatcatctaacaacaataaaaatacgaattataaaaaatctcatataagacgaatagttaaagttggacacgaaaattcagggtttgtctttttttttttgagacggaggaaatatgtatctaccagtttcatcaagccccacgaatctcggagtcgcgttgcgttgcacaacggagcaccacgaggcaaatactgtaggctactactacctgcccaggaaagagttgtggctagagaaagagtttgtactcaaagtctgaaaggccacatcgaaggttggaataatggagaaagagttgtgaccagagaagaataatggagagtgccaaatatatactatactgaaaggccacattacgatgctaaactgctcaggtgactcgctgacagtagtacttaggacacctacaatggttatatataggctctctacgagagatatatgtcagcatattttcctacttggaagagattaaatgaagagagagagcaaagctatctactaacctggagatagtctatagagaaaaacgaggcaatggattagagagctatagatacccatgtagacatactattgaagtggtttactattaatctagtatattgctgagatgtacatgtttttatagataataccttactttaccattgcgggtgctcttagtactactaatatgcaatttattgtgcttgcacttagagagtaagttattcctgcaggggacggggcattgcttatcttgccaaggaaaacaaaacatgcatggaacacgttaacaaaatggaccaaccgaaggacatgcgtgcgtgtcgcccacgtggtttcgatgggaccatctctttcggtggagaagaaagcctagtacagtagtactagttcttctaagtgcaagtttaatagtatatccaactactagcttcaaatcatctatagccaatgtaatagccaattcgtacaatagttgcttactatactattaatacctggtcctacctgtcatacacacattacgtcttaaagtccgtactggaactagctatagatctatagcccgctacttttctctctctttctttacttctttaaaatatgtttatagctggcttatagcctgctattatctactctaacactactattcattatttgctccgcacgagtacggctacactagtgtattcgtggaatccgctactcctacgtaccactgagcgtgtgatccgccgccgtttacgcccaacggttcgttacgctttactacggagtataaacaaaacacaatgaaccacagttgctgagctgctgcgttccgtgtactgctactactggtctgcagttttcagtttttcttttatagggtttgcagttgtagttagttgagctcttgagcgacactgaatttgtcaatctttgactaaattttgcttacattataaaacggaaatcatatcctctaacattaaacagtaatattaaaaaaacattaaacaataatattgtaagctgattttgtgtcgttataaatatagcaatgtcccccattccctgaaacgacgccccgccccggggatggaagaggcttctctgacataaagttagggcctgtttagcacagctccagcttcacctctcctagagctagagctcagccaaatagtttcagctccactaaaactgggagtggagctgggtgaagctctctcacaaaatgtactagagttgtggagctgggtttaggcagctccacaactccactctaaatttaactcttaaaattatatttaggagttggaactgtaccaaacagacccttagagaaaagtggggctctttcactttacgttagaggagctccgtccccggggacatggacggttggatgcggttttgccgccaatctcctcgcgctgcatgaccaaagcttcggcggcggaaacgcccacggcgcggctcggctcggctctgcggaaaccgggaaaactttcggtgttatcaagggcaaagatgccggtggaatcttagcccgtggcggtggcgtgagtgtgaccaggaagagagagaataatcacgatgcgaatgcgattgggcgtggacgagccggagccgtgtgtccatgggctcgattcttctattcaaggctttatatgggccttatcgaagcggggacccagagagaaattaggagtatcatgggccgagagcccgacagagcaatgggctgggccctttcgtactgtagatttaacttaaaaattaggagtgtgagtctggacgcaagttcttttcttttttttcctttttgcaacttggaattttcgatgtgtagactagtagtggtacgcacttgtaatagagtgggttccctctgaaatcaaggtttacaaagttaccagtattatagtgcttcctccgttttacaatgtaagttattctagcattttccactattatagtacttcctccgtttcacaatataagtcactctagcatttctcacattcatattgatgtcaatgaatctagataaatatatatgtctagattcattaacatcaatataaatataggaaatgctagaatgatttacattgtgaaatggagggagtactacacaaacgacgcaagaacccagccagtgttgaaacctgctcatctggggaactcaagcacatggtctctaccacaaagctctaatttttctcttgtcattttgtcattgttttgtctttacggttagatcaatagtggtccttgggttaggatgatataaagcttgtctgctcttattctgaccattggtgctactgctatcctgcatcaggtttccttccaactcccccctctctctgaagctctgggactttggattgctaacagattgcagatatgtagcagtaaaaatgcagtatagttgtattggacaaattaggagtacacatggtaggacatagagaatactggttcagaaaaaaaaaacactctgcacggcattaccgattatcatgtaccgattgtcaattatggcactataatggagaatactggttcagaacacctgcaaaggtactacaactactgtacgtctgtcacatggatcacccctcaggtgaaaactgaaaaccatcttggtaatacactgtggatttttcacattttggtccttttgaaaaacttatttcgcaaatagacccctagaaaaacttatcccaaaaatggtcctttttgggacgccagagtggctggcgccgtcgtccaacaggatggcgccagcctctctggcgccgtccccttgccgatgtggcggggcgatgctgaggtggctagggagtgcgccagagtggctggcgccccccccccccgaaattttttatttttgttttatttgtttgatatttttttcacgcttagggacacacaaaaaccaaccatagaaaaattgggactcaaatggcacgttaannnnnnnnnnnnnnnnnnnnnnnnnnnnnnnnnnnnnnnnnnnnnnnnnnnnnnntaaggctataatccttaggtatttgataggattttataggaatggaaggaatgaggcatataggaaaaaaatcctaatgtttgaattcctacaataatcctataaaaatcctttaaaccgaatgagcccgaaagagagagagatgatgaagaagatgaggtgacatgaaagtcgctgacacgtggatcccatctactgacttagcaagttaaaccgtggtcaaactgtcatgtcagtagaaaccacttccaaaacgatcgaaggagttgattttcactactttccgaagacaaaaaaagccttccgggagcggcgctatatccggttttgcagttgagggagacgatttacaggagcaagagatgagggagacgaaacagacttatttgcctctactagaacagcagcttaggcccaaacagcggagcgagaccagtcatggcggcgacactcgcaggccgccgcctcctcctgcagcgatccgcggcggcggcgggggggaggtggcggctgctggggacggcggcggaagcgtcctcctctccgggagggagggaataagcgggcgggggagggggagatgatatctacctgaagaagccggcggcggcggcggcggtaacgacgcgggacgagacgtcggtggcgatgccgatgtcgttcatgacggggtcggtggtggggaagcggttctaccgggaggccaccgtgcggcgcgccgacgacggcaacgggtggtcggtgatgctcgactaccgcacc

SEQ ID NO: 43648 - DNA, 1155 bp, Oryza sativa
  unsure (1)..(1155): unsure at all n locations
ttttcaaaaggaccaaaatgtgaaaaatccaggtactacacttgggctgtgtttagtttacatcaaaattagaagtttggttgaaattggaacgatgtgacgaaaaagttggaagtttgtgtgtaggaaagttttgatgtgatagaaaagttggaagtttgaaaaattattttggaactaaacacggcgttgatagattcagaatttatcctttcaccttcttttgtcccacattgatctgccttcgttgccattatttatgtactaccaatgttggagtacatgattgcttcaagttgaagtgttgaactcagctcagccagaaagatacagaacctgaatcaccaaatactccaatgttggagtatgttattggaacttatgattgttatcagttcaggacatcgtagataatggacacccatgacttctcttcaatggataatcatcctcttcttaaatccacggccatttatgcatgattgcagacatgacaaggattctttttttttttgaagacacatgacaaagattgctccttgattattcgacttgagtcgtaacatggctaatcagctactgtactagctagagatgtactcctcgatgcttgtccagtttcatctctagaattatattttaggggacaaagagaggatatgctcgtagattataatattattggtagaaagcaactgaagcattttatagtgattggctactctagtatagctagtagtaattgtatgtcttgtgtcgaagaaatgcgtggtcgctgttatggtgtgacatggatcgatcgatcgatcgatcggatcaacaccagcagctggcgattggcgagcatggcggcttcatgaccccggcgtttggatttatcaacaacacatggttaatttctaaagagatattgttcatttactcttaagctaaatctataagatgtagttaaaatttaaattttaaaactgatttgatggttttttaattatagttttatttcttttaataagtgttatagcttataatcgagtgcaggcgaagcgattgggctagcacggcattctcagagcgagtacaatagnnnnnnnnnnnnnnnnnnnnnnnnnnnnnnnnnnnnnnnnnnnnnnnnnnnnnnnnnnnnnnnnnnnnnnn

SEQ ID NO: 43649 - DNA, 6356 bp, Oryza sativa
accgcgctagctacatgtatagcccgctgttcccgggatcgattcaatcaatcctgcgaagtcaaagccgagcacatgcgtagcaccaacgagatgcagctgctaaccacatctattactcttgtttgaaaaaaaaagaggagaaaaaaattaaaaccatgtgattgacgatgctcttattaacttctaacttgacgatgctcagaggcgacgcaatgtcctttttatttttggtgaactcttcagctttataaataaccacacatgtggcttgtgaagactgacaacacaactgaacaaacaacttcctactagcaagttagcactacatgagaaccctgtgaaaaatcatgcgtcccaaacgccctgaaatcaaattgaatattccaatttgcagatgaagttcagctcccctgaaaattcaatcaaaatgaaaaaaaatacgaagaagaaaaattcgaagtgcagacagaaacagacaagaattatcccaacttcctactactacggagtactaccggtggaaggtgtggggtccacgacgcgccccgcgccatcaacggaacggtcgcgaaaccccttcccactatcctccgccgtccgatcgagatcctacggcccgcagcgccgcccggagggaatctcggggggagcggagtcgagtcgtgtcgtgtccccggatcgcacttgcccctgtgatgactctcacctgacccgcgatcctccggtgggcccactgacatgtgggccccactttttccttggtagggcccacccccgcgtcgccagtcgccactgccattcaaagctcgcacccgctcgcgagagaagaagagagaaaagagaggagagagagaggcaaacccgcaccaaaatctctctctctcccccagatttgcgccacattttcctcgccgaatcagcctcgccgccgtgggtgcagctgccgcgggatcccggcgagcgagcgccatttgagccggctgccggcgggtttgcgttctggaagctccttggtaagacctctagctccctctcctgttttctctgtgcgttttttcttttttagtttctctctctctttttcttttgtgtgtgttttttgtttgttcatctttctacttactgcttttgaatggctggacgattgggaggcagattggcagaaggttatattttttttctctctctctgtttattttgctagtatgagtctgctatagtgcattatttgatgaaaatttaagcaaattatatatatttttgaaacaagaattgtataaggaaattagtacggaattgcactcgcatttgcgtggagtggcgaggtggttagcgcaggagtatatactagcaatgatttgccaacgaacctactagaaaacatgtcccgatagtgaattgaattcatgcgcctttacttcagttttaattttcgtacgagtgccgtgtagccagaagcccagaagaactgtgcatgaattgaatagctctgctatgtctaagcttaagtttacccatgaattctgaactgtgttgtttagtttcatttgtaataaaattgcaaaggtctttcagctccaaattatttttgttgttcgcaagattagagtaactactattttttggctgatgccagctacaatgtttgaaaatttccaactgtacttgatgctacctggtgattggttaaccttttgttccccaccgatcactttaatcatacatgaacgtcctttttccctattccactgacaaatttgcactagtagtttatagctttaccatctggtactactaactgtccttcatagtggaatttaagtgtaacaattacttggtctgtagcctccaatacagatttgtaactttgagtttagtgaccagtattgtttatacttcaatacttgcgacgcatgaggtttggttaattggtttggtggtagcacttgtgtgcagctagatgatactatgatatccagcacttattttgtttgaaaccgaccagcacttgcttttgtcttatatttttattatctatggacactgcattttatttgtactctttcctttttatttttttgatggtgttgacttcccctaatgattatggatgcacattttaaacaaactataattatcgagcatttcaactaatgataatttactgtggccagctgtaaactattgaggggtaaagcctgctatttagtcaaggttgagggtgctgtataaatgacgcgggcgtccacaattgatttcgggcggaagacacataatgatgtcctctggtcagggccattgcgtcctgcaaacttcatcagaaataaattccctacatacaagaagagtttgaatgggatagttatcaaattgacagatgatcaagaaatgccatctctgaaagaggctgttgccaaggaaacagcagacctacttcatcggagtcagcgcctttcagtccgtgagcttgctatgaaatttgagaagggtcttaacactgccacattgttgtctaatgaggtatggaacttttacctgttttaggccctgtcctcctgaatgctctttgacgattggcccaatacttgaatgaatggagttatataaatcaaagttgtctatctggcctcaccttgaaatcttgaactctcaggttaaatggagacaagctgctttattggagcgagacatccttctgaaaaatctaaagagtgtattagaatcgctgagaagtcgagttgcagggaaacataaggatgaaattgaggagtccctttctatggtttgtttcttgttatgaaccatattttgatttttcaccaaggattgttgctactcaatttgtaacttttctaatggtgttgctatttatctttaattgtgttgcatgtgttttcaaaagaggctactattctgtccttttttttccctccaagctccatatgcaaaaatggtgccttttctgtgggctgttttaatagtttggtactttctataggtggatgttttaacagttcagctgtctaaaagagaagacgagttgctgcagcaaaaggcagaggttgccaaaattgcaacctcattgaaactggtgcgtccaaaatttcttgtagttcagtagtgtatgcatgctatgaacatcggtcaacatacttttagcatcttgtgacattcacttttggttttttattgttatagcaaaatgtcaggttccattgtttttaagtgttctctgtttcgctaaattgctagtaaggaaagttgagttcttcctatgaacaatatgcagtactaatgaacaatagaatgcttcttatgttgggactgtattatactatggaactgaactattgaagtactagtggtttcccttccaaaatacagagtgaaatttcagtcacatgtaatcacagcttattgaataacacgttttaggacttccacctgatttcctcaatatggttcagatataagcatgctgacaataattactgtttttttaccggcttcttgtagaatcgtgtttaatatcgccttgggtagatctatccattggtataccttcatgtgttcatcccttttcaatcattgcttgtttttctgtattttcatacaggcttctgaagatgccaggagaattgttgaagaagaaagatctaacgctcgcatagagatagataatgctagagctgctgtacaaaaagttgaacaattagttaaagagcaagaaattgatcctcaaataaatgggaaacaggtaggtggtaggaacactatgttcttttattttattgaaataactatgagatatatgcaacattaaacattgatgtatgaagtcataataaatcatttttgttggtagatatcttcttcttgttacatttgttgtcatttcctacatgtcttaggcactttcaaccctaaacccctaatttccagctgcctgtgtcttgtgattcatttatgctaagagagattccatatttagagttcctctagtttcaagctgaattgtacatatctgtttaccatttctttttgaaaccttgttaggatgaggatgaacttaaggaaaaggctcaagaagcacggagagtgaaaatgctgcattgtcccagcaaggtagaatgcacttattatgtcactctacatgtgaaattgcaagcctatgttgcatacttgatcgtatggtattatggtttctaaatgaccaatttcaagtttttaattatcttttaggcaatggacattgaaaatgagattgaagtcctacgtgaacaattagctgagaagtcctcaaattgtgttcatcttttgaaagaggtatggttaacacatgctgattttggcaatttcagttgtcatttctacagtaggccagattgaaaccagctattgcaatatgaatttgcggtgaatcacaccgtgcactgtggagcatgttgaaaacaaaacaccgcaagagctcaccaattctatgtcaaagtttgcgaagatagaatcatatatcaactctgtagcttgctttctttcttttaaacttgtgcaaataagcagaacgatgccaaagagcgtgtagtggtttgttattgctgcttcatgcctacttttactgtcattgtttttctataggagttatcttgctacttggatgatcagccgtaaaagacaaataatagtgtctttagatcgaatcgtttcttttattctatgttgcttctcaaatctgtgaagttcccaacatgaataatttcggtatgtagagatcaagatctggtatttatttccatgcatgattggctgtcctttttatcagttacacctgcatcaaagctatgaggaaaacgatgtgtcctcgtatgagctggagggccttgaaagcttaggctcaatgttgcgcatagtttcccagagtgatggatatgttgatttatcaagaagtacaatacagtggttccgtgtgcagcctgaaggaaacaagaaagagataatttcaggtgaaactatttccatcaagcaaaacgatcttgtttctacatacgatgtaacactgatgactgttgctacttgctaccgatcttctataggtgccataaagcaagcatatgctccagaaccacatgatgttgggcggtatttgcaagctgagatcaaccattgcggtgaaatctctgtcgtgaagactgctggccctgtggatcctggttagttttcctgactggtaacattaatgcgcttttattattatgacatggctaacgttattttgtcgagcagctgcaggattggtcgattacgtagagactcttctaaggaatcctgaaactgaatataatgtaatggttttccttccttatccatttttgtttctgcattatacctacataatttgttataaatcttgctatttactgagtcttgtcagatattttggttttcataatttcccagttggcatgccatctgctgcttttatgtcaagaaatcattctatttggatgcttgtatcaaatattcagtgtcactaaaaataataaaagaactgtgtatttactgctcatgaagtcagctttacccactgttactagtcattctttaaggacacctatttttgccccttatggcaggttgttgttcttcaagtgaatggaatcaaacagcctaccgattcaattcatgttctttccatcgggaaactgcggatgagactcgcaaaagggaagacagtaattgcaaaagaattctactcctcaacgatgcaggtattctaggcaacacttttagcactcataagatggtgtagaaacttgcttccatctcactgatgatagctttcattccacatcattggactatgatatagtctaaaatttgcgttgcattgttgttcatttcagctatgtggtatgagaggcggtggagatgctgcaccccaagcgatgtactggcaaccgaggagagacctgagcctggtgctgggcttcgagacggccagagaacgcaactctgcaatcatgctcgctcgcagatttgccatcgattgcaatgtaagcaacctgtcttggaggaagaaaaaaacaacaagaagttgtcgcactctgttgctccagctcgaggaattttgtttcttccccaacgttttttttggactgtgttgtgcgcaatgatcacggagtaattaactttgcttgtccgaatgcagatcatacttgctggtcctggggataaaactcactggtgattgatgaagacgaactgtaccagctaaccttttgtacgagctcaagaccctgtgtttggaatcattgtacatctgtgtcggtgtaggtagatactctaatacatatctg

SEQ ID NO: 43650 - DNA, 13490 bp, Oryza sativa
tactctagtgtatgtaactttgttcatgaaactgtttaccaaacataatggactatccccctttctgcttatcttggctctctgtttggagagcttatggtagatggtgcttctcataaaatctcgacctctcttgaataactcagtttttttaattctcaatagctgtttttcgaaatgtaaagctctcctaagagcaagtttaccgcggaacgtgcgtgaagcgtcatcactgttgtggtgccgtgcagcgcagggctcaatactgggtgagttggcccttggccggtcctcggcaagatgccaagatgacctttgggcaagactgccacttgttgtgactgtaccttggaagcaactggctttgttcggtcaattcccatgaggcagggattcgagggaaattattccacacctattgtggtgttgaattattctccctcaatccccttcaatctccctcaaaccgaacaaggtcttaggccctgtttgttttagcttaagattattgtaatctagattattgaactagattactataagctagattataataagctaacataaaataagctgctagctgtttgtttctctagattattatctgtttgttaactgttagccacccattaatctaaaaaaagcacctttagagtggcttaccagattatagtaatttgacttatagattataataatatattataataagctatctgtttatttcagcttacttctaataatttagattataataatactaagctgaatcaaacatggccttaagctggaaaataatcctgggagagcaggtaaaattaatccatacttgaaaaaaactggtctcataggattattttctcttttaaggcctcgtttgaaataaacgaagaaaacacatgaatagaaaaaaaatgcaggaatatgatatagtgtaaagttgataactaagaaattcaaaacacatgatagaagaagtttaggctgtttacatgaaaaaagagagagagagagagagagagagagagagagagagagagagagagagagagacggatggaaggatgaagcaaagggaatcttcctttggatcaaagtagatgttttatatttcctaacaaaatggaggaaatgttttccgaaggaattcaacaaccccattcctttgttccaaacaagctcatagggaaaaaaagatccaaaggattgcaaacctccaaaaatcctttaaaaaccaatgttccaaacagggcctatgcttgtatagctcgcttattactcactgatcagcagggagcatcttccttcagattgctcgtcttccatgactcctctagtcctcttgaacgcagaaattttacaggaattttgcataaattagttctgcacccacgaaaatcctcaaaatttctactttctgagctcactgactttttcacactacagctatttagtatcaaataacttgaacttcacatctatcaagcaagcaagtcaaaagcaggggaaccaattgacttccttttcctctacggacagacaaaactgtcataaacaagtcaacatgtaataacagcaaagcttcccaagcgggagctttaagaaaacactcagtgagcaacagctttttgagccttgtttgggaggatactgtccgggaggataagctctggtgggatctcacggaccacgccgagcatcgaatcgtactcctcgtctttgtgcgcaaacttcttcctcagcatcttctcgagctcaatctcatcgaaggtcttggcattctcggctgcgtggacttgagccaaattgatatagtttgttgctgactgtgcaatgaacgccatctcctcttcagtaagctttcttaggaacttggcaggattaccaacccagacctagcaatgtcaggaaacgatatggtttaataaagccatgcaatgtattaacttaaccataaaatataaatacaaagcatatttaaatcttgcagctgttcacaacaagtgtggaacataaaacatggacatcagtataaacatgcagccagcagctttgtttagtaatcctccagtccccgattacagttttataaataaggaaattcatgcaaaatatgtgtcaacacatcataactgtaaattaagggaaaaatgcagactaaacctctacctcagaatcattcaattgcattattcgaaaacaattaggtatttttctgaacaaagagcatgccaattttgtaatcatataccagcatctctgagaattacctcattacaaaatgttggcagttgattgcacatttctcatatagcaagtgaaaaaaaaaaacttgcttagcaagaaaataggaaggtaacctctccagaaggaatcctggtgttttgctttacaagggatcctgcaccaaccatgctgtgcttttcaaccaccactccatcaagcagagtggcacccataccaacaaaagcttcatcctcgacgatgcatgcgtgtagaacagcactgtgacctggcagaagctttattgtttaggtaggtgcatagcacagtgtcacagtgaatagtccatgcgaaatgaagctcagaattttaactcgtaaatcaatcacaaagcagcaatggaaaccatatttttacgattttatcaggtataaatgatgccatgtggttaatgtcttccagaaaagccaaatcacaacttcaatagcatatcagagtgtatattacgaattaagataggaagtgctctactgacctattgtaacactgtttccaattatggttgggagaaccttcccactgatattagcttttgaaacatgtacaagggaattgtcttgtatatttgttccaactccaatatgaatgctgttgacatcacctgaggacaaaagaatgaaaaggagctaaaatggttatcaccgcaccgtggaagtatccaaagtacaacttcaacactatagttactgaaactttaaatatcaatatgctagggttaacccagtatgtatgacagcacaaatgcctcacaccatgataaaagatcatatggtgtaggaggaacgttatcatgtgaatgaagctgcttgaatcctttttctacttggatttggttgtaaaggagaccatacaggcattggtcaaaaccattctcacctaattgttttcttaagagctactagtatgttactccctccgtttcatattataagactttctagcattgcccatattcatatagatgttaatgaatctagacacacatatatgtttagattcattaatgaatatatgaatgtggacaatactagaaagtcttataatatgaaacggaggaagtagtacttaatgctttatggttgggagaaccttcccacatcatcgttgagagcccaacacatcatcgttgcaggttaaaaactcgaacttcatgtgaagtgtcagttgagagcccaacaatgaaaagatgagtgtactagagctgtttgataaaactgtgcatctccgtacgactggtggttctgtcagttgtctatgtagtaccattcatcataacaatgagtgtactgcagtcagaagcaagtttattccaaaaacaaaaatgtacagtaaacaaggtgtaacaaagaaagaaatgggaaacaaattatcaagacaaagcccatgcttactcacatgtgtaataatactacagtgtatatcgaccaagagtttacctcttaaaatggagccataccagattgaggatccatgtccaatctcaatatcaccaatcacagctgcactgggagcaacaaaaacatccttgtggattctgggctctttctcaaatatgttcatgattgtgcgatgccttggcactgacaagggcatacaaaacggtaacatgatagtcaggctcaaccataaagtttatgtaccttgctaaattcattagctcgtggttattctaaaatgacctatctagacataataccaaaacctttttgatacaatgtccaatttatgctaattcaaggccctctacaagatgcagcatggtggaaatcaatcaacaccaactacagcaccacacctaactagaaggtggaacaaatgacattcttcatgatgctacgcaacagaaaatagatgcataaccactcgaaaattggcatgccaaattgccaatgtgacactcccacaatgggcagtatgaccgcaataaccaatatgcgcaatccttgatttacttgctgcagttttcacacacgagatcgatcactagttgaaaacctggaatgcagaacttcacaaataaccgacgataatttaggctcatttcgagactcctcgaatccagtcaccccctatccattcctaccaatttcttcccaataacaactgccaaattgtcagagagagagacggcggctgctgctgcttacgctgctcgtcgacgcggaggccgccctggatggtggatccgaggcggtccatggcctgccccgtgccgcggatccacttccccgccgtgtagatcgcccgccccagggtccccatgcctcgtcctccccgcttgctccctccgctgtccggacctcgccgccggccgccgcccgccgccgaggtgagaggtaactgtgtgagagagagagagagggagaggaggtcaaacagcttttggcccaggttttttatgggcctggatccggcccgatcatcacagaggcctcgcggcctattgagatttgggcccaggtttttatgggcccagcctgttgcgcgaattctagagtgatcacggccgtccaaaattcgattgaatttttttctttatgtttcaaacgattaaacagtactccatccgtcctaaaatataagtatttttagcatagtatcaagtcaaatatttgtaactttgactattaatagcaaaagaataaaaaggatcaatcatgtaaaattgatgttactaaatttatcattaatgtaactctttttatttaaaacatattacttttatagatattattggtcaaaatagcatctcatagactatgtcaaagtctaaaaatacttatattttaggacggaaggattagtaataggctcccttgttgggaacttcggatacgggcttaaaatttgaagtgaaatattggcttacccacatgattggctaagagttccaaatcgctcaaacttaacgtgactgattatgttgcagtcatctacggactgcagggaactggagtcttggatcctgcttgctttgcatcaacaaaaacaaaaatctaaagcttttacaacgtgcacgcattctgcagctgccgtctgccgatcatccgcaccaggactacagagagtgtgcaaccgaacaaaaataattgaccctgtttggatggtgttacatcggatggatgtttgtacaaagtattaaacgtaagctattgacaaaacttattctatcctagttaattcgcgagacaaatttattgatccaaattaattcatgattagcctatgtgatgttacaataaatatgtgttaattatgaattaattaggcttaaaaaattgtcgcgcgaattaacactcatttatataattagttttattaagtagtgtatgtttcatactacatcagtcccaaaatacttgtcgctttgatttttttcttgcaacctttgaccattcgtcttatttaaaaattagtgtaaatataaaaacgaataagtcacacttaaagtatttttataataaagcaagttacaaacaaaataaacaataactctataatttttgaataagacgaatgatcaaaagttatgtaaaaaacacaaaacgacaagtatttttggacggaggtagtatctaaacatcctatgtgacctaggagtatgtgactgggacggacaacagtgtacaacctttcgttgaacaacagagacgtacacgtacgcaatgttgcacgggtcacagatataaaatgcacacgctacaacgcagcggatgtactcattgcgttggtgcactgcacgcatgcagcgagagatgcccgccgacgctgacatgacgcgccgccgccgctcgccgtcgctaccgtgcgcggtgcgcgtgcaggcggccggcttcgcgctcgggcaccgccgggacggcagcgtccggcgcctcgtcttctccctcttggacatccacgtcagggccaagcgccgcgccggcgtccgctccgtcgacgtcaccatcgacgcctcacgcggcctctgggcgcgcgtcttctccccgccgccgacgaagggagaggcggcgcaggcgctcccggtcgtcgtcttcttccacggcggcggcttcgtgctcttctccgccgcctcctgctactacgacaggctctgccgccgcatctgccgcgagctccgcgccgtggtggtgtccgtcaactaccgcctcgccggccccgcgcgccgtttccccgccgcctacgacgacggcctcgccgcgctccgctacctcgacgccaacggcctcgcggaggccgccggcgtcgccgccgtcgacctctccagctgcttcctcgccggcgacagcgcagggggcaacatggtgcaccacgtggcccagcgctgggcggcggcgtccgccgcctcaccgtcgtcgtcgacgacgctccggctcgccggcgccgtgctgatccagccattcttcggcggcgaggagcggacggaggaggagctggagctcgacaaggcggcgctcacgctgtcgctagcgaggacggactactactggcgggagttcctgccggagggcgccacacgggaccacccggcggcgcacgtgtgcggcggcggcgagcacgacgtcgaggtggcggaggcgttcccggcggcgatggtggcgatcggagggttcgacctgctcaaggggtggcaggcgaggtacgtggaggcgctgcgcgggaaggggaaggcggtgcgggtggtggagtacccgggcgccatccatggcttctgcttgttcccggagctcgccgactccggcgagttcgtggaggagatgaagctgttcgtccaggagcatagaaccaagcgtgtgcagtagatggcttgttggcccaacgctgtaattgatccagtgattatgatgattccagcagaatttacgagattatttttcgattacacgacaggctcatatgtatgcacatgtactcccccgtcccaaaaaaaaaacaatctaattagagatgggatattacctagtccagcgtatctaaacaaacatatgtccggatacgctggactaggtaatgtcccaccttcataggttgggttttttttttaacgggaggagtatatgacaacacacataacaacacaatcatacgccaccaatactgtgagaggcactacacgagaaataaattttattattcattcctaaggaatactcgatgggatgagaaataaataacaaccttgaagatgagtaaatatcatagagcaagttttatgtcatttaagagatatgcgagaaatgaagacatcacatgggagacaaaaatccatctgcggttatttgctgccttttgttatcataatggttgccacctgctattcgttgcctttcgtcgatatacgattatattactatagtgaagtgtgtgtcgatgggttatacctcaatcacatgattcgttcatatacaaattgtttggaggacgtaggaattgattgttaggaggatacaaacaaatctgtaaatggagcaaggggaaagggatttttatataggtagacccttgatgacgagtaatagcattatttctgttgaccggagctggtgttgccatcgtatatcaatctatcacaagtacaaagtagagaataacctaatctagtgtaccagcgtatcaatgtaaagctcgagtatggttagtcgttggttagctatttttggcttcctcgagaatccattcggcgagattggaggttgctctatattttttttattaggcttgtccttcacttctgggatcttgtacttatatttttaggtgtttcctttttaagtagaactaagaagataaacatagatacgatcgtcggttttgagggctctgtatttattttatgtgactcatttcttatctatttaggacttccgctatatgcacgagagttgtttccgtacaaatggtatatgatggtcttgcaaagctaaatacatgtgtatagggtactacatatttagagcactcacggtctaaatttaaagtacttttggttttggcatatatatttatctattcattttatttaaaaattatgtaaatatgcgaatataataaatcatacttaaaacaacttcaataaacaatacaagtcataacaaaataaataattttgtaactttttttttaaaaaaatatcaaacatacattcaatgtcactggcgtcctagagtctcaaaggtcactctaatctcaaatattcttttcagcataaaatatatagtaaactgagaccgaacaggatgtatctttttacaatgaatacgaatgtgaataaaaaaatctatccagattcatgaaatcattatgtatctcatctaatttcaggttgctatattttgagatctcctctacgtcttcgtctcaatctccttgcaagcgactactaccagaatggaaagactctacgtagtccaggacactgcgtgtgatacacttcttgtctatcaggtgggtaactgggcacgcatggcagatagttgctgcctaggactcgccaagaacgtgccacacaggagttcagagaaattcatctggagaaaatggcaaaacggtaaaaacaaaaacgaatacgaaactcacaactcacaaggaaaaagtctagggcctgttttgggggagcttgttccagctgcagtttttcctaaaaactgattctgctagaagttgcctcaaacagtccacaacttctgagaatctgtagttacaaattctgaaaaatgaactaaaaaatcagaagctggagaagctgggtttcagagcttttctagattatcaaaaactagctaccaaacagctgcttcttataatttaaagatcccaaacaggccctaggagtagtatctctctcatgattcattacttgatacatacagaaatcatacaaccccactagctagtttatttaagtctattgcatactactctgtcgaaaaaaaatcctacctacgaacctaaagcatgtatccatgtttataggtaggattgattatttttttttttgacggaggggtatgtatctgtaaatatttaaaattttctcctaaattatgcagaagccagcatgatagcgtcgaattctgcgtgtgattcgatcaattggacacttaaaaaaagaacaaatataattaagccatacggttggagctatgctcctggacgaactgcttcatctcctccacgagcttgccggagtcggcgagctccgggaacgcgtggaagccatggatggcgtccgggtactccaccacccgcaccgccttccccttctcgcgcagcgccgccacgtacctcgcctgccatcccttgagcaggtcgaacccgccgatcaccaccatcgccggcgggaacgcctccgccagctggacgcgctcgccgccgaacacgcgcgccggcgagtggtcccgggtggcgccctccggcaggaactcccgccagaagtagtccgtcctcgccagcgacagcgagaggctcgccttgtcgagccccaccttctcctccgtccgctccttgccgccgaagaagggcgatatcagcacggggccggcgagccggagcgaccacgacggcgaggtggtggacgccgcccagcgctgggccacgtggtgcacgatgttcccgcccgcgctgtcgccggcgaggaagcagcgggagaggtcgacggcggcgccgagctcggcggcgggctccgcgaggccgttggcgtctaggtagcggagcgcggcgaggccgtcgtcgtatgcggcggggaagcggtgctcgggggcgaggcggtagttcacggacaccaccacggctccgaccccgcgggagatgcggcggcagagcgcgtcgtaggggcgcgacgccgcggagaagagcacgaagccgccgccgtggaagtagacgacgaccgggagcttcaccgccgccgtgttcgtgggcgggcagaacacgcgcgcccagaggccgcgggaggcgtcgatggtgacgtcgacggagcggacgccggccgcgtcgggacgggggctggccgcggcgtggaggtcgccgaggtagaagaggaggcgccgcacgctgccgtcggaccggtgcgcggccgagagcgcagcaagctgcacgcgcaccgtccacggaagcggcggcggcgacgacgacgaccggcggctgcggtcaacgccggccatctcttgctgcaccaagtgtggaggagagttttttttttctttttgagtgaattgcaggagtgatgtggtgctttgatcttcgatgtgaccaatgcgacaaatctgtcgcgccattaattaatgtttaaggacaagttgttcgcaagttgcacacggcacagtggctgtggagttatattttatttcaatttgtttgtttagttttactactagtataaattattgtttgataaagctcaaactgtaataagagtgccaaagtactgaaagagaagtgcagatgactcaagagttgcaaatttctgccatatgtaaaagcttctgttctttattgtgtagatatattttgacccttgaatatttgaacattggtaatggtaatatgatgtaatcctagttggccaaaatcatgtccaattagctcaaattctctgtccatatcccgcaaattctcaaatttccttcgtctcttcggttgcttcccgttcatcttctccatcatcgtcgtcatcgcatccacagtcgctgtccatagccttcctcttcgtcttctccacgaccggcgtgtgcacagccgcaggtgcaagggttgtcgccgttgtcgtcgatctcgcactcgacgtagccatgggcagcgagctcccccttgacccactcctgctgctccttccagtactcgttcaggtgccgtatatatggcctccgcaccgtcggcgtccaagctgcaggagcgcctcctcctccgcctcgctcgccgccagatcttcgctctgtaacacggtcgcggggcggacatcgtgacaggatgtgcggtcgatctgctcctgcagcatcctccacttcctcagcttcttcattatcttcttcatcccttcggcttgcgacgaccaactccagttcatcgccggcagaatctggatttgttgggatttttctgatggattcatggatcgctacgggaccacgccataaatgggccagaatgcccgtgttctactcggcctcgggctcctagtttcctttgtgaattctccgccgcgcccatgtgtgccggcccaggctcccaccaaatacttctctgtgacttgtgaggaggaaaaagtacaccggagatacctactcttgtcgccgatttacaaaatcatcccttaaccaaaaaaccaaatacaatgtatcctccaacttttaaaaccagtgcaaacaaaatccttcgatggtattgtccccagtttcagctaacaaggcaccaatgtggctccttcgactagatcttcatctcacatggcgcttatgtgacggtttcatcaagaaacaaattataaaataataaaaatgggtgggccaattgatcagatccccttattccttttctctcttcttcctctcttttcttgcgtcagacaggaaggaaggacatgaggacgatggcgaggtatgcaccttgcccttccccatttctctcccaagcttctccactcctccgcggatgaccccgcccatctcctctgcgccatccagctcctattcaccgccggtgccctcctccatggtatggtcaccgtggttgcctcctctcccacctcacctcgccagcctccttcgctcccgacgcttccctctacccagcgccgccatgtcgctcgtcgtcggccgtcggacctcctcctctccgcaccggacagccagcccacccaaatgacgacaagaaaaacgagaaagggtagaaagggagagaagaggataagagagagggtaatgccgtggtcaccttgatatgtggggttcacgtgggttccatggtgactcagtcgtcatgtcggacaaaaccaggatcaatgttgtctaaggacctggaatgatctagttttgtaagttgagggatcttatacatctggtttttttagttgagtgacgattttgtaattcggtgacaagatgagggacctcggacgtactttttccgtacgaggacaccttgtctccatatggcccatcaaaagcccatcaccgtcgttctcttccttcttcccaccaacgcatcctccctattcttccccaacgttcaagttcaaagttcaaacaagcagccatggctaccaagaaacctccaatcatgctgtttaactattaaaactggtagacagcaggctagtattaatcacacataatcatattaaaaaatataatgcagaaattatcagtgatcgaggttccagccgtctaatttcccgaacagattttcttctcttcagtttcgtcctcataacaatcatcgtctccttcttgttcttcttcttcttcttcctcctcatggtcggcagcataggcgcagccgcaggtgcaggggttgtcgtcgtcgtcgatctcgcactagacgtagccatgggcggcgagctcggccttgacccactcctgctgctccttgtggtaccggtccatctcccgcttggccaccgcgtcgtcggcgtccacccgccgcagcctctccttgagcgcgtcgctgatctgcaggcggccgatgtccacgtcgtagcgcggcggccgggctggctccggcgaccacgacaggatgaggtcgatctgctcctgtggcatcctccacttcctcagcttcttctcctccttcttctcttcgccgacgttgttgacctcgtcgacggccatctccgtcgtcgcggcggtggttcgatcgatgctggattaatcttggattgcttggggattttttttttctgccataaataggggcagaaaggtctccatgttcttcttggtttcctttgcgaattcggatggaataagttcacttcatgaccctcaaaagtgatcgaaatctaatccatgacctcaaattacaaaaccggatatcttgacccccaaactcttaatacccgtgcaattttactcccagtgcggttttggagagcggtttcgctgacgtggcgcctacgtggcagcattgactcggtcttctttccacgtggtgttgacgtggcgctgaggtggcattagaaataaaaaaaatatgcgtgggacccatctgtcattcac

SEQ ID NO: 43651 - DNA, 5655 bp, Oryza sativa
ggctgcggccatagccaccacccacgggacgcgtcgccgccactccgggtcagcacgcggcagcgctgtcgtgagcgcgagtgcgggaggaggcaccggcggcggcggtggcggcgacaacacgagctcggcggctccgcctctcccctctcccttccggcccttacacaccgccgcctcctctcatgtcacccatcacatccgtttcctccctcacctgctctcctctcctctcctctctccacttggcgaggccgccgccaccgcttcagcttcctccgccgctgccgccgctctggcgcccgcccgctgccgctccagcctcccatgctccccgcggccggccgaaggagagaggagaaaaagaaagaaagagagaagggaggaagaagaaagggagatagaggatcccacgcatatttttatttctaatgccacctaagcgccacatcaacgccacgtggaaaagaagaccgagtcaatactgccacgtaggcgccacgtcagcgaaaccgccctccaaaaccgcccagggagtcaaattgcaccggttttaagagtttaggggtcgagatatccggttttgtggtttagggtcatggattagatttcgatcacttttgagggtcatgaagtgaacttattccaattcggattcggcctctcgagcaaatgctattatgtgggccttgtgttgatatgggccggtatctcggcccattaagagcctgtaataaaagtacgaaatgttcttcaaaatgtactgctgtacttttgaatttagtttctctatatactcgtgtaagtcgatcgctctcgttttaatactgatttaattctcgtcccgtttcccctttttttttgcgacaaaaaaaagtctgaaatgtgccgatgtgcttgtgctccacgtgaacagaaccgtgtagtttattttatccttaagagtgtcacttttaaatgtgacaattaactctttgacattggacccacatatcatggaggggaggggccaccgcgcaccgctctcccccttgttgccgcgccgccaccggcctcctcctctccagccaaatcaaaaagagggaggtgaggggagagagtggggcagccgccgcccctggcctcctcccctccaaccagatttgggaaggaagggggagtggggcgctgccaccgacgctccatatgctgccttgctgccaccaacctcccctccttgactccaccagactgtcacccgcgaaagtcgccgccgccggatccaccacacgcttgactcgccgtcaccagatctgccacccgcttgattcgttgccgctggatccgtcggtgaagacggaggaggggggtgtgcaccagtgaggaaggaggaggggtgcacgccggtgggcatctgcagggaaggagaaggagaggggtagggaaggagtgcgtaccgatagggatggagagggagtaaagagttaggtgcggtggagagagctgatcttttaatatggcagtcctcttcaaccgccagtggaaatcgctaaagtgagccgccagcaaaaagatacactttcgttggccagcgaagatccatttttgctggcggtctatagccccattgtcgctggtagttttcacgtatggccgccggagaaaataataaggtgacgccataaaagatcgattttgtagtagcatacgctcctaaagtgttcgactttggcacacgtgaaaaaaatcattaaacatttgttttatacaaaacgccctctacttaattagaaaatatcattaaacaaaagagtgtgtttcattttggaccgtgtaatagacgactaaagttggaaatagaagttgtttaaacttacgaaataattgtatgataacacaatgattatattttctggcccaataagggtgcgattgtttcggctggggcggtggacggtttagtcgcacgcaaaacgagaaatgcgattagtatatgattaattaattattaatatataacttttttatgaataaatttgttggatttttttaacaacttctttatagaaagttttcgcacgaaatataccatttggcagtttgaaaagcgtgctaacagaaaacgaggagaatctaatcctataggctcaaaacgagagcctgtaagaaaaggatagaaccctacacgaaaagtgttcttcaaaatagcttttgaatttgattttttctatcgacgtgtaatgcgtcgcgtacgtctcaaaagtcagactgattttacttgtcgcaaaaagtaattcttatcatgtttcaaggctgtgtgtttagatctaaagtgaatccaaacttcagtccttttccatcacatcaatctgtcatacacacataactttttagtcacatcatctttaatttcaaccaaaatctaaactttgcaccgaaaacacagccttcctctctctctctctctttttctcttgtcgcgtcaaaaagaagtcagaaatgtgcagctgtgctcgtgctccgcgtgaacagaatcgtatggtaggttaatgtctccgtcagcatcatgggatccatgcgatgaaatcggaataaaaaatacgctgctagtaaaatcggttttattttattaggtatgtttaattcatttaaactacgttcagtgtttgggtgttacttttataataattggctgtagctctgatgagcaaaagccgagatgttttatttcattatctaaaaaaagtaaaatctgtttatttcacagagcaattcatcatcgcaaaacttgatcaaatttcagcaaaatatatatgaaatagcagtccaggttaacattttgaaatgccaaaggtaaataaaacgcttctaattaagcattcgatttgggcggcgcgttgcgctccatgaacgccttcatctccttgacgagctcgccggagtcggcgagctccgggaagacgtagaaggagtggatcgccgccgggtactccaccacctgcaccgccttcccattccgccgcagcatcccggcgtaccgccgctgccagtcctgcagcgtgtcgtaccctccgaccaccaccatcgccggcgggaactcctccgccagctcggcgttctcgccggtgacgtgcgccgccgggtggtcgcggtcggcgccctccggcaggaacgccctccagcaccagtccgcgcgcgccatgctcaccaccggccccacgccgtccagcctcagctccgcctccgtccgctcctcgccgccgaagaacggctgcagcaggacgacgccggcgaggcggacgcggcggctcgaggaggtggtggcggcggcccatcggtgcgcgacgtggtgggcgatgttgccgccggcgctgtcgccgacgaggaagcagcgggtgaggtcgacggggacggccgctactacgtcggcggggaggccgacggtggcgaggtggcggagcacgtccacgccgtcgtcgtaggcggcggggtagcggtgctcgggggcgaggcggtagttgacggagacgacgacggcgcggagctcgcggcagagccggcggcacaaggcgtcgtactggctggaggcggcggtgaggagcgcgaagccgccgccgtggaagtagacgacgacggggagcggcggggattccacggcgctgctgctcgcgggggagaacacgcgcgcccacagcccgcgggacgcgtcgacggtgacatcgccggagcggacgccgtgggcgtccgggcgcgccgcggcggcgctctggcggtctgcgagggagaagaggaagcggttgacggtgccgtcgccgcgctgcacgatgtcgacggcggtgacgagggcgaagagctggagccgcaccgtccacggcaacgccggcggctcgggccgccggagctcgtcgccggccgtttcttgctccttctcgtgccccatttcgccggtttctgtgcgagtcatttcagtgtccagaggacactatatataggtgaaccgattaattttttttggaaataaagggggtgtttagtaaagtttcggcgtgtctcatcaggtattatatacggtgtgccataaatgttcggcactaataaaaatactaattacagaatccgccggtaaaccatgagatgaatttattaagcctatttaatctgttattagtaaatatttactgtagcacaacattgtcaaatcatggaacaattaggcttaaaagattcatctcacaaattagtcacaatctatacaattagttattttttagtctatatctaatacctcatgtaggtgtttaaacgttcggtgggatttggggtgggatccacacaggaccaaaattatcccttgatttttacgtgaatattccaatttgatagtagaaatttgaaataccgtgtaactactcgtactacctagaatttaagtccccagcgccgaatttagcctaaattggcattcatgagtcatgaccatatcgtcgaaccaatgaactctagctgcgttcaaatttgacaaattggcacttgatacctctcataatctcatgtacaggtattttaatgcaattccatacgaccatatatagctccgttgcttctgtttgttttgagtataattagtacgtcttcaatttaagttttatagttgaacacattggtactacgtacgtacaacccaatagcttcaatgcgatatgattttgatccaatctcattattgtgtactgctcaactgatgagcacatagccacacgtttgtagcgatttttctttgtttgattgaaggatataattaattaatccagtagccttttgcaatgatgtgtatctgattatctgatacgtacatttgtggttgtggttaacgtctcaagtctctcgcaacgaccatgcttacgttgatggcgatgcatggctgcctattggggactcttgaggaatatcttcttattgttattgtatatatactcacatagttataaaaaagtttaaaaggatgtattaacatgtaatatatcactttataaatatataatttaaaatttaacttgtacatctcgcaactaaaaacaaactaacaaactatagttggatctttttttgctgagatgagctaaagcatcattttttttccttcacttttttcttcataaaaaacaaactaaagatgttactccgataatttccaacgagacatagtccccattggttggcaagagcttagcggcaaaaataattaatgaaatttttttatatatccattacttatcgacttaaaagctaaataaaaaaaaactacattgagaaaactttgaaattaaatttaaaattttatagcgataggtcaaatgatgaggccctcgtcactaagcagtgggctgcttggacgtgatgcattcttccacgaacgccctgatttcaccaacgagcttccggtgatcgtcggcgaggaactccgggaagaagtagaaggagtggatggcctccgggaactccaccacccgcgccgccttccccttccgccgcagcatggcggcgtaccgccggtcccagtcctgcagcgggtcgagccccccgacgaccaccatcgccggcgggaacgcctcgtgcagttcggcgtcgtcgtcgtcgtctccggtgacgacgtgcgccgcggggtggttccggtcg

SEQ ID NO: 43652 - DNA, 2841 bp, Oryza sativa
tgccgccggcgctgtctccgacgacgaagcaggtggagacgtcgaccgggccgacgtggtcggggaggccggtggcgcccaggtagcggaggacggcctccccgtcgtcgtacgcggcgggagcccggtgctcgggggcgaggcggtagtcgacggacacgacgacggcgcagagcgtgcggcagagcgcgtcgtaggcgcgggaggccgcggagaacagcgtgaagccgccgccgtggaagtagacgacgacggggcgcggcgacggcgacggcgagtagaaaacgcgcgcccagaggccgcgcgaagcgtcgacggtgatgtccgtcgagctgacgccggcggcgtccggccgcgggtcggccggcgcccggcggtcgaacagggagaagaggaaacggttgacgctgccgtctcggcgctgcgtcgcgtcaatggcggcctcgaaaacgcagagcctgagcctcaccggccacggcagtgccacccggcggcgccgcccgtgcgcgcccgccatttcttggctactccgacggttctaccttttcgtttgggagactgataaaaaaatgcaggttcagaaacaaaattcagagaagttcaggaattttatctttcagtgtgcagccacaaaattcagaggttcagaaagtgttgtttcagtgttcaagcagccacaaaattcagtggttcaggaagcgtgtctttcagtgagtgttcaggcaggcacaaaattcagagaagtttaggaattccttggtctgaaaacaactttcaaagtgatatgaaattgatattacgattgaggcctggatagaggtgacatggagttatggagatcgccaattctccgtacttgaagataacgcagacgctatctttgcggtctcacgccgtaggattgttgtgagaagggtgcaagcaacacatacgacatgtgactatatgaggtcgcaatttgtttgtacgcttatcagttatcacatctctcttccttttcgcaaggcaaattcaggtgattcttgacttaagtattgaaaacttaatcttttttgctgattcagtaagttcagtgcgtactatagcttagtttactgaacatttagaagcgtctgacatgggattttgaagtttaacaggagcaatatcctgaaaaatcccagatagtattaggctgattttgaattacactaggcctacactgtttgatgaaaaacagagtgtgagtaaggatgggtaagaacaaggattttctacgcctaaatgccatagcacccatcatttacatacgacttaaatacttatagaaaaaatttagtaacattaattacgatgatataaatctatacagaaacatgcaagattatatttgatctacaactagataaaccaaaataataatcgatatcgtacaacgcagataaaatttattatttttgtttttcatgtgtatatcgaatttagacttacatgtttgtagtatcttatattatcgtagtccatcttatcaaattttatgaaatttttatataactatttaaactacatgcatacacctgagtgtagaaaatacattcccgaatgcgtaactattggaggtatgtactcttacgagtcgtcgactcatacataatttctataccaaatgccttttttttattttttatttttgccaaacacggtacaaacatactaatttgtcaaaaaaaaaacaaactctaaaaatgaacctggacacacatatatccagattaatagttaggattggtttatttggacggagggggtaaacacttacatacgtacccacacttactccttactatctccaaggactgcaccggtgtaaacccactctctatccgtatgaacatctccaaagactgatccaacatctttcagtataaagcgggtatgacacctaccattaaaaaaagggtaaaaatagttagctgcaaatacgaacaccctagtaagtctatgacatgttggggtgagcatgttttcaacacatgaaacttagccaagtgatcttacactcgcttcgtatgaaatgccaaaatttcatcgcggtggcaatgcatgatcatacaactttcatcttaattcatacaactttcacatgacacttagctgtgacctcaatttttcatttttgaattaaaaaccgttcaaattcaaatttaaaactttcatatgaaaacttaaaaccttcatactcaaattatacagttttcaacataaaatcatacgaaacttttaactgcggccttaaactttcaccttgaatcacagaaatcccaattcaaaatctcaagtatatgaagtgtacgacgcgtgtacggtacgaagcagatcaaactctcgaatctcaattcaggcggtggcgcgcgccgccctgttgctctggacgaacaccttgatgtcctgcaagaccttgccggcgtcggcgagctccgggaagccgtagaagccatggaaggcgtcggggaactccgccacctccaccgccttccccttccgccgcagcacgtcgacgtaccgccgctcccagtcctgcagcgggtcgaaccctccgatcaccaccatcgccggcgggaacgcctccgccagctcggcgttctcgtcggtgacgtgcgccgccgggtggtcgcggtcggcgcccaccggcaggaacgcctttcacgagaagtccgaccgcgggaggttccccaccggccccacgccgtcgagcgccagctcggagggcgtcctctcctcccgcgcgaagtacggctgcacggggatcatcccagccgaggcggaggttcttggccgtgggctgccacgtggccgcccagc

SEQ ID NO: 43653 - DNA, 8489 bp, Oryza sativa
gcgcgcggcgtcgatggtgaagtcgaaggagcggacggcgccggtggcggcgtccggggacgggtcggcgcggacgctcatcaggtgttcgacgaggacggagtagagcgcgcggttgaccgtcccgtcgcgccgctccaccgcgtcgatcgccgccgagagcccgatcagctggagcctcaggcccagcggcataggcggcggcggcggcgggcggcggttgctctcgccgccggcggccacgtccttgcccatcttccctcccattcgcgagcttgacgaacactctcgttttcttctctcgctttttcggtgtggatttgtgagtcgtgatcacgcaacgctgtttccgaaatgggcacgttatcgccgtcccgtaaatgaggagtacagtgattgtactaacgtgtcgctgtcggcgatgggacacgttccaaaaaaaaaatatttttccatccatttcacatgtatcaatacaaaaccaaaaccaaaagaaaatttaaaataatcatcgcttcatcaaatcctaatacagttatttatctactcctaatacatttattctttacttcctccgtcccattttcagtgtagccatgattttttacgtccaactttgatcgtccgtattatttaaattttcttaaaaaaaattgaaaacataagtcacgagtaaagtgctattcatattttatcatcttataactacaaaaatattaattataaaaatttttcaaataaaacggacgatcaaagttaagcgcgaaaacttatggttgcacttaaaatgggacagagggagtatttttcacaaatttcggtgtgctaacggtaaacgggaaagttgaagtttggaattgagaaaaaagaactgaggccttattttgggataaatgggagagaaaaaaaatttgtcctcaaacagtggaagtactagtaagaaattgctttagtagaaaattgaactcggaattgttagaggacagtggctgtttaggtgctgaacctgtccagtcagtcgtggctgcgcctgcgccgcaagttcatcagtcaattgcggcatctggaaatccatggcaagaacagagctaacactgccaaaagcccaaaacacaactagagcataaaacggtggggttcggaggatgaaactccgactcccctttgatctctctctttcagcttattttctgcagttttcttttgttcgtcgttcaggtgcccagacgcaaaattcataccgtttaaattaaagccgtctgatacggatgaaatgatctgttataagaaagaggaaatgcaattttcagtgttattccaagatgagagtagatcactgaacagaagagcagaggaatgaactcaaatatggattctgatttcagaaaccatgagatggctaaaaggattgtgggatgaggtcatatgagtccgtagagggtttaactgaagatctctgaatattaacaggtgagcaggtgactgacaagatgacgccgccggctgttcttttgcgctgtcggtggcgagcaatcattttgtgcattagtttaaagcttgcatgtgaatcattttcatctaatataatacttctccattattcttgggataagataatccactaataaattggtcgttgaggatcgtgcctgcgccgcaagttcatcagtcaattgcccgatcaactgagaaccgcatgatcactttcaaatagcaactttccttacggcaatttaatttgggtgcatctttttttcttactggaggagtcaaaacaaactgaatcaaagttcagtgcaaactttgctgaaaattgaacccaagttcagtgtataatacagagtagcatgatttactgagcatttagaagcatataacattttttttgtgaagtttaacaggagcattcatccagattccagcctgattcattatattgagagtgctcctattgattcattgcgaagagaattaacatttcccaagcagtggcactaggcagttatgaaaccatcaaacatcgtctgccatttacacttttggtcttgccatgatttgaaattttaattctttgaacactacagaccaacaaacgagaggatatcagctgctgctatgaatcaacgcttctctaaactgcttagcacttggtacccctgcaaaggagacgcagtatgcgataggagtggggtccggagtttaaactccgaacctctttggtctccttttttttttcctcaaggtaattttctacaattttttttcatcgttcatgtgatcagacgcaaattgaacctgttaaaattcgtctgatacgggtgaaatgatctaataaaagaatttaataaattgcaatttgcagttatttcaacaaacggaaggaaaaaaatatttgatgattccttttcaaatggatttcgctgctttgcacttggacaacacctccaatctgaacttctctgcaggatgattaaggtctaaggagtaaggaacaacgaaagggtggaaacgagccggctcggctcgcagtggctcgcaacaaacaaggcttggcttggctcgactcagttagggaaacaagtaaaacttgagcacggctcggctcggctcgtttcctggctagcattcatgttgaaacacctcttcatatatattttataattattaaaaaaaagcaagaacaatcatcaacatgtaaaatttaaataagtttcaattcttcaaaatcttaatggtaaatttcaagttgacaaataatatctccataaaaaaaataaaataatcgatataaacacatgatggtctaggctcgcgagccaaaagaagttgctcgcaagccagctcgggctcggctcatttcagcaatgagatgaaaagaaggcttggcttggctcgttttgcttacgagccgagctaagccaaccaaggttgagccaagcccgagctgagctcatgagcctaagctttttttttttccaccactagctaggagtggagcgaccggagcgagcgaggagacggagtttgtgatgggaaaggggttggagtttcaaactccgacagaccgacatcctttggtctccttcttttcagttaacgttctgaattttttttcttcgttcattattttgatcagacgcaaattaaacctgttcaaagccgtacgatctgttaaaacagaaaacctattttgcggtcattccagtcttccagatgaggctaagcaacgaactgccgaactgctaggagttcttattcggaaaaaaaaaaacgaactgcgaggagtgaggaatacaggaatgaactcaaatatcgattctgatttcaggaaccatgagaggactaaagcctaaaggtagggggaagagttcgcatgaatcagtagaggttttaactgaaaatctcagaacataatggccaaatatttaaagtgaaatgctgataagtaccaaaaactacaagtttcagaattttaatttcattgtcaatttgtaattggtagttggaattgaacctgcctcacaggagaagggaatactatgcacaatgatgctatacttttgtaatctttgtacttcattttagatagcgtagcacctaaaaaaatcctccttaatatttatgtgatttttttaaacttttaattcagctagccatcttttttagaggagttggggacctgtcccatcacacgataatttttgttttctcagatggctgagatgtaaataatttccattattaaaagaaattgaaccatccccaataactgaacagtactagacagttctgaaaccatcaaacactatctgtaatttacacttgtcttgtcatcatgccatggtttgaaattttgattccttaaatcctacagaccgacaagcgagagaaaatcatctgctgctacgaaacatgaatcaacacttcgctcttccagtttgatgattctttttcagatggattttcgcagctttgcacttggagtgggggtcggaggactccgatcccctttgatctctttttttttcaggccatgttctgcattttgttcgtcgttcatgtgagcagacgcaaatttatacctgttgaaagccgtctgatacgagcgaaatgatctgctaaagaaaacaatttgctgcatgaactgaagagcagaggaatgaactcaaatatggattttgatttcagaaaccatgagtgggctaaagtgtagggtggtgaggtcaaataaaccattagtgggttggactgaacatagtgaccaaatattatcggttgaaataccgattaatatcggaaattagaaatttcagggtcaatattactgttaatagtaattggtactgttgaacttattagcgtgctccccaataaaatccattagacccctccccctgatgaagcaaatcagattgattggtccacaacaaggaagaaattaaggcctgatttcactaatgatttcgactgcatggacttttgtggaagcacgtgtgtggcggcgttttgcagaaattaaccaatcaagcacttggctagcataattcctttgttgttttcttcctttaggtgatccatcttctttgtaacatttcttatctttcatgtaattcaccaactcttcttataatatatatattttggtaaccctccattgaagctagccttttgcagcctctatgttcatgaatgtacgtacagtaattaacctgtatgagcatcagcatcagatcatcattggaatcaaagcaatattcaagcaacaaaccccaagaaaagcgaagggaatgacaatattatagttgtgcctcagcccctctaagtctaaggtttgcctctcagccaccctaaaatttaaatattaaaatttaattttgaagttgattttagagtttgtcgtagtagtttatttttgacaccggctttcaaattgttaaacatgcatatataaaaaatgtattcacaaactatttttttctttaataaatagttgtaggtgaaatgatggtagtctcactatccctcttgatccaaacaactccagcttgcaaagacattttgccagataattggcatgcatgcagcctaccattttcaatattttaaatagcgggctaagatatttagcggttagcttctaaaactgctatagcgggctaaatggagctataccggctaaattgtacatgaaagcaaatagctagaaccctctcaaacagctatagctgaagaccctgaccatttctcatctctataaatagaagtgcaaatctcgagctcctaatcacaggcagctgcagctagctagctaagcttggataacagtgcaagggcgccggacggctacttggtccatggcgtctctgacgatcgtcgtcgccaccatcttcctgctcagcctcacctcggcgagcgtcgccgtccatggccggagcagcaggaggaggttcgtcaggagctacgacgagccgtgcatggagatgaggctgtacctccacgacatcctctacgactacagcaacagcacctccaactccacggcggcggcggccaccaagccgacggcgctggccaacgccgtgccgtcgaccggcggcaccttcttcggcgaggtggtggtgttcaacgacccggtgacggaggggagggcgctgccgccgtcgctggaggagacggcggtgagggcgcaggggctctacctctacaacagcaaggaggcgttcaacgcgtggctcgccttctccatcgtgttcaactccacggggcgccgcggcacgctcaacctcatgggcgccgacatcatcgccgagaagacgagggacatctccgtcgtgggcggcaccggcgacttcttcatgtcgcgcggcgtcgccaccctccgcaccgacgctttcgagggcttcacctacttcaggctgcagatggacatcaagctctacgagtgctacgtatgatgcatccatccatggtcgtataatatatactccatccgttctaaaatataagtatttttagctatgaacgcttatattttaagacggagggagtaccaaacactattcattattgtcgatgcaaatttcagtgaagatgtgacatctttggtcagggagacaaatgatcagccaattgacaaggtgatctgatgctcctagcttcgtctacctatagatttatttgttgctgctcccatcatcagatcagaccaccagctgtatgagtatatacacagtttgtatgctaaattctttctaaataaacatccttatgcaaatgtgttgataatgaatctatctattatatactaaaagtccattaaactccctataaacactctaaagccaccacgtgagactcctacaaacgctcctagattgccacgtgccgctttaataaatcttacaaattctaagaaaaaaagcaaaacatctagccatcaattttcatttaatttggtggatccaccaccaactgcagccgccgccccaccaccttcaatccctgccaccaccaccaccaactgccggctgccgccgccacctcacgccgaccctccgccggtggcctccccaccagatccggccgcggcggcccggatctgggcggtcttcactgtctactgcgcggccctccaccgccgacgggagagggagacgaagatgacgaagccccgccgccgccgtccttgcggccgcgcggctttgccgatggccgcttgggcagcggcgatgcggcggaaggaggaggggggggggggagcaggcggcgccggcggtttccgcctcccgtgtcgcccatgagggaggacgacgcgggagcgggcgacgctttttgaactacgccttcttggtagcatgtttaatcaaaataaaaatcttcttttcattaaacaataaaagttgacaagaacattgtatataaaaaagagagatttaattagattgtttatgagataggattttgtaggattattgcaggaatgactccaattttctcctaaacagttaatttatgccattggaatgattttgaaaataacatattataatagtatatgtcttacgattgcaaattttgttcccatttctacttttagaatttcttatatacaaaacataattgtatctatgaaaataaaaattatagttaattatatacatattattatattatgtttttaaatctggtttggcgcaaattaaattgcatggggaaaaacttgctaatctcatcaatgatttttgactgctcagatttgctaatcttctagacaagctcacctccgggatccggctattatgccgggtttcaggagattaagcgattggctaggcgtagatcacttttcttcctttacgactttaagcactccctcttctatagatacatgtaacatcgatctcattaattcacccactctaatttcttataatattttaatagacatgcgaccagatctgtcagaatttttttttctggtaaccctcccttgaagcctttgcatacctccatactgctcataataacatgttacaataccctgcatcagcatcagaaattcagaatcaagcattcgagcaaacagtccaaagtaaagagaagggaataacaatataaatatataaatataatagagtagcctttgcttatatctcactccctcttgatccaaccaactataggatatgagatttgctccgatccaacaaaaagtactttgagttaccagtacctcacggtaccaaatcattttcgatcattggatctaacagtacccattctgtccagttagattcaacggtcgaaaatgatttgataccgtaaagcaccggtaccttgagatacttgttgttggaccagagcaaatctcagaacctacagcaacacattttgccaggcatgaacatgcatatattattccatttcacacctctataaatagagatgcaaaactcgagctccatcacagctgcagcaaattaagccagcaacacttgctaagtggagtggagtagctagcttctccagctagttagtgaattaagctcattaagctgagttaattgcactaacttactactccaagatagcaatggcgacttggtccaatccctccctgatcgtcgccgccatcttcctcgtcatcagcctcacctcggcgaccgtcgccaatggcggccgtagcggcggcggcaggaggctcgtcaggagctacgacgagccgtgcaagaagatgacgctctacttccacgacatcctctacgactacagcaacagcaccgccaactccacgtcggcggcggccgccaagccgacggcgctggccaccgccgtgtcgccgaacggcaccttcttcggcgaggtggtggtgttcgacgacccgatgacggaggggacgagggcgctgccgccgccgtcgtcgctgagggagacggcggcggcgcgcgcgcagggggtctacctctacgacagcaaggaggtgtacgacg

SEQ ID NO: 43654 - DNA, 2405 bp, Oryza sativa
tgcagatggacatcaagctctatgaatgctacatctgatcattacatgcatgttttttttaaaaaacaaattgaatttccatttttttttaaaaaaaggtgaatttccatctcgatatatagttgcttgatttgcgtgacgagttatatgcaccgacgagtgtgcaaaatgtatcccaaacacagttttattttccccctaatttgtgtgtgtagaatgtatcaaactattatcgcacttttatttcattcaataaagactaaccacataatcgtgttttgcgcgactttttatcctgtttaagaacttttgtatgtggtctattagtttaccttagctcttaataaggttttgatataagttaatttatttataaagtatctattatcctagccaacaatagaacttccttcgtcccataatataagggaatttgggtggatgtgacacatcctagtgcctctcgagggtcggcgccgaccctaggtgccacatcggcgcaccagatagaccaagaggccagggtggcagcggggaagatgccagcattcgttgctgcttgcaaaaatagttccacaaaaaaaatgataagtattccacaggttgagtttttatatcttaacaaacatactgtttgagacaccagaatccaacagattaaattctggagctctgtctccctattaaccatctgcagggaagtcttattctaccagtcgtcacaaaagttgatacaagctcgaaagtcgagatcaaacaaaaaaaaaccaaccgatccgtagattcgctacataagtaactatagttgccatgaaagtaaaagaaacacaacagctgatgacatttgcactttgagatcggcaatatcaacatcatgacctccttcaaccaagccccatctatcaacctgggggaattaaacaccataagacaagagaaaagtaaatagccttaataaagatagacaatggttgcagaataacctggtgatcttcttcaagtctgatcaattcaattgcctgctcaattcccagcttccctctgaatattgcgagagggattaccagggaatgggctgctgctgccatagcatcaatagatgccaactcaaagtcggtggtattcttcaaaacagtttctacagcattagctaacccttcatcttgctttccaccaaaaaagcttgtgtatacaacaggcttgaagccaaactcagtgtttacccagtctagtatagggtcaattttctccttctgtctttctgcacacacacacacacacacaagaagcataagaaagacattgctggagggaaatgaagagaagacatcgctaaccaaaatgtatggagttatatgctcacaacactatgaattcatatggacgtcattgcatacacagtcaagaggaaacaacttacgataaactcctacagtcagctcattatcatcaggtgaacggcagaataccaaatctggtggaatttcttcatcaaataatcaattattttttttcgtgtcaatggaactcgttccagtgcagtgcaagcaagcttcataagaggcattgtaaaaggccggattccatctgcttcgtatgatgtcaagaaagtttggtatcagtatatgttacataagaaactagaaattcggatacataaagaagagacttgcaaagaagttaaattcaaatataattctgggctgtgtaaataagaagcagcatcaagtaaacagaattcgttgtaacatctcctgtcacttgtaaaatagatgatgtttgattgcagcaattcagccatgaacatatgttacagttgaaggcagtaatcaatattaattggatgcacacccgtgatgataatataacaaaagaacaaccaaaaccgattacttatgacatgacagatcttttattcacatatgcaatatggaagtatagagcagctgactctttcctaagtttacccaccgcaacatataagtacagacatacatacattttaagggttgccatgtgaatatgtgatgcaaatgcaaaggcgcaattgccttatgaagtttgcttttactaagctgctggaatcaacctgataaatttgaatacagtccatcttgtggtagtactattatagggatgataagataagaaccagccaacaaaataactctaaatgctgcattcttcatatcctactgaaacaataactctataataccagtatccgaattaattaggagtcctggtcatcttctttgctacttcccccgtttcacaatgtaagactttctagcatttcccacattcatatagatgttaatgaatctaggtatgtatatgtgtctggattcattaacatctatatgagtatagacaatgctagaaagtcttacaatatgaaacgg

SEQ ID NO: 43655 - DNA, 1385 bp, Oryza sativa
gaaaacttacgactctgtctctaagtggggcgtgctccatttgatatccaactctagtccggacatcatagggattccgcccctcatcggagtcgcggtcatcctctatgtcggcttccgtccaagtagggcggaggaacagtctatatgtcctatgcagccaacgaaggtactctgagaaaagatgattttggtgtatagtttcgatgtacctatcgttccttccggctattctccattcatcaatgtatctattatgctctagcccccagtctttcaccttctttgttctcaccctgtcatacctagacaagtagaaggtgatgaaatagtagtgagcatcgacaagggttaaatggtacaaaattgaacattgacaatgaaagcaaacaaagataagaaatatttacttgtgtaattcaactccagttgagatgtcctcaaccggccaatcttgtttcttcccgaactgtcgcatgacacggtgcggaaggtggtactcaactgcccagaaacaaatcaatgggcactggtacatgaaatagtcagagtctcgattgcacatcgagttcagggtcaggcttgaagcctcatttgtgtggtatggtaaccactcaatctgcaaaagttgaagagatgtcgttggttagtatctcaattaaagaagtaaatgtctaactagaagtgatattggaagtacttacatgttgaggctgcaagcagtccatctcattgacataatgcttgtatgccacatcccggtgagcatgtgcagtggcagtactctcaaaaaggtaggccactgtcttctccatgtctggctcattgtagggccaaggagtgaagctttgcctccacttaggccttccaaccggtagtcttaaccacatccacatctgaatcaatagcacacaaccactcatgttggatgatggtgcctgacgacaacaggcctcacagagctgtctatatgtccacgccaacactgctgacccccaactgaaacggcccagatcaccaaggttggcgaccaaaggaatccatatcgccgaagcaatgtcacccccagcatcaggaaacagaacctctcccaacaagtgcaagatgtatgcacgggcataacactcaacacgccatggctcagcatcgtcgtcaagatgtgagaagttctgactcagccaagacaggggtattccattctgcttcttcttccccccttgcccctgctcaatgttcagtggaatgccaaacagctgctgcacttgtgcatgccatccaggagtatctgtcctgcccgtcacggcatgcccccgtaatgggagggccaagatcatagccacatcctgtagagtgatggtcatctcaccactggggaagtggaagct

SEQ ID NO: 43656 - DNA, 3799 bp, Oryza sativa
  unsure (1)..(3799): unsure at all n locations
gctaccgatacttatgcacaagtgaatcaatgccgattcataccctccccgcctcgatcgcagccccgcgatgacgggcctcgtagtacgcctccaaggctgggtaagtcggcggttgtccctcctcggccatcctacatgaaaaagtaataaattcaccgttagttaccaatgtgacatatattaaaagaaaatgaatgcgagaacatgagtaggaaaacaaaatatttacctccctaacacttaaattttttttggacttcttcttttttggacgcttaggacacttagttttcttgtgaccctcctggtgacacaacgagcatctattttgcaccggcgcagcatcaagttgaacgcatgaaggtggtttccttccagaaccacccagacctgagtccatttcgttcttgaatcgtttcgatctcctcttccctcttgttttaatcttcaaatttgggtcagcaacaaattcttcaccatcgtacgatggccactgtgtggggtcgaggtatggctcaaagcgacttgcccatgtgttcacaacggctcttgaagagaactgatacggcattcggttgggagattccttatcaattgcatgaatcagataaacgtgtataagatgtgagcaaggcatatggtagagcaatggcctttggcaagaacatgagttcccctcaccttcaactttgaaggctcttgcgccgaatctaacaccaccacgcgttataccacccctctctgtgacctcgtatgtctttttctgcttatcgaaacaccttgcagtgtgtttgttcgccttactttcttgcaccttcatcttactgtcaaccttggtggaccaacgctgccctaactggactcgcttcaaagcttcatcatgtctgttcacaaagtagtcattacacttcatgaacgtaaatgatacgatggccgtcactggaagcttacgaacaccaactagcacgctattgaactgttcggccatgttggttgtcatgtaaccccaccggcggccatttctatcgtatgcacgagaccacttatctttatccaacaactcatcttcaagccatttacgaggaccttcgggaatacgctgccttagtgcctcaacatccctctcaaatatccacttctcgtcaatctgacatatccttaggagctcttttgtctgatgcttgtccgcaccggccttgtggaaattagcactgaagtgcctcatgcaccaccggtggtgaaccgatggcaatcctgaaacaggagtcatcatggcattcattataccagcatgtcgatctgagataatacaaacctctctatgcggcccaaccacaacccgtcggacaagatcgataaaccagcaccagtctcgtgaattctctttctccaccaaggcaaaagctaaaggtacaagttggtcctccgcatcagctgataatgcagtcatcaaggcaccaccgtatttcccagttaggaaggttgcatctatagctagtactggcctacaatgcttaaaagcctcaatggaggaccaaagcaccagaatgcacgcataaaattttcttggtcactccatcaacgttgacaaccctatcaggatgagtatcgatgtggtagaccatactgggattcttctgcttaatggcttgcagcaaagtgggcaaacggacatacgcttcaccccattcacngtaaatgagcttcatagcctcctctcgtgccctccaagccttgccatacttcaccctatactggaaaacctcaaatatatacaaagctaacgcagaagcagagagtgtaggttgcagttttatggcattgcataacctatttgctatgaactttgatgtcagttgccggtggctccctgaaccttcggcagtagcacaactatgttccttacctacccgtgatatcctccacgtgccactagacctcttagttgcatggaccttccatttgcaccgtgggttttcacatttaacagtgtacctcctatttgcggcagaattgacaacacggtatggacgatggtgcacgatggcgtactcctggagccatagcttcaatgcgaccatggatgggaactctaaaccctttctgagaccatccacctggaatggttctggcaactgatctaggttgatgccgccatctactagtgcaccatgggcatgtgttaggtccctaaactcaggaatgtccggcttcctcccaaacaccttctcaaacgcacgacattcctctaatgctaacttgtcattattagtaagtggagggaatggacggtcatcatcagagtcttcagcaaattcaacatcatattgctcaacacttgcctcctcgtcaacatcatctctattgacttctactgagacagaatcgtgaccaccactcaattcgacataaaagtaatcatctggattcacatattggcctgctacttctgtcgggtattcagggttgactccgtacgacgaccaatgaatactcgccgacaaatgttcacttagatcaagcccctcttgtactaactcccttttcatcaccctcgctgcatccacatcatcagtaccgcaatgtctctttgatggtcctgcctcccataaatcatttccaagcaaaggtctcttcttctctccttcaccctccaagtcttctcgtaccaactcactcttacttgcaccccctccacggcgagaataatatgtcacaaaattcttctcaacgtaatgataagaaggagatttgtttagatccaaattttctacggtacgaactaactttgatgcaaacacctctagagatctaaactgagactcttttaccaaatcaaagtaaacttcccattccaactgacctatcacatttaatatatacttatgcccttgaccaacatcgtatctcccataaaaacgaatctccacattatcctcggtccatccaagatgtttaggataagattcagtaaaacttttgaaattccaatattcaatttatattgcaataataagtttattaaatctagtaaatttatgatactgtgatagtatttttcgagacaaatttatgtatatcatttcttttatttctaaaataagcatttgaggaactgttgatggttaaaattttttaaaaaaacataactgaatttttcctaaacatcaaatatttttaccaagggattatgtgacatgagtatggatttagtgttttttctaaatcaatagaacaattttatttactaaacctaaataacttagaaaaacaaggataagccttatattcttcttaaaagatgagacattctttattattatagaacaatttggatatttttttccatatacaagactttccattctcaggaaacacctcattgcaaacatgaatatgaaagtgtttctattaaacagactttcagagtgtaagtacacttaaatcctaccatctgcttagtgtaatttcagactgtaattataccaaacaccatacaaaaattcattttccttacagaagaacacagtttcactgctgaattagtttctctaggttttgaatatattaatgtctagtacaagttgaatctcatatagtatttgcagcctcagttcatctgttacagttgaaattccaggtctgtgtgagaactgagaagatcaattactctgttaaaatttacagtatatgtcaatccagcaatatgattctctatttcaattctgtgatatacaggagtgaatgtcctgtgtggtgtgnnnnnnnnnnnnnnnnnnnnnnnnnnnnnnnnnnn

SEQ ID NO: 43657 - DNA, 12010 bp, Oryza sativa
ctcatactgtgccatggaagctgcctcatccaaatcacagctttgtagctcgaagtccggtctgcgcctctgtacttcctcacctcatcaaagaacgagtactgctccgggcacacacagcttgtctggttgttgctgccatcaaacatgcagtaactattgaatccacaggtgccactgcctacttttgtctgagcattgcagatgttttcaggttggatgctcactgctgtccatgcctgactcatgctgctgggcttcttcgggtacacatattgcctgaacacaccatctgggtcaagcgtagcacgatggtagtagtcctccatggagcggatcaccccagatgtcatgttgaattgtgttccattcttcatgctcacgtatatcctaccggtagtattgaacaccagattggtgacctgatttgtgacattctcatctatgggtgtggaccaatatgggtcataaaggtttccagatggaactgccatggtataaagtgcagctcgttgagtttccatgttaagaagaaacctgccattggagtaatctgtggtaaggagtcggctgcggagcttcattccaggggacagcgcttgtgtgaccaggatggtgtctgttgggttcttgaaagtttcccagctgatagtagagcctcctgcagcagcaatcacaaaattcccggtgtcgagcatgctggcatagggtgcaccagttgctcctggattccatacctctctattggtgggatctcggagagaaagtacaccagttgaggtaaactggaggatggagccaatggcacttgtatcggctgtggttcttgctcactggtcttggcataccatgttgccgtcttgtcgctgatcttgttgaaccagatggcgaggaggtagaaggaggagttgccatcgatgggccggaatccaaacgcgaagtcgcctgatggcgagagccatgcgttgtttggcccttgggttgttaatgatgtgcccaagctgatgttctgagcttgagcagatggggaggacagtagcaccaacaattggagggagagcaagaagagtggaggtgccatattgcttgttctgattattgcttccatttcctactttttattgcacaccgaagagttgacttgaccttacaagttatttttttttgaacttgtaaggtcaagtcaactcgagatcctgcccaccttacaagttatttctaaggtaaaatgtcacgaggaatagtatctgtaggtaaatggtcattgtcttagctggccttctatataccacctggattttgtgaactgaaatttgcatatacatacaacatcccttgcatcctccattctaagaaagaccatgatagccacatactttttctaagattgaactggtctgtcagtaagactattccatgcttgacttgctaaagtcttccaacttttcgagtcttccaaggtggtcaccacatcaggtcaagacgaattttagatagagcttcttctttggcactttacagggtagaagacaaactcttgttcagtttctgtttatctttatggtagtgagtatacaatgtccctatttctttctaagcttacaacttgaattccagttggatggtcttacaataatctctgctggatatctgtctatcagatcactgggtctgttactgacagtcaggctagctcaagctaatattccgttgtttgcctgtttgtcaggttgtaacaaggagtcaaaattttcagctaagtagctaatatatcaattttctttgcaaaatccgtagagattttctatgggtacattatttactcaaatttccttggaatctatattttttctccttcagagaattaagtaaacaagccataccaagtcttgtttggtgacagctgagaaagctttgaccttgtccttaataatgatgctgtgattggaaatgcgattgaccataactatttgtattgtacttagcattatttctccttgtctagcacaccagactactgaccaacgatcacatcatctgcagctgaaaagaacttgttttgcctgcattttgtacatctcagtctacatgttttgccaatatactcagttctagatactctggtcaaatttgttttagagcaattttttgttttatcttggttcaagtttctagtttttaccacaataagtaaccttcagttttttatatagctttgcttaggagagctcatgggtgtatctaatattttaaatttctaatatgcaccatacctatcggggtgacctgttcatcggcacaggctgttttacttggctgaccccatatctttgtcccacaatgcttgtctgaagggccaaaaggcctatgatatattgtaattgtaaagcaataaaaataagcatgttattgaaatagttttatttcgaaaatgacaaaatatctgggtttgtttgactttgggactactttgtcatgtgaagttaatctgggcttaaacctgttttaggatctccttttatctgttgcatggatggtaccttagtttcattctttcattctaggtatttggtgagttcctcaatttgcagcaagtgttacttgactgcatgggttttttcagaaatcaaggattcttggtgagctttgttggggtatatggcatgagaatataaggtagactaatctgttatgatgaacatgtatctgattctttctgtttacatctaaatttggcacctatggatgaaatagggaaaaattgccaaagtttagaaagtgacgggtttccttcacagggccggtcagaccacaggtgtatgggcggtctgaccggctagtagggccggtctgaccgcaggtatgtggcggttagaccgtcagggtccgagtccgagtctgttttcgtcgggtctcgggtttccttacttgggaaggcatgtttcgtgtttcctttggtttctatccctatttaagggacaaggccggttcactgtaaaacccccgaatacaatctacttgaatagttcttttactatgttttctattttaccctaatttagtccatctttgtcggtttgcgccgtaaaccgtccgtcgccgctgcgagactgcgacacccttttataggtttgtctgaaaaccttccgtttgcccacgagacgggtagttatcctcatatcgatctaaatcggcctagaggctgattttgagctctaaatcggctccgctagtcggtttagctgtttttctacagtacccatgttgatctggccctttggctagattgaggtggttggcgactccatatcaccacaaggcgtttaggtgttgcgatcgtacttgtcgacttgtcataaaaagttgccaacgtgatttttgacgactccgctggggaacgatctaatcggccatatcacggccgaatttcgtttaatctagtaattactgttcatcaaatcaggagtttcggcggcgaagttaattatctagtcgtcactgaatccatctgaatacttgccgttcagcacgccgcgtataccgaggatcatcgtcaggaggcagaggccggctcgatggcctcgtttctttttgtttcataaggcaaacagagaaaatatcaggcttctagagccgatctacctggcagacaagcagcaggagctttgtttctttttattactgtgcacgtgctaaaacaaagatcaggctatccaagccgatctacttctgttcacataaaaaaaaagccgattcctgctatatcggttattcccgagaagcttcaaattctccaatttttttgctaagtacagtagcatacaaggaaaattacaagaccgtatattaatctattcggtcagcgatttcggctatgatctatatggccggaattaatcaaggaatttcttcatcaaccatgatgagcgggaataagatcgacgaggtcacatgggaggatcttgacgcggagcaacacaagatgatggtggttacgcaggagctgttgatgaaatcatacatcaggaccaatcaaggcatcgtgaaggaaaacgtctcgcttcctcaagttgtagttttaccaaaggtaacctccgattcgcccaacccgtcctttgctaataatcactgtgtagatgtatatactacttctagttttactcctatacaatatgcttataatgctatggggggtcaatgagtgtttatacggctgattacacaggaatcggctatatgcaaaacctagataacggtatgactggtcatgacaccggtctaaccgcatcctatgccggttagaccgtgcccaccatggccggtcagaccgtgtactacgccggtcagaccatgcctaccataaacggtcagaccgtgtcctatcctggccagatcgcgcctcctgtggccggtctgaccgtaccattgaccaccggtcagactgggcatgggctggtcagactgggtgcttggccggtcatacctcagactggttccctggaaatttctccaggttttcataccacgactagcagtgctgattttaattattattcatcatctgttaatactgttagtcatgctactccacatgtccctaatgcttacaatgatcataatagaggatattctcatgacaccgggtacggccaatatgacaatattgcgccgcaacaaccaccttttaggccatcaaatccaccaccaaatccaccaaggcctgaaatcatggaggtaaggaatcatgctagggtttaccaaatgccgtatcctaatttttatgatgttgtcccatatcctcctgattataaaattcctgaatttgccaagtttagtggtaaggatagtaggaccacatgcgaacatgtaggtcaattcttagcgcaatgtggtagggctagtagtatggatacatgtaaattgcgcttgttttctttatctttgtctggtactgcttttacatggtttacttctttaccatcaaattctatttctgcttgggctcaattagaacaaaaatttcatgattattttcacactaatgaaactgagcttaagttgtctgatttaacattggttagacataaatacaatgaatctgttgttgattatattgaaaggattggagatgttaaaaaccgatgcttcaatttgaaaataactgacaaagatttggccgacattgcatataatggattgcttgattctattaaagagaaattgaatggccagatatttcttgatattgatcatgtgttgcatgaagctctggctcaggaaagccgagtggatgacaatagcttacaagctagtttagatgaaaatgcaatatcatgcatagccgaaccaagcgatggttcggattgtgttaataatttgtgcaatgatgctgtgacaagtatagctgaatcaaatgttggtccggattgtcttactagcttggatgataatgcaacaaccattatagccgaaccaagtattggttcggattttgttactagtttagacaacgatggaatagccgaaccaagtaatggttcggattgtgttgctagcttagagaatagcatcattgaaaatatagccgaactaagtgacggttcaggttatatcacaagcatagcattatcacctaagaccgagtcactaatcggttatgtggatgttggaaaagatgatgacaatgtcttgcgggatagtagtgagatagaacccaaagtagctatgcatacgtatcaaaggccgtatcctgaacatgtagattcggtcccatatccgcaaggatttgaggtgcccaacttcacaaaattcataggtgaggatactagaacaacaaaggagcatatcggccaatttattgaacaatgtggtaaggccggtagtgatgatttgcttaagttaaaattgtttcctctttctttgtcaaactttgcatctacatggtatagtttacttgctcctaattcaatttctacatggtcacaaatggagcatgagtttcatgattattttaaagatgcaagcttgatagagaaaagaccggttgatgatttatcggtcacttgtgagactatttcggttacacctatgcctaagaccggaattgttagtaatcctttccctattagtcctattgatgatgacaaatggaaagggaaaagtgttattattggggatcctcggcctaagaataggatcaaaaatgcgaaggccgaagatcataaagttgcaaaggatgagtcatctagttcccaaaagaccaaaaagccgaagctcacttttgagatgcttatgggtaagtacaagaaaggattagccggtcaacgatttgataatcaaactagtgattcaaaaagaccaagatcatctcgtagggagagatttggtcaaacaccaaagcaatcggagccatcaactataacaactccatacaaacctccggttgtgatgccatggtatccacatccaatgtcaccatttggttatccttttatgtattacatgccatggatgcctcaaccacctatgccgtgtcatcaaggatggaagcaatcacctaggacagtaccaagtaattctaactcaagacaagaccgtttctcacaaaagaatcggtccggtggatcaaaggtgaaaaaggtgtgggtgaggaaagaagccaaagctccggaggtcgttgctatcaaggagaaatctcaagatgttcaagtacctactgaagatgcggcgaaaactatacaagcggagaagactgaagccgacgccgttgctgtcaacatcggtggtctaaccaagctagttggctggtctaaccgccagactacggccggtctgaccgacggcttgtggccggtctgaccgggcccagaggccgtctgaccggggggcattggagaagagtaggaaaattgtgagcaacataggagcttccacttcgaccaaaaatatgaagaatcattgcttagctcctggaaaacaatcacagccgaagtggataccttctggcttatctcgctctcaaaagaggaggctacagcgtcttcgggccataggtcaaaaagaaaaggaggccgaagatgtggagaacaagacatgcaataatttagagcctcgaacagcacctaggcaagtgtggagatccaaagaggtaaaagttaagagaccggtaatttcccatagtagagataaatccaatttgatgacagaataatcatcagtcattagagataaatctccttcgcatgatactatggatgttggtgcggtgttcgtcttgccttcgaaattgtgcagtcgagaaagccgattttgctcagggggcaagacattaatatgctcatgaggaaaccaagagaagatgaacggtgatggatataacatcacatctttgagccgccgtttgttggatgctaaggcaaggtatgagtttattgtgtttaccattatattatatgcctatgccatgttattagaacattgcttgctatctagcacatgtgtgtttttgcttatcaaattcatattatacatacatgttgcaaatgccagttctaagtagaggaattggtaggttggcgtataatttgtttgaagtatgatttggctcatgagtctttgatatttatttaaagccaaatcatatgtgtttttatggatcaccatataatatatagatttcatatttattgcaccatgaaagttttgcttattagtaattcggttaatgtcaatggtcaatgtgatgatttgctttagagttgttttctttaggaacattggcattgttaatattttgcatacatgctcaagccgattacttacatttgtagtttattggaatctatgcatgtgacacatatgactttggtgattcattattgatcatacttcaattggctaagtgttttgatgctatgatgattattgtttcaaaagccacttgaattagtattcatctagccatattagttggatattataatttttcatatgtcgagagagaaggaattttggtccaataatttggtacaccaagcatctggctattatgtgaagaaaatttatatactaaaggccgatgcttgatttcaaaagtttggacgaaattggcaaagtcatagaccaggggcggtctgaccggcattgcatggccggtctgaccggtggtatcggcggtctaaccggttctgcatggccggtctgaccgggtagacaaggcggtttgaccggcattgcgtggccggtctgaccaataccaggcggagaattagggggcatgttacaattgattaaaaggccgaattaattgtgaattcggacatttgtgcccatgagttagaaatagcttggagaattcctttgattagatatttgaaagatcctacacataaggttgatcagaagattcggcggtaagcgttcaattattatatcgccgaaaaatagatggagtattacttagataatgatcaatctaaagttgctaggagagtagtacatgaaaggatttgtggaattcatcaatcggcccgtaagataaattggttgcttaggagagtggggtttcattggccgaaaatgattgatgattgtttcaaatgctatagagggagtgaagcttgttaacggatcgacaatgtttaattaatgcctaccgctgtgttgaatcctatcattaaactatggccgttctgagattgggctttggatttcattggtcaaatttatccttcgtcatcaaaagggcattggatcgtgctagttgcaatggattacttcactaagtgggccgaagccgtgccgctcgagaatattacttgtaagcatattgttcatagatttggtattcctcaaacgttaaaggagcttcttttatgtccaaggaagtgagaagttttgctgaatcttatgatattaggttgttgagttcttctctttactacgctcaggctaatggataagccgagtcgagtaataaaacattgttgaaattgtcgttttgccagttgaggtaaatcttggctctctttggtatttcaagctagacgacttgtcggttggagattacaagaccttgatgggaagcaattttgaagacgtcatcgacaagcgtttgaagactttgaaggagatgaagacactccaagacggtgttttcagagaacaattcatgggaaatacttgaagaaatacttcccgagtatttggcaagatgcttaggaagtcctatggccggtaattggattatcgccctgagataacatgttctatgcttttaggttcatgtatgttcactaaaaaggcagggggcatgtgtttacacccaaatttggcacctatggacgaaatagggaaaaattgccaatgtttggaaagtgacgggttttcttcacagagccggtcagaccacaggtgtgtgggcggtctgaccggctagtagggccggtctgaccgcaggtatgtgggcggtcagaccgtcaaggttcgagtccgagtctgttttcgtcgggtctcgggtttccttgatcgggaaggcatgtttcgtgtttcctttggtttctatcccgagttggacgtggagaagacctgtagagggggagaccaacccctatttaagggacaaggccggttcattgtaaaacccccgaatacaacgaatacaatctacttgaattgttcttttaccatgttttctattttaccctaatttagtccatctttgtcggtttgcaccgtaaaccgtccgtcgccgctgcgagagtgcgacacccctttgtaggtttgtcctgaaaaccttccgttttgcccacgagacgggtagttatcctcatatcgatctaaatcggcctagaggctgattttgatctctaaatcggctccgctagccggtttagctgtttttctacaaaacccatcttgatctggccctttggctagatcgaggtggttagcgactccatatcaccacaaggcgtttaggtgttgcgatcgtgcttgtcgacttgtcacaaaaagttgccaacactttctttttctcaaagaagatttggtttgatgctccagtcaccaggtacgctataaataccctaagaaagctcagtacaatgtacccataactacagtacattcatgtctatatgctttctgatccaatattcatcatttgcgaaatggtcacactaatttgaaattaaaaaaaatacccaaagctgctctcttctcctaaacatcaaaactattctatgcaccatttcttgcaaaaccaagatcctgaagcaaattttaactttcctttatctgcttctaataactgttattcaacaaatgcaggtcgaaaacacacagaacgatacagaagaggtccagcactcaatgcttttaagaataacttataaagagtttacattttcacgcatttgtttgatctgaaatttttaggttgtttctacacgcagaaagctatctcctgacattgagctacatacatcttttgttttgtccccggcagggaaagatgaattgcaccgtagttctgttttgtgctttcagtttcagctattcaatcttggtgtaattgactagtctcaataaagcttccattatctaaaaagctaatcaatcttagtgagcactctgatattgaccttatggacccattaacatgaatcataatcctcaaatgaatcctccattcaaatgatcaattcctatacagcgctaggccaggatggatgcaaccaattaatgatagttcatttatttgtagataggtaccatataaatttgggaaaattacatccataccacaaacttttgaacggtaaaaaaaaaataccacagatcttcccaccttcccagcaataccaacaataccaatatcaattgaatacttcgattgttattctttatatttatggtgttcttcttagtcttgtgttattttatatgcttatgtcgtagaaaatgagggcacatgtttaataaaaatacacaagaaccaaaagtgcataatatcattctaaactgagccttgaatttctgcctttttgtgactcatatttttccccttctttcaatgaccatgatattattccatatgtagcttgctgggattagaactttggatgatatatatggagtgcaagtacggaaaggctaatgagcgggtgatcgctcccccacccgcccagcgatcacctgcccaccctctcccctatactactagatgtactcctccctcttctcccccttcctcctctccttctcctctttctactgcagtagaccacacaattttttgaaaaacaaaagttagaaaaatttatgtatagaaatactatatataaaaaatttgaattcaaattcaaatttgaatcgggtatgtaaacttttgacttataaactttgggtctataaactttaggtgtataaactttagatgtatagaaatactatatatagaaaatatttgaattcaaattcaaatttgaatcggatataattcaaattcaaatttgaatcgggtatataaactttaggtctattaactttaggtgtataaactttagatgtatagaaatactatatatgaaaactatttcaattcaaattcaaatttgaatcggatatttgaatttaaattcaaatttgaaacgggtatataaacttttgacttataaactttaggtctataaactttaggtgtataaactttagatgtacagaaatactatatataaaaaatatttgaattcaaattcaaatgtgaatcggatatataaacttttgacttataaacttttggtctctaaactttagatgtgtaaactttaggtgcataaatttactaaaatagaaaagtaatgtggtgccaaaaaaggaaaccaggtggagggagggaggggggaggtggggagcgaatctgatcgctaccccatccgcacggcgatcgatcgcccattaggggtacccgtgcaagtatctataaccatcaatgaaccagaagtgagag

SEQ ID NO: 43658 - DNA, 2042 bp, Oryza sativa
  unsure (1)..(2042): unsure at all n locations
cataataaactagtcctataaatataagttttttttaggcgcctcaaaagattagattgtaaatgccttttgaacaatgcttggagaaactatctgtatggtctcaatttcttaaaaaaacattttgaataaaaaatcagaagcatataactcaacttgtcaactgtctaattccctcaaattataaaatatagagtaaatttcacaaaactataggtactttaatcaatctatctgaaaactacagttttaaaaatgcatatcatgaaactacagatttaaggtatcgtatcagaaaactacgtatttaaaaccagttttatcataaaactaagacttttgtaatctcaattgtgatatggatataaactccaaaagatgtagttttctatgacttcttcactaaatatgtagttttgggatacgatatcctaaacatataattttgcgataaatttggggttaaatatgtagttttgtgatacatatttctatatatgtagttttgtgatagtttggtgaattcatttgtagttttataaaatttactctaaaatgtatgcttttatggccatcagcctgtccaatacgccgaattggctggtttggttcacctactcgtttgcacgtatcaattgccagagcttaatcacgtcgtctagctgcacgtgtctctgccttttttaaaaaaaatttctcgactgtttgatggcacgagatggtcgcgatttcagcagtaattcgttaccggtaggagacattggggcctcgtagtttactctgcaaccttatcaacctctgtctaaactttaatttgaagttaattttgagtattttcaacgtagtcttttttttttaaaaaaaaattagcttttaagctgctaagagcttatatatatatataagttttatacatcaattatttttttattactaataaaccattacaatttataattagttttggtcacgatcaatgggggcaatttcttgtgtcttcccggtgcagcccaaccggcaccatcatcccaggaatctgcttgtcctgctcgacttggaagtaagctacagactactacagcatatgcaggaccaggcagctccagaacacacatactacgacattggatattcaacaaagtaatactagtactaaacaacttcgtttgttacagtactagaatatacttattactcatacataagcttgaaactgttaaacctcaaccactcatgtcggcatctcttcagaacttatcagcaagcgaaagactggagaccggagagaagcagtagcagcagcatgcagtaatcaaggaccaatgcctaatgctacagtactctctgtttagtatagtgatctataatctgtttgttactgaggctctgagcagagaatgcagcagtacaagtatggcctgatggccagcatctaccctgttgatgattgctttttatgcactgcgaaagaagagagagcgaggcacaggcaggcaggcagtcagtctcgggcctgcactgcctgcttctgcgtgtgtggcaggagaggcaggagcaacggctttgacgcgtcaataggtgaaattctaattacctgttcagttaataatagtagcattttcaagtaaacttggataaatattactgtaaaaacttttactaatcttgatatgatctttgtaggtatagccaagctttaggtggtgtttttttcttctgaagatgaagataaagatgaaaacgattggtattaacgtatgattgattgagttttaattattataaacttaaaaaataaattaatatgatattttagagcaacttttatatagaaagttttcgtacgaaacgtaccatttagaagtttgaaaagcatgccatgaaaatcttaatcttcatccaactcttattgaagaaaagaacgggaccttagtagtgacaactttgtaaggttccatattacttgagtaatgctaaagtcacacaannnnnnnnnnnnnnnnnnnnnnnnnnnnnnnnnnnnnnnnnnnnnnnnnnnnnnn

SEQ ID NO: 43659 - DNA, 7379 bp, Oryza sativa
atgcctagccaccagtgaagcacgagccgacgccagcgcctagagaactcccctacaagccactaactgtgagggatgtcgctgctacgtctgaggccacgaccacctcctcatgtcgcgacggtgcctccggcgccacctcaggcccccctgctcctatggccgccggtcgccagctctaccaaccagttctggcgacgcccgccacagcccccgcggccccactgccaactctcttgcgcccccgccgcttgccacctcatcctccccttcctccaccttcgccagctctagatctgtcctcgccatcgccgctgctccacaccgccgcctatcttcccccttccccacctccacctctagctgccgccgtcatgcaagggtggctagaccagaaggggatgccaagtccggcaccgtcgccacccccgcgcccaatcgcctccgcgcccagccgttccgcacctagctgcctccgtgcgcccagcccaacgccctgagcccctaacacagagggaggaggaaggccccgctgctgccatccttgcagccgcgcggtttccggcgttccgctcgggcggcggcgaggcgtaggaggaaggcggtagtggtcgccgcccgtgtcgcccctacccttggagcgacacgggggcctcgtctaaccttctgaatcttttaggttcaggtggacttgttgatggcccaacatataaaaccaacccttcgcccatgggcagtacccattttgcaaatgggtgctatgggaaagcagcccgtatcagcaaccttcacttcatagatgcagcaggccatagcttcatatcccagacaacaaggccattgctggtacgaccaaagaaaaatgctacacggttgatagctttggtcaggatagtactgacatgcacgtctttggtggacctggtggttgtaacaaatagcttaattactagcttgttccattgtagggacatagtaaaaaaatcaagaaaattcgtgacatcaaataaaattgagaattctttctttaatttgccactcaaagttaccatgtttccttattttcccttattcgccatcaacatcaacacaccatgaaaactatcatcttagaggttaaatttagatagaaatgacaattttttcccctcagccaaatatgtgcatagttttcacatcccatttatgtttgcctaatttaaaatttcacattcgcttttattgtccaaagatattagcacgagtgtttttattttcgactaattatttttcagaggtaggtgacatacccaccaacaatgagacgcctgtagttatcccgtaaatcccaagacatgtcgatttagtctttgaaggtgctcataggggttgggtgtaagtttatagggtgagtgtgtgcataattatttaagcgcatgtttctgtattgtgtttaaaaaagtgtttaatttgaggaaataattaaatatttcttttattttttcatatgtttgttaattggagtttatgtgattttatttgccttctagaggtggaggcttttccctaaatgctgtaaattctagaaaaaaaattcaaaattacaaattcttgaattttatttcagaaaatctgttttcctctccattcctttctgccccttttcctcccacttccatcttatccaagccgacacgtacctcctatatttctctcacttccctcccattccaaagccactcgatcatcacccttatctcacattgcaattttgtaataactaatactcacctatatgatatgttatctatcttggttcggtgcagatatcattgtttcattttttttatgttattattttggataatgcttcaatgcaaatttacaattttgaacgtaaggtggcagcagattcatcgttgcaaacaacatttctaatacaaccagcaatcgcgtcaaatattaattatattagttggactcagatctaccaaaataccgatgggcattgaactcgaacattgatttatttgatacaacatgctagtacactacagatgtatcactttgtgcaattaccaggtccaccatataatagacgggctccatcatcgttgaacctgatatctccagcatcatagcagaatggtctagtactgcctgaaaatgtgttgtgtgtgcctggaatgaagtactggctgtctttgttgatgactttgatactcctcacataggcagctttcccaggtccagtggctgcccaatgtccactgcccagttctggaaggtgtaattgaactgttggtccatggacttgcccaccccaaaaacaagcacttgctttttcattcatgtaggtgaaaattgaaggaggccaatatccaagtggttttttatcacgcccatatgctagccaccaatttccggtcttcgggtcctacaatgtgtggtgatcggcgacatgattaaataaagtcttgcataaataaattgatatatatttcatccttcaaaattctttccgtcattcccatttcccaatttggcagtaatttcaacttgatagaatgtgtggttagtttcactaagtaaatatatacgttacaaactacttagaataaaaaaaatctcaaaagaaatctaccttattgatctgtactgatttgaaaaaagaaaatacaaacttcaatgacattcacacactttcaggtgtagtcgtgttcataaactcaaaatgccacttcaactaacagaggtatcctaaaattttctcttgtagtgtccttacaagtgatgactacttgcctaatcattatggacaaaagaacacaactaaatgtttatggcttatagttatgatataatcatgtgtccaagtattctaggagagcataagatgaacaatgttagcctatgaaatgacaagctgaaaacacaaaacaattgtgaaaacaacacctattttgcattgaaaatgttaacctaacacaatataataaaataataaatagcatttatccaattaaaatcagagagcatgcgaaaagaacaaatagtactgccttaaataagaaactaacaaatagtcttgtccccatactacattagcatgttaattgaagcttaacattcaaaatatcttatttgtactttatcaattagatgtttcatgaactgcaaagccacactaataattatatgcattggaactatttctatttaattaaggacacattggaatacatagaatggcttgatgacacaaatcctagatgattcattatatatatatgtgataccatatacagtttgactcgtaagatggatcaacgtgctcttaggaagcataaacccattaagttacaaagatatcgaatggacattctaatatccaataaatgcaacctcctctctttaattatcagttgaattttatattgttttctggtgagaattatattgtttgatataacatttagccatgttgataatctagtttagagaaattatgtttagtcccatggtacatcatgtaaagttgatgcatttaaccatctaaagtaatgcttgaacacaaggatttcacaaatcaaagatataggattccagaacaagtaaagacgattttcaataaaagtgaattcattcgagagttgttaagcaaaacatacctttgatattttcagtaaaaaaaaacatacctttgatatagtaacagtaatttcatactgatctccattataggtagaaactggttcaattctcccaccaataccaacactcgtactgacttgtacaaagccaggacacatatgatcaaagcatggcatgttcaccgtattaacttgctgccataaacaaaaagtaaatagaattcttaagcagtgcaatactgttcgactcaaaacaacaacaacatatatacagttcaaatgcatgactgtttacagaaattcttacccagtatatatgaaatctggcaaagttgtcaccatggtagtttggccatacctaaaagcattatatattgaaatatcgattagtgtacggcaaaaagggctttctattaaaaaaaaaggaaagtttaatgcaatgaagactttactatagactctgttatggcatttatgcattaggaggtggagcagcatagatggtcctacggagggcttgcggcgggcttgcggcccactaacgtcctaggaagcccaaacagacattttttttaaggaataagtccacattccctccctcaactcatggccgtgtatgaatatatagcatccttcaaccgcaaaaccgggtataactcatcccccaactctgaaaaccattgcaaatcaactccctgggcggttttggaggtggttttgtcctacgtggcatctttgaccctgttgacttgctgagtcagcaggtgggacccacctgtcagtgactaggataaaagaaaaacggtgggcccactgtcaaccacacttcatcttctacccttctctcgctcctccggccgatcccgacggctaggagctcgccgccatcatggtgcctagccaccgcgacgatgctgctgggggaggcttgccggggacagctgtggatgggtagaagcgcggcgagaccgaggccggcatggcggtcgttccgagaccccatggcaagcagcgagagtgcgctgagcgccacgaggaggagcagcgccgcccgtaccaccgtaatgtacgacaacttctccccgccgctctttcccctcctcctcctgcagctatgtctgcacatcagtgcacatggattgccggcggcggcccgcggcatagcgtgattcgtgcggccggcctcgggggagacttggctagggcagcacgtgagacggcagtggcaagaccaattacatctacaaacggctccaggaagcaagcagtcggatataaaacaatgcaagatcaatggttatccatcaaaaaaggtgcagatagccaggtaccccaacaatagtatcaatcagaaaattgccgggtggcataccatgctgaccaaatttactaagctatcgatcagcaatttggtcgactgtatcgtgatttttcaagcgtgtatgatactatgatgcttatgatcagcactaaatcactctgcccaagcacgcaaaacaccgtcaccagagaatccccgatccccaagcctaggggggaggccgtcgtgcacatggacgtggcggcgaagacgggctggtccacctgcagtgagaagccgctccacgtccaagggttgccggccagctccctcatctcgttcgccctcctccgctccggatctgaggagggggatggcggggtggggcggcacgtcaccgccgggatcggccggaggagcgacagaagggcgtagagaagaagaaaagtgtggttgacagtgggccccaccttttccttttatccttgtcactgacaggtgcgccccacctgctgactcagcaagtcaacagggtcaaaggtgccacgtaggacaaaaccacctccaaaaccgtccggggagttgatttgcaacggttttcggagttgggggatgggttatacccggttttgccgttgagggatgctattaatacacagccatgagttgagggagggaaaatggacttattcctttttttaacccttaagtactgctccctccgtccctaaatatttgacgccattgacttttttaaacatgtctatctgttcatcttatttaaaaacttttgtaaatattattcaaaaacttgagtagtagtagtatatttaacaatgaatcaaattataggaaaaaaattaataattacttaaattttttgaataagacgaacgatgaaacatgtttaaaaaagtcaacagcgtcaaatatttagagatggagggagtactccactaaagtttttttacccttaacactaatttagtgtttaaaacgtcatatattaacgacaggaaggtgtactccactaacgtttgtggtagtccaattaaaatcagacaattgcacagatgaaaaattgaggcagtttttttctaaggtgttttttcaatatttactagtgtattaagttgcactttcacgcaactataaccaccctctctgttaatatgtctattggttattcgtattaataataagcttaaatttgtaatgataataaatcataataacacgtttcgatgggtacataggtgataaccatattagtacatcacagatatatactatacatactcaaggctaattatatatactttgaatgatgtgaagattagtctgaaccaatgaatctttattaaaggatgggttttatttgaaaataatctttatttaacgtgcaagttataaaattatatgcactacctatatcttcctccttttttttttctttggctgttagatctttgtaaatataagtcaatgatttattagtaatttttttaaagaaacctgcacatttaatagaccgaaaagaccgataccgagaaattcggtcatcaattcggtccaaggtagtgaaagactgaattttgttcggtcaattcggttagtaccctcgggtaaccgaatagaccgaattatcaaaaaatatctaaatgcaacctacaatccactatgtttaataggattaaactctaattttcacatccctacttcttctaggcatgcaacctaataagagtctttactcataagtgcttacgaattttttttttgtgatttttgtgttaaaattttccattatttctttgcatatatgaaaatgttgttgaatttcggtcagaaccgagatcgagaccgaaaagaccgagaccgacttttgtcggtcctgacatttttgtgttcttcacttttcaaagaccgaaaagaccgaaagactgagaccgaaattttcggttagaccgaatgcccacccctacattgtaaaactatatccagaatcttactagccttttcttcttggctttggagatttcgagacaaagttaaattaataaaaaatgattactacgtcctctatccaacggctcatatttcttctatctatattttgttaccatgaatccaaaggtcattaatctgctgattacttggtgcatcctaaggtagtgtttggttgctgggatggaatgggataggatgggatgaacccatttttaggggtgtttggttcaggggtgagtgggatgggttggtccctacagaggaatattcctctcagatccgggaccaatcagtctggccaaaactggcggacgaactcgtcccacttgggacgagcgacggcgtgaaaccgccgctttgctcgcacgctcttcctcgggagacggcggcgggctcggcgacggcggcggtgggctcggcaacggcggcggtggggg

SEQ ID NO: 43660 - DNA, 26601 bp, Oryza sativa
  unsure (1)..(26601): unsure at all n locations
cgtcctattctacaaaccaaacacccgaatggaatcatcccaatcctcaaatcagggatggtttcatcccatcccacctagtcccagaaccaaacacacgctaattgagttttgggattcacttttcacctgtaaagaccaaagtttttcatacttgttgtctatgtctgttccacatgtaaggggttgcgctagaaaagcctagaataatctgtcttgctgctttttaccgatcagatccaacgattttccttcgtcctatttctctatgggatggttcagtgttttttattacttggatcaattaggtgttgtcttgggttttattgtccctgactctgaaatgctagagcaaactggatcctaatacaatattcatggtataataactgcaagcttagtgtaacttacaatagaaccagcaccgattccctcataatttccagtaggtccgtttaccattaatgcccatgatgcactaagatcattttgtcctcgcacttttggctcatagacattgattgcaacttgtgttccatatatttcatcatatgttgtacacccagctctctacatagaagatagagtcatgtttattattagtaataaaaacaaaaattttggatagaagaaaaacttcacacacaacacaagtaacactaaggtgagatttcttgattcctaattgttttagggataaatttattacttgctactaaaattgtactcattcacttagtttgccacttatactgtcctaatgacagtacgtgggggtttcaagacacgcatgtcagtaagaaagtctgtgtgtagaaatttgagaggaaactaagaaattgccataaaagacattctttttttagcgtatctggaacgttgatctggaaattctttcaaaatcgttcttacttgtggagctctagttgatagagttagaacaagggaagaaaaagatgcagaaggagggcaaggtttgtgcaaatattaggaaaaaaatatatgctggaaactacatatgtagtggtaaacctggaaactaccattagattgaaaaatggacgtctgagattcgtccacgtcaccacggatacaaattttactagtaggtttatatttttactcatggtgacgtgtacgaaatctcagacgtacatttttcgatccgatggtaattctaggtttctactacatattttccaaatattagtgttaacatttatctgcattattacggtgaacttttatcattgttttattcaatacaaatagtcgtagaaaaatgccaaatttcaatatcatattatttaaatattttatgggcatatattttctaggttagtgcaaatcaaaagaacatttgtaacgttacaataaaagaactacttgactctggaaagtattcttttgattagtttgaggagtaaattagaacatacctcccctccacgatgatgggtattaccgattggatcaaaactaaattgtgtcttcagatcagctttactattttgtaacaatggtattgttccctttgggcatgcaatggtaggcagatgagcttctgtcgctatagtgtctgatgatgatttgattttcagctctgatggataagaggtgggctccatctggttgaaaagtttacaaataaaaaaatgttgggcaaatgaaacaagtcataaaacactatcacattactatttactccctccgtccccctaatataagagattttgatattttccttgcactgtttgaccactcgtcttattcaaaaaatttgtgtaaatataaaaaatgaacagttgtgcttaaattactttagataataaaataagtcacgaataaaataaataacaattctaaaattttttgaataagatgaatggtcaaacagtgcaagtaaaatgtcaaaatcccttatattataggacagagggagcaatatttactaaactacaaacatatgcagtcatatcccctttccttccattgataataaagaacaacctagatgctcaattaattttgccaaatcaagcagttgatttgcgccaaagaaagaaaacaagtccaaccacaccttttttgtgtaattgactaattgagaaacatgagttggattaaggacttatttgtactatttgattatggggttaggatgagaagaataaagcttgataatatgaaaacggagaaagagagtgtgaaatagcaacatacctgtattatgtgccctttcaacaatggatgagatagtgctggttgtagattgatatcgatgcaatgaaacacgtcgccgtctccagtctattaattgtgaaatttatattgcttgtcaactagacaaaggaattatatatgtaaatctagaagaatcgaaattatatggagatatgaaatgaaaaaggtgtgtagatagtacctcaatgatcttgttgataatcttgtcggaaataggttgatcataacttgcttcatgctttacatatctaccttcttgtattcctgccgcaaggaggacaagatatgatatgaaaattatcactggaagttctagtggtttggtcattgagaaaactgaattgttcactattctaggatacagacctaccgttttataggacatggagggtggctaccgctcttacagtaacccccgttttaatgaatttggtggaaatgaactgtcatgtctttgactcaaaagatatagtgaagatggaaaaaacaaaagacatgatgtatataatctgcgaatgatgtacgagtattagtagagaaatcaaatatgaccgctcaagaagaatgaatttaatgcctccagagaatctcatttattgcagttgccaactaagaaagatatagagcaataaacttaataaatgcatgaaactagtctatatttattagaaaatatataatctacagaattattggcacaaaaaatattgcaacgatatataaattgttgcaattagttagtcagtgattgagtccacgactcctcctcgttgtaaccgtccatgcttccccattcttctctctcgctctgtccctctctctcgccacgcgcaaccgttgtcggtcgtcgagacgccgccactgtgtgcctcttggctcccagggcgccgccttcctgttcttctcctcttcaactcctcatgtactattcctcctctcccaccctcatctctcccaatgtggcggtgttccttcggctagatctaaccatccctgatctcgggtatcagatccggggcgaggccaccatgtagatggggagagaggcatgaatatggcttcagctcgggagcttcttgcagccaccatctccatcgtcatgtcccttaccggtccgatagaggaggtgaagaagcagatgctggtgctgacaaaggtgaagctgatgtgcttgactagttgggaaagaatattgcaaaccatattcttttgatgttgcacataatgtttacttggtgtttcaatcagtctctttttggatgttgtacaaattggtacaataatttcttgatgttgcaatattctggttttgtgtgttgcaataagtatcgttgaatgttgcatgtgattgaaacatctttcgatagagcaatgaaacactcttgatcaagtcatggcacgctgaaacaattctcgttgaaacattttttcatcgaattatgaaatatatgaaacattttttttggatgtgatggaaccctatccgatgtttcttcttccatcggacgtccgatttgtagcgctctcccaataaaatatgcattgttatcatattttagaattttacttgcaaaagctaaaagttaccatgatgaaaaatattacacggtttcaattttcattgtaataaatatgctctcatacctcactatattgatgtggtaaaattatttgaattttctttgaattataaataagctattgcgacaattagataactattgaaatatgcttggagtagcctaaataaaactctgttgcctggattcttacgttacagaactaatctcagcaaagtacagccacaaaccagcccatctctagttctccaccttcctagcaaatccagccagccagcccactatacccaagtccttctagatggaaataagttcaccggaggtccctcaacttaacaacgagattttttaaggtcccttaactacaaaatcagaaatgtgtacccctaatctcacacaaaccatgcacttaaggtcctatggcagtatatatgggtgggtttgctgacgtggcatcctagtcagcaaaaaaatatttaaaaaagtacgtggggcctgtatgtcagctgcacattttttttttcttctccttgtcttctcttctctctcttctctcttctcttcctcttcagtgagggaggccggcggagtggcgatgggcaggcagcaggcccgtgcagcagcggagtggcgatgggcggtggcaggcagagcggcgccgggctgtgggcggagcggaggcgggcgaagctcatcttggggcagctcgcgggatcatggggcggggcgcatccaaagcgcacattcagatcactatttgtggaatgatattttgcacaaatctggtttgcgatggaatgaactgagaaacgagcatcatctcccctgtgtcgtcctctgtgccaccgtgagagcacacgacacacctacaagagttcagacattcatggaagcagctgcaagggacccatcatatctgctggaagaagacaactaacatatttcggctgggcagaataacattcgtatcaaatccaattcttgggtgcaaactctaacatattttggcttggtttgatcgcaagtataggttttggacaactgacagatttttttttatcatagaccagagactgacagatgtgctctctatgagggagaacaatacaggaggctgccctccacctgctgctggcccaaatatccaacagcgagagaacaaaatctacattaattttattacggcaaggagaaattcactttgagtacatcgatttggtggactcatgtagagttaaaagtactctactaatttggttgggagtaacgttaatctggttaatttcgattaagagcaaccaaaatactgtattttctatctataaaaaaactccaaaaatacaattttttttatttgagaaatgcattacaaacgtagatactcacaatacacatacacccatataaacgcacacatacacccaacctttattagcgcctcgaaaagaccgaacttgcatattttgagagtgacaaagtcatcactggtacctcgttatcgataagtacgttgtctagaattgaaaaaaataattagctgtaaatatgagtactaaaaaatatattgtactcctctatgttctatctattatatgcaatacaaatattttcagttctgttatcctaaattcgattgccccaatgtgcaaaactctccataggatacacacatcactctaatcctccattacctatgacaaacacattcattccgtgtgaaccacgtttgatttagccaatcacattcaccaaggcaaatttggagcactcaaattccaattttgtattcatattcccattcaacaaacccccacagcataatttaaaatgtaggcgtctgtgtgctgcaggaaacgtacgtccaatccacaataatttatacacgcgtatatacttcacggctacgcagactgccgtttacacagaaacacaacatcgtacacgcaccgtatgtgcttacataagttcgtaccactgactatatataccaatgcatcctaattccaattcaccaaaccaaagtagagttcacagaagcagcagcagagcagcaaccaacagcagcaggatcaaggtcacacaaagcctgatcgatcatggccatggccaaggctctgctcttcgccatcctcggatgcctctgcctctgcagcgctgttctagcagctcgtgagctgagcgatgacgcggccatggcggcgaggcacgagaggtggatggcgcagtacgggcgcatgtacaaggacgatgccgagaaggcacgccggttcgaggtgttcaaggccaatgtcgccttcatcgagtcgttcaatgctggtaatcacaagttctggctcggcgtcaaccagttcgccgacctcaccaatgacgagttcaggtcgacgaagaccaacaagggattcattcctagcacgactagggttcctactggattcaggaatgagaatgttaacattgatgcgctgccggcgaccatggactggagaaccaagggcgtggtcactcccatcaaggatcaaggccaatgtggtaagaaaattcaggctactcagatgacattcttcagtatcttttatgatagagttttgtgataacatctattgtgtccaatgcattgaacatgaatgattattgcaggttgttgttgggcgttttcggccgtggcagccatggaaggtattgtcaagctaagcacgggcaaacttatctctcactctctgaacaagagcttgttgactgtgatgtccatggtgaggaccagggctgcgagggtgggctcatggatgatgccttcaaattcatcatcaagaatggtggcctcaccaccgagtccaactacccatacgcagcagtagacgacaagttcaagagtgtatccaacagcgtcgcatcgatcaagggctatgaggatgtgccagccaacaatgaggctgcccttatgaaggcggtggctaaccaacctgtgtctgtggccgtcgatggaggcgacatgacattccagttctacaaaggtggtgtgatgaccggctcatgtggcactgacttggaccatggtattgtggccattggctatggcaaggctagtgatggtaccaagtattggttgctgaagaactcctggggcatgacttggggtgagaatggtttcttgaggatggaaaaggacatttctgacaaaaggggcatgtgtggcctcgccatggagccttcctaccctactgcatagggaaagctcaagtgtgatgtggatgatgtatagggattgatgaataatgtgttgctgtggttcatactttgtttgttcaaaatatataatttataatgcacttatctacgagatgcatggataacatgggttggatctgataaaataggtcaagtatatattgtccatgagcaaatgagcctttgctacaattaattaagatggctggtaaggttataagtagaacaaataacatgtactgtcataatttataattcaaattgttgaaatcactagcaatcacatacactactactttctctgtttcatattataaatctagacatatatatatatacatatttattaacatctatatgaatgtgggcaatattagaatgtcttataatatgaaacggagggagtatagaaaaggaaatttgtgctggttgggagatgaccataggtgccagattttccaacgccacccagcaaagcaacacctttgaggtcccaggaatgaaaaaaaactggcttgatgccttgaccaactctccgtcatcactgagatcaccatcattcacatcaaacacaatcacaatcatcactgagatcaccatcatcacaaacagacaaagaatgtcaccatcacatcgacgaccgggccaaccccgtggtcgtggcggtggatcagtccctgtgttgacagtggcgttggttggatggagaagaagaggaggaaggaggggtggtggtggtggctaaggaggaggaggaggaagaggaaggaggggtggcggtggggatgaggaggaggaggaagaagggcagtagcggggagaaggaggaggcggcagaggataacgccagtcggctcggttggccggttttttttaattataggcggtcttttaaagaacatgcacatataatatcagtataggtatcgatttttttctagaatcggcacctgtatgttcttaaagatgccagtttttaattttttttatcccatgaaagtggaaattggtcaatagatgccggttttaaatgaattggcacctatgactatgagccgtttcctattaaggtttccattgtagtgttataatttataattataataatttatatttttatgcttcttggtgtattttgttagataatgtcttggtgtacttatgtaccattaaaattactactgatgcttggtattacaaagctaacattttggaaacatgtcaccatatttttataatattaattatcgttctatgtaaataacttaaaaggtggaaaattcttcgtaaaatgtcttatccctattatgatatataccagttataaaaaaaagaattcattttagacctgctatgtaaagttaatttatgtctgctgaatcctgagtaatctagcagtttgttctccctatatacttttcaagtgaaaaaaaaattgtaatttccataacatctggactggctattctcattaattaagaatgcattcaaagaattctattcatttcaaatattttgcagcgaattcagtaatatttttactagagctccctcctgaactcctgcattgctttcttagctttattcaacaagctcgcagcatttcgcctgtatttctctttccgatctccatccatcatcacctcgctgatgcacctcttccctccataagtaccattcttgtcccattgcacctccgcgcacctatgccccacaaggtctccatatagtatgcaatggttggttgatcagcccattgtgcattgccaaaggggcacaccgttggcaatcgcctccaatccgtgatgagcccacttatttgagtaaaaattaaaaagagaaatattgattattcaccacttgaataatatttatctcttctctccctcccttctctctcgctctcttctctctctccccctcccatctctcccgcagccggcggaggcgatagtggcaaccacgccctccgctctgccagatccggtaggaggggaggcggcggcngcaggaggggaggcgtcagcgacaggcaggggtggtcggatcctgcgttggcggcgggtggggtggctcaagaaagggagccggcggagggctcgcccgtggggaggagccctcccctccgctagatctagcgggaggagagacggcagtaggggtggtaggctcgcggggggttggtggtggcaggcggcgggctctctgaagggagacggcgcgatgggaggtggcgcgacggatgaccgtgcaacggcgacgactgaagaggtgtgatattttttattccataaatttgattagagtgccaaaatttgtgtcgtgggatgaatgctgccaaaatttgatatgtggatgattccatctttgcatgttgtgggatgaatgttgccaaaaaaaattttcttgttctttctattcttccaggtgtgggaggagggactgcttggctcaatgcattggctcgattgagctaacgcatcgagccggcttttttttattcgtcgaacctaaaaggtcccggttctagaaggtcccggttctaatgaaccggcacctttttgatttcaaatcagtgccgcctcccttgtgccggttgggaaaaccggcaccggagggggtttcccaaccggcactaattaccttttctgtagtagtgatactagctttggaaacaaaagtacataaatactaatgttataattcaacattcaacaaatcatacgctttcaaaaatccacattgccacaatttgttatagcaatcaagctaagaaaagcagcagacgaaaaactgtgcaaagggaaaacacaacaataagaaaaaaaaaagagaatatgagataatctaacttgtgaggtagcaaggtctcgtgcctcaagctcgcagcgaaaaggagaggggagggtcggaacaactgaatctagatccaccacctagggatcgaactaccgtaagaacagggcaaggccgtcgtcacaatctccgtgctgacttcccgggccttcgtgatctcacgacacagtcatcgaccatggagccaccagatctgccaccactccctctccttagatccccaaccagcggatccaagtctccgccatcactcctacttaataagctaccattgtcgtcaccgccattcctaccaatcaagcactatcactacattctctgcccctaacttctcgtcccccacgtagtggaggaagcgctgcaaggaccggatctagaggaaccctgagcagccccgagatttgggttttagatctggtccttgcatcgcccctcgctgcgtcgaggaggagggaggagcaagagagaggaggcatgcagcgatgtttgggacagcaaaaggagatccccatggtagggttggggatgcaagtgggagagacatatcggtaggcaaacagttctcctcccccgcgtagtggaggaagcgctacaaggactagatctggtggtaacccttagcagccctgaggtttgtgtaacatcttgaaaattcctgacaataaaaatcactaaaattttgaactttttaaaactttttgcatcatgctagatgttatggttgttattgcttgccaaaccataaattgacacaatggaaaaatcaatctaaagatttacacccgagcaataattacgatttacaacgatacggtatttattatcaatcccataaatatttatgcacatgaaagccaagccaaataaagtacaagttaattattaaaccgtgtagtataaatcacaaatcaaatattaaataatcaaaccatgttgatagcctgatttcatatttaacaaaaggaaacaacatggttgaatatgattcacttgaatccaatctcacatgagatataagaacacatgaaatgatgatcaccactataatgagatataagccaatgccccgttcagggaatccaaaacctctgtatcagcaatttcatagacaaggaactacaccacatggatggaaaggaaaacagaaaaggaagatgtcaccactaataacctatgctgaactggatctcagtaaaatgggaatagaaatcggtgatttgcctgaagaagttgacgagctacaactatggcaacgaaagagagatggctgttgtttttcttgtggacaagtcggacattatgcaataggctgtatttaagacactagtgaagaacaagaaacactgccttcacagatcagcccagaagaggacagagttccagaaccatccaaagaactatcgaaggttaaggcatgtactctttgcggagagataggacactatggtagtaattgcgttactcaatgcccctattgcgaccaagaccatccagttgaagaatgcccaactacgaagatcacctgcttcctctgcgaaaggatggatcatgtgcccaaagactgtcagctgagcccgttgcttaccaagacggcagaagtacaaagagtgacgcttcgcttcgctcatcaactcatgaagtcgggaagccacgaagaccctggatttcctacattcgattagcatgtttgtctatcgatcaatatttaatgttgaactagtttaatgtcatcgtagttccaccgaatctcgaggacaaaatttctttaagggggtaggtttgtaacatcctaaaaattcctgacgataataatcactaaaattttgaactttttaaaactttttgcatcatgctggatgttatggttgttattgcttgccaaaccataaatcgacacaatggaaaaatcaatctaaagatttacacccgagcaataattacgatttacaacgatacggtatttattatcaatcccataaatatttatgcacatgaaagccaagccaaataaagtacaagttaattattaaaccgtgtagtataaatcacaaatcaaatattaaataatcaaaccatgttgatagcctgatttcatatttaacaaaaggaaacaacatggttgaatataattcacttgaatccaatctcacatgagatataagaacacatgaaatgatgatcaccactataatgatcgtgtttataaataagtaattcaccggaatatatatagattgatacttacaacatttcgccgagttcctcatgacatgaaaatcactcatataaaataatggtcacataaataaattaatctttatatataaacaagaatatgtgagtgtttaaaactagattaatgttgtaccgagtcttaatatactatttatagaataaatagattcaacctatccgtgtaaaatatattgctatgcaaataagttcactcaatgtgctattgtaataataagggccacattaggatattctaattaattttagaaccctcaaagcctccaaaattatttaggttaattttagaattagacctcatttaaataatacaatagaaaaatatatatgagaataaaatatgggtaatattaaaatttggtaaactttcatctaaattaaaacatataatgggtaaactccatttgtgtgaaaattagggtttatggaacaagaattgaaaaggaaatcaatcaaatagacaacataggaaaagtcactgttcattatggcctaggtgtttgatgtggtcccctagcccttcccccctcctctgccgcgctccccctcgcgccccgcgcccctgcacacgccgcgccgctgccgccctctgctgcgcgccgcctcgcgccctgcgccgccatcaccatcgccgtcgcctcgctccgccgcgcgctgtcgcgccgcctcgcgccccgcacgccgtcgccgtcgccgtcgcgtcgccatcatcaccacgccgcacgccgtcgccatcgccgtcgcatcgtcatcaccgccgcgccgcttgcctgtcaccgtcggctgcgccgcgccgagccccacgccactctcgtcgccgccgtcgcgtcgcccgtcgcgtcgccatcaccatgcgccgcgagccgtcgccgtcggcctcgcgccccgagccgccgcgcgcccatcgctgccgccgcaggccgcgcgcctgtcgtcgtcccgcccgtcgcgtcgccgctccgagccccgcgccgtcgcgtcgccgcttgtcaccgtcgcctcgctcaccgcgcgccgcgccgtcccatcgccctcaggccgaccgccctccccgcgccctataaacccccccccctgtcgccattaccctcatcaccttctctccctttcccctctctttcccatctccggcgtcgccgcctatttggaagccgccgccgccgccgcggagccgacgcgccccgccgccgcgctgcgcctcgtcgccgcgccgtgctccggcgtcgaccccgccgccgtcgtcgccggaccggtaagcccttccgccttccttcgttgccggtagccgcgccgcgccgctcggctgtgagagagagaagaaagaacgagagaagagattagtgcacagtaattacttagttcaccccggataaatgagcctatgacgcgtgggtccggatgattagaaatctaattaaaatcaacattaagtttacactctatgacgtatggggcccactggtaattaaacaagcaggtttgaccctaagtcaaccagggccggtcccacatgtcaaccacagtgggttttggataatgtttccgattaaaaataaatcatttatgaacagtacatttttacaatttctcggattaactcaaatttgaatctttaaactagcataactctctcattttaactcggatttgagtgaaacttgaacctaaatttatctaaatttataagctttccaatggtatataattcactatttgataaaatatatttataattattaaataattaatactaagataatgcataatagtcaacttaaaaatgtgctaacaaataaaattagtactttacagtaaggtagatgtaagaatatttgtctctaacatgctttgtcaatgtaacagccacacaaactaattttaaaatatgtctcaaattaatgtataggaagatactagtactattaaatggttgtataattaaacccatgacttatagattatttaaataataaagttagccttataattaggcaaataaaatatggatacacatagatcgttcctaggctttcttgtgagataataacatagccatcctaatcacatatatcgaatagcttacggtaaatagcaactattcagtaaatgatccaatgttaaaatattgttgcacacacgtatattgtacatcccaatttagatgtacagtatatcaataacctacccttttgaatataataaactaaggagtctatgacaaacatctatagtggataaatactaaatataaatcatgacctaatataatctaagttcaattgtaagttaggattattcgttgtaaaattatgtggtgggataatctgtaaccataatacgattagcctaaacaactctaacatacaaagcatggataattattaaccttttataacttattgtgacaagtaaaatatgttcataattaaagtaaagcctccatcaattaaataataataaaaatgattcaatatttgattgatcctaaatccatctaacaacagaacctctagtatataaccgtcctatttacatagatgtatacatagtcataatccttccatagccatttcatatatatatatatatatatatatatatatatatatatatatatatatatatatatataccataaatgctatgttggttaactcctaaatagatcacgatgacaatagaatgattaagaagctttagcccttagcatgattggaatccattagcaaacacgaatagtacattttattgtgcatatttgattgttgtttgaatattggtttttctcgcgtattatagaccttgtgtatcggttagtcgtgaggcaacgtctgcaatttctaggaggagaaggttgatcaagattatatcaagaataaggactatcctgagcaggcaagtcatcactattctttgatcacgttgatcccaattgcgaaattaatttttgtttacaaataagattgtatgtaatgatgaacatcctacttgtgattatgccatgccttgattattgtttacccttaaatctttgaaaccatgattacgtatgagtccctagtcaactatgacacttgcttagaaatgctactttagaatcttgcatactcatgtttatcaaatattatatgcttgggcaattacctttgggaaggtaattgagatgcggcatgtggagacatgagcaccacattgccttgataatgatgacatgaaaggaattaaaaacctttgttttagaccggggtggacggtggatttgggtggtatccgggaaaggctagtaccgtccccggtcaattaaggaccgagccatgaagttaagcatgaaacgaccccgtacaaccacatttctcgaatggggatagacctagcggagtaaatagccgagcggaggcagtatccatgcatagtggtttctcatgtgtaaggcagtggctctacaatggtgtcgccattgctaggactgccgtgtgttgagttgaacctagttataacttaattacatgggtgtaaaacttcccttcccgggtgcgccagaactcctctcactactagaaactgtgtacgcctagagtgcatgaggatgaaaagttcatagagcgggtattgccaatgcgaggttatcgaaaagctttgtcgtgacgcgtctcatatgttgagacaaggctcatgtgttgggcagtcgcggggtgtgggtaaagtgtacatccactacagtgtaagtaaaccaaatctattcgaatagccgtgctcgcggttattgagcaccgggacatgtattacacttggctagactctaaattcttaacttgtgtgggatgggatattgcatgatgaattttatgctgatggagccacttcttgagaggagggaaggtggacgtcctcagaaaaccatgacgactcaatagcgggaagctatccttgggattacaatggatgatggacagaaccgtcgttgtttaatgtgaacactggtattaaaacttgatcagtctatgctaggtcttaggcttgtgaaaagaattgcaaaactagctttatgcaaaagaacctgaagccgttccttgaaataccttctatcatacgcattgttgttgtggtggcttgctgagtacggttggtactcacccttgctatttatatatcttttaggagagtgtcgaagagaagcccttgtcggtacgcttgcgtatccaacaagatgatcggagtgcagtcttgttctaggtctcgttccccagtcgactgcctgtagcatgttaaccgggccctattattattttgtcttccgctgttgttctctgatagttgttggcctacctggccttaatgtaagtatttaactcttatagcctgaattcattcgtgatatgttgtgatccaactatgtatgtgtgtaccaactactgatccagggattggtacggataaacatagaagatttccgatttccaaaatcaggggtctacagtttgggtatcagatctggtccctgcaccgtctcctacactgcgtcgaggagggaggagcaatagagagggggcatgcagcgatgtttgaaagagcagaataagatgcacgcggtagaattggggaggtgagggggggaggcatatcggtgggcaaacggtcacatcaatggctgtggagagcgaaaggattgttatgtcaacgtgtgagaggaaatgtagagatagcttatgcgcaagagccaagcttagacttatgtatgcacgcgttgtgacctgcgttgactgtttttaccatcggttaattaagaaaacaagcaccactgtctattttttatcatgaacaaataggagtatttttatatcacaatgaattcattaataaaccggcctgaatagtatcattaataaaactgagaatgatataatttccagaaacaactttaaataatccggcaatgacaatgaggctccggttgatggttctgtgcgatagggtcgttacgcaagattgaagtctcaacatttttaaccatattatttacatgagtttttccttgtgctattttttagcttcgtatagtatggaaacttgtaattagtaggagagagatatatttttgtaatggcaagttctaatagaaaggatggattaagtggagaacataaataacagtttgtctggtggaggaaattaaaatgcacatatgtgttctgtaatttagaaagacataacccttgtgctcccaaagtatggaaagcttaaagaattatttttttttgtcccgatatgtctatgcttagcttgttgtcctcgacgaggacataagctaataacacttcaggtaaagtttggcgtagctctggatacgagatttcttaaatttggtcgtacctgcaaatctatggagctgtgattacgtgaataatatttagattaatcatttgttcctattttagatgaaataagaaattttaaaacagtataatttgatatagaaacttcaaattcagaagggatatggggtctggagttatgctagacatgaccttcattatgaaataaaaattgtaagtaatataaagtaccattttacacagtccgtaaacttaatttacttctgctgaattatggaaaacatcagctcctcgacctccatgaacttttctaggaaaaaaaattattcataagctagaacatctctaggctaatagccattctcactggattgtcatttcgaatacttcgcagcaaattcagcaatattcttgtcagaccttcctccttcatgcattgcctctttagctttcttcatcaaccttgcagcactcctcctatagtcctccttcctatccccatccatcacctcccgaatgcacctctcaacctcttccctttgtatgccgccactcttttcctgccacactctgacacccatgccccacaagctctccatatactttgatatggttggttggtcagccaaatgtggcattgccactagcggtacaccattaacaattgcctccaacgtcgagttccatccacggtgcgataaaaaacaaccaatacataacatattttattctaattgaaaacgacttcaattgagctattgttgtctagtactcattcactagtctactacacactccctccaggctaaaaaaaataactttgaccaatattttctattaacatatatatataaacaccaataaatatatgattttattgaattgaagtactttttagattaattatacatatggtttgcatatttctaactcaaacattatacatgttatttatagtcaaatttttaaagtttcacatatttcttataaaaatgacaattattttcaacctggaagaaaattattttgttgtcaaaataaataatttaagtttttgttggttccatacctgtggccttgtgagaaagcacctccagctgggggcaaaagggaacaattagtcctctcttcccacacttttctcgaagttctcgagataacttgtgctcctcgttggacctcacaacccaaaggaatggcttgcctgaattgcaaaggccattgccgacctcctcgagcttggctgcgtcgtagccggagaaagtcccatacgacacaaacacgacagagcgaggaggctgcttgtccagccattccatgcacggcacggtgctcgtgaagaggttgaacccgtacgccgtgttcgacggcaaccggccgtcgccgaggtagaacgacggcaacaacgggccgaccgtcttcgcacgccatgtcgcctccatgtatgctgcctcctgctcatttcacagccaaaatgtgtaacaattttgggaccaaatgatcttgtttgttgcaatgtaagctggatacactagattacctttggctcgaggtcggtgaaggagttgacgagcacgtcgtcggcgtcctccagcccggcgaactgcgccaccgactgctcacagaacgctggtgtcagctctggcgtcgcgacgaacggcggcaggtcgtcgtgccccagctcgacgcctagcgcgccccgcgcgtacaagccgctcacgtccgccggcgtcaccggcagcgcaaggcgcccggcgcacacctccccgtagatgaggtcgacggcgcagggctgcggcatgaacgcggcggcgcccacgccggcgtcgcgcgccacgcggagcgcccacggcaggtgcgggtcgaacaccagcacgcgcgccggccgccccgcgcgggcctcggagacgagcagctccgccagcgtccgtgcaccgtgagcctcgaggctgcggtggtactccccgtagtccgggagcgcggccatgccgccggcgtcgtcgtcgaagccgtcggagaaggcggcgacgcggaaggggtcgccgggaggcgggctcctggagagcacgtagcgggtggcgacgagggtggggcggaggccgtggtaggcgaggcggcggccgaactggagcatcgggttcatgtggccctgcgccggcaacggcacgagcaggacgtgggcggtggcgccaccgtgttgatcattcatgctcgccatgggttcgaatcacttggtgatttgacttggaggtagcaagctcgctcgcggcgacgatgagctttatactaggtgtttgaagggttgagaggcagagtggcgcgcaagttaattttggttgtgctggcgcgcttgacgacgacaagtttgtaggcgaaatggagactcgctttgtccagggactatgactatcacagcctcacagaatggataggtgttcgcgtggtcgaagagaagttgctcaccgagattcctgcccttgaagtccttctgtcaaacaaaacaattgctcttagaggtgtgcttgggccgactagtagacaatctctatctctatctctattataaaaatagaagatgtttttgtcggtattttggtatgttatccatataagagtcagtttttaagttcgtttgcttttgaaaatacatatctgtatttgagtcagtttctaatatcattcacttttggtaatacagaatgaatcatataagaaatctgtttaaaaaaaatcgcatgctaacttgagacgatcggactcttaactgcagttcatgattttctatatatatatatatatatatatatatatatatatatatatataagcgaactctcacagtgaatttcatcttaactaaaccatataacaataataagattaaaatatacttcactcgttgcaacgcacgggtattttttgttgctctaactaaaaagccagaaagcatgtttggggttttgtgcagctgcaccccttctccgaaactccatctatctactatatgattaaaacagcctagaaagaaggtaacacatttgttttggaaaacaactaggggttatccatcattggcatgacattagcatttcatcaagaaacgacctgcacacagcactgaccggccctttattatcagtcataactggcattaatggcaagtcatactcactttgaaaacaaatgtaaataaataccaatacgataaattcaccatttaacaaatcatacgcattcaaaaatcaacagtgcctccatatgttgagaacaatcaagctaagaaaaggaacagacaaattaaaagttgtgcacagggacaataacaataagcaaaaaagagaacataagacaatctaacttgtgcaacagtgaggtctggtgcctcaagcttgcggtggagatgagggttggaacggctgaatctagatccaccaccgaaggatccaacctctataagctcacaacgaggcggtcggcgcaatctctgccctgagttcccgagtcttcgtgagctcctaacatagtcatcgactacaaagctaccagatctgccatcgctctccctccttagctagatccgctaccagcaaatccaaggcttggccatcactcctagtctctgagtcaccgttgtcgtcgtcttcccattcccaagccaccaccattgttcctgcaaatcaagcactccaactccatcgatctcctcccctaaatctctcccgtgcaacgaaggaagcgctacaaggaccaaatctggttgcaaccctgccagatccggtccttgcactgcctcctcccctgcgtcgaggaggatggaggagcaacagagaggaatcatgcggcgatgtttgggagagccgaaaggaggtacgtagtagtagtgggaaggggagtgggggagggggcatatcggtgagcaaacgggcacatcaatgaatgcggagagagagagaggagaggtgcgtctgcgtgtgaaaggagaaggagcgatagcttctaggcaagagccaagcttggacttatgtatacacgcgttctgacttgactggctggactgctttaattttgccatatggtttcaaaaccaacaagtaccactaccggtttttaccgttaatagatagtaatatttactatcagttcattaataaaccgcctggaatagtatcgttatattaaactgagaatgatattaatttcagtaacagttttaaataaaccggtagtgctctggttgatggttttgtgcgatagggaagttatagaagattgaagtctcatcctttttaaccatattatttacttgagtttttcattgcgctttatttttttgctttatatactatagaaacttgtaattaataagagagatatattgttgtaatgccgaattttagtagaaagaattaagaggagaggataaataacagtttttccggtatcagaggaaattgatgcatgcacatatatatgttctgtaatttggtaagcaagctatgtccggtactctcaaagtatataaagcttacataattcatttgttgtcctgatatctctaaggtagcttgttgccctcgacgaggacataagctaacgacacttcagttatgaaataaaaattgtaagtagtataaattaccattttacacacactgtaaacttaatttacttctgctcttaatttacttctgctgactcgtggaaaacatcagcagttcagcaccttgacctccatgaacttctctgggaagaaaaaacaattgtattcagaactagaatatctctgatatatagctgggtgcttgagatttcagcaataatttttgtcaatttgaatacttcgcagcaaattcagcaatattcttgtcagagctccctccttcctgcattgactccttagctttcttcatcaaccttgcagcattcctcctgtagtcctccttcctgtcaccatccatcacctcccggatgcatctctctacctcttccctttgtaagctgccgctcttgtccagctgcactcgcacgcccgtgccccacaagctctccacatactttgaaatggttggttggtcagcccaatgtggcattgccacaagcggtatgccattaacaattgcctccaatgtcgagtttcatccacagtgcgataagaaacaacctatagatgccatatttggtgccaattaaaaaaaacttgcatttagttattgttgtctactacttattcactagtcttctatatactttttgttatcaagattaatataatttgagttcttggttagttccaatacctgtggccttgtgagcaagcacctccagctgggggcaaaaaggaacaattagtcctctcttctcacacttttttcggagttggacagataacttgtgctcctcattggacctgacaacccaaaggaatggcttgccggagttgcaaaggccattgccgagctcctccagcttggctacgtcgaaggtggagattgtcccatacgacacaaggacgacagagcgaggaggttgcttgtccagccattccatgcatggcacggtgctcctgaagagattgaacccgtatgccgtgttcgaccgcagccggccgtcgtcgaggtagaacgacggcaacaacgggccgaccgtcttcccacgccatgtcgactccatgtatgctgcctcctgctcatatttcgcaagcaaaatgtgtaacaatttgcaatgcaatgatcctctttggtaatacctccgtttcatattattataagttgtttaactttattctagtcagatttatttaagtttgcttaagcttataaaaaaataatagtactttcaacacaaaacaaacatattgtcaaaatatatttattattagatttaatgaaactaatttgatatcttatagctaatttttgtataaactatgttaaatttaaaaaagtttgagtcaaacgactcgtaatatgaaacggagaggtatgttgcaatgtaagctggacggaagcacacttaattacctttggctcgaggtcagtgaaggagttgacgagaatgtcgtcatcgtcctccagtccggcgaactgctcgaccgattgctcacagaaggctggggtcaactctggcgccgcgacgaacggcggcacatcgtcgggccccagctcgacgccgagcacaccccgcgcgtacagaccgctcgcgtccgtcggcgtcaccggcagcgccagccgccgcgcgcacacctccccgtagatgaggtcgacggcgcacggctgcgacaggaacgcaacggtggccacgccggcggcgcgcgccacgcggcgcgcccacggcaggtgcgggtcgtacaccagcacgcgcgccggccgccccgcgcgcgcctcggagaggaggagctccgccagcgtcggcgacccgtgagcctccagggtgcggaggtactccccggggtccgggagcgcggccatgccgctggcgtcgtcgaagccgtcggagatggcggccacgcggaaggggtcccccggtggcggcgtggtggagagcacgtactgcgtggtgacgagggtggggcggaggccgtggtacgcgaggcggcgcccgaactggagcatcgggttggtgtggccctgcgccgccgggaacggcaacaggagcacttgcccgccgttgttgttgtcctcgatgttcgaggtggtggcgctcgccgccggtgtgctcatgctccccatgatcttgtttggtttgtggtactggtatgcggcggcccgcggctgctgtgtgtgttttgagtcagaaggattattaataggagtgcagtggagtgacggccaagattgcttcctgcacggtccaatttgcggtgtacactctttcaggggtgtcgggagccttgattagcaagtaaagggtaatgttgcacgtgttgtatcacaaggtttgttttcttttttacagaaaccgcagatcgatgtagtcagacataccactatgcatatgcacaccagtgtacacgctcgttttttttgaacgtctcgtactgacagtgccaagttcgtattgataaagtagaaaaaaattacaagattacaaccttgagaggtcataaccagttaaaaaaatatatcaccacccacacaccgacaactctaatacacaaacccgggggaggcgctagtaccgaccggccgccgctaagcgtgaccgaccgccactagaccaacaaaggaactacagccgagatcgtccaaaacctaacccttagaagcgacatgaaatcccgctctatccacatctttgggattgagggagagagggtgagagagaagaataaaaccgctctccccctaggccctccgatttagccaacttgcataagctagatcgccgacataagaggacgttaatctagagcaagcttgcgccacttgtttgggaggttttggcaaaaggttgcctagacaacatttccaaggagagaagcgacggaagcactgccatcgccgcccgtcaaggtctcaaagagaaccgagactaggctttcacccggccgacccgctagagggatgagacggcacgacaacgccctcagaagggggagtgacgctcgaaacgccaccgttgccggcccgaccaaggcctggctgggttttcactggccgtccgccgcctgcctatccaccgctgacacatcattactccaccaccatctaaacctcttccagtgcgtgggcaccactgcattggcgccccccccccacacacacacacctctcgccgtgtcgccaccggtcgtgcctcaacgtgatgcaccagcatgcacctcgccggcctatgccgaccacaccttccactgcgccggccgcatctccccgcgtcgcgctggcctccgctgccggcagctattggtatttcttacgaccacagataaatccacaagtgcacggaataccgccgtagcacttcacctccgagtgacctcaaaaggatatcgaactcagggaacatgtgtaatctcctgaagactaagtccatccaaggacaacaacaattggtagactagctaggctagagagggctttcaatgtgttttagttatctaagctaaattaaaggtaattttctatctgctgctttgggcactgaccctactggtctgccagcgtggttctggctatagctctataatgtacccgaatgtgaaggattattaggacggaattcagagctgtcaccacctgtcgtctacctctaacaaatctatgggatacacaacaaacaaatgtaatatgtaacctagacaccacacctaagttattaattactactctaatcctagtactagagcacttagtacgaatactaaacaatgaacccgcaagatggaaatctatcttacttagactaagtaattaaataacataagaaaaaatcttgaatgcttactttatagaagatgtttctccgaactcggagcagagtgtaccgacagctccaatactcctccagaattcctcctagaaacctacactcgtcaaggtagaagtcagagagattgccaaactttcaagcactcctccagagcttccactcactatctaactattttctaatgtgtaaaagatataatagaacctcttgtaattcagctcaaagttgtgtgccttggaagtgagatgagctcatccttttataggctccatatgacagttaaagccatgggaaatgtccaaaataccctccaaccgtcattgaggagtaattagggacgtacatgtggaaaatggcgatcaacggcgccaggatgggttcggccgaactggtggttcgtccgaacccaaaagcccacctcctagcctctccttcagctgggaggttgcttaatgggcccccaacatcatgtattataatttggcttaattctaagtagctttgattggccctccaatccgtgtaatcgcgttgtgattgtccggaggtgtattttgtcgcttgacgggtggttttcatccataaaatacctgcttacacctatttcaccaacactgtggaaattattagtaataatccctacactaagttggataccatattttatttcattatatacaggc

SEQ ID NO: 43661 - DNA, 25297 bp, Oryza sativa
  unsure (1)..(25297): unsure at all n locations
cctccgctgccggcagctagccacgcctcgctggcctccgtaccgactgcgcctcactggcctcctccgctgtcactgcacctccacacgcacaccgtgccgcgcctccgcacgcgcactgtgctgccctccatcaccgtcgacgccgcgccatcgctagcgaatccagctgccggcctcatgccagtgccactggtgcgctgtctcagaccagatccggcgcgatcggtgctagatccgagcgccccgctgtcggatccaaagtctccgctaccaccgccgtcgctccaccaccaccctcgccgatgtcgccattcccgccgccatcaaggctcccgtcgctgtcgagacctcgctgtccaattgccgagactctgccattgccatcaccatctccgccgctgttgctgacgccgtccccaccgccggcagacaccccgccagatctggccagagcggcacagatatggcggcggccgccgccgccaccctgggtgactcccctggctgcctgagcaggctggcgagaagccccaccactgccttccttgcggccatgtggctttgccggcgaccgctcgggtggcggcgaggcagaggaggaagaaggggggagaggtggcggcagggtcttcgcctcccgagccgcccctggggtagggtgacgcgagagagagtgtacacactcataagtattcttgttaaacacatggttaatgtcagttataatttggtactctcttttttattttggctcatgagccagcagcttataagacaaaaatactaaaacccaaacaaacaaacaacattttggttgattatatttaaagctataaagcactcctacactattaaaatcaacagtcatatttgtgtagcttttcatatgtcaattatagatgtgccctatttttttggctcatgagctaaacgaaaaagtttaagccccaccaaatggtcagcttgttcgttgcacttgttttagccatattaagccaaaataaaatcttggttcaagcagttcttttaatttgtgaattagacataggacttcaccttaaactcgagaattactagtaatgtgtccgtgctaacgctacgtatcacggcacatggttcgatatcaagtatctaatatgataaatttaatatttaggaaaaaagaactacggagagagttattatattgttgctaattgttaaccgtgcaatttggtaagcccggagtatacatcggcttagagtcagcatcggcttcgaaatcctgagattagccgatgagagttgtcaagtcgtcagttgtcggattcttgctatgttcggttaaggaaattgatctactaaaggaagcttatctagaagagaccgagttcaaagagaatgcggcatggcaagttatatattaattaggaatagtttgttagtttccttttatctctaggaaagtgtgtttagtgtcctataaggactttatcttttctttttatctttaggaaagtttctttcttatccgacaaggacttatatcaacccatgggtataaatatgtacacccggggtctatgtaatctatcttcatgatcaatacaattcggcgcatcgccaccttttaccttttctactttattttatcgtctggcgggacttggcacctgacgcggggctgcatcggtgttcgatctccgactaaggggtaagtccaatgttccgccggcccatgcaattgtatcgtttacgtcggcgtcgttcaaggctgcatcagtacattcgacctcttggattgctctggtttggatgatatatttgcctacctatttatcatatgtctctgttaatctagtcttagcatatcaatttagctctatcagctgcttctcgttttagggtttctgcaggtatcgactaaatcgcgttgctagattagattagcttagacatctaccaccctgaaaactcagtcaacggcttgattgtctagatattatgtttcttttcatacttagtgttgtatcagttaagtttgatctactaagtcgtgcttagaaccataatctctagcctgcttcttgattgccaataagggtttcatcggggttttagccggtgagttatctggacgttgcatcggctcataaggaatgcatatacatataagttggatttagccgataacaacaaaggtttcactgtttaatctaatcttgtggatttcatgacatcggaccttcagccgatatatgctttaaccttcggatcgatgcttatttatgatatcattatttgccgattggtttatactgaattatattgttattttattacatcatcatcagccgattgcctttatatcattatctacattggacatatagccgattgcttaaaccctatcgctatcggctggtatcgggcatcggctattatcggctatcggttggaactactccatcggcttgtcagccaatcgactgttttaatctactatttgcatatcttgtcagttgcaggatcaaactgactggcacgcccgcatctcatcaagatttggacctgcacaggagctaagcagatcttctaggctggtatgttcgattctttcgtcaacactaattatatagcctccaaaatataaaatcacaacttttgtatcttaggaatacaaacaaaacatattgcctacaaataatacaaaccaaacttcatattacaaggagaagcgttttgattattttataaattatattaatcaccgagacaaatttcacctaaatggaaggatataattagacagaaatgaccttgttgtctagctcaagtataatcataagtaacaagaaccctatctgaaccagtcctcgtgccttcgcaaagcatgttagatagtgcaaaagcattttttgtcattctgcataataaattgaaatttgtcatttatgaattagtttatagaacatgctgtaaatttgaaccgtaaatgtatagagtataaggatataccaactatcatgaattctttcaagtgcatgcaatcctataataaaccagatattaagagagttagtatttcatcaagtatttgctactatgattatcttttaaaaaataaattgttataaaatggcagcaaaccaccagcagtactacttcatgctttgtaaaattagaatatacttgaatcaattcagatgcttcaatggctgatgaatttttcatgcataattctacttactttcggttatgaagaatatagatagcacttaccatcaccaattggcttgccatcccatttgacaatgggcagaaaaggatctgactgttgcatcctagcacacttccttgctcgttggtcatattaaacacaccggcatccaccatcctgggtaccagtgctgcagccacttacagtagcggatccagaaaattggttcgttggtgtcataacgtgtctatcggtgtcatagtatgctaattatgcttagaacatgatgttatagtatatagataaacagttttgctataggttttgccgaaagtcgtcggtgtcgcctgacaccgatgattatactatagatccgcccttggccacttagccatttacctagtcacccacagcgttgaacgccagcaccaccagatcaccatcgcccgtgtcgaacaccacgttcatcatcggtccctcgtccatatccccggcctcgatgagccacaccaacgcgcacacaccgtggacctgtaccaaatgtgaatctacctgaccaaatcaagaacccactttgagtctaaattcagtaccaacaagctcctgcagttgtatttttttagataatggaaatggattacatctccggcttctgtcataagacacacagccataagtttaaaagtaataaaaaaggtaagataaaaataaatcaaaacgagaaataaggtgatgggacaaatctccaactcccctttattattgactagcgttaaaccacgtaaaaatttttagctagcaattcttatggaactatgccacccatagtggaataagagacccttggctaccgattccaagagtgtagcaccattgcgcatagtatcctgctcctcatgtggtagcattgtagaccaaaagtggagccagtaggaagacatgaagataacctgcatagggttagataattgtttaccattaaaaactttatcattgcgacaacgccaaattgaccaacatacagcactagctccaattagaatcatcttcttaatggacctagatacccctctaagccaattaccgaaaatgtttttggcgttacggggtggggggatattaaaagcaaaaaacacacatctccaaacaaactgagcgacatgacactcaaagaaaagatgttggattgtctcttgtgtatagcagaaagaacaatgtttgtctcccccccccattttcttttagccaggttatctttcgttagaattactttcttgtgaagaaactacataaagaccttgatctttagtggaactttcaagtcccatagaattctctttttgatccgaacattacagttcatgatcgcggcatacatagatttgacggaaaattgaccattcttatggagcgaccatataaagcagtctttttcatttgacagagttatattagctagcttgaggatcaaatcgttccactcgattagcttttggccaacaatagctcttctaaaagagatatttagcggtgttgtgctcatgacctctaccacagtagactgtttctttcgagccacattatataatgtagggtactgatctttgaaagcgcgcgatcccaaccacgtgtcttctcaaaatcttatgtttgtcccattaccacatctaaaagaacccaacctaagaaattggtctttgactttcattaaaccggcccagaactaagaaatacctatcttgctggacataccagaaagaggtttaccctttaagtatttatttcgcaaaaggtcttgccataggccttcaccattaaacaactagaaaagccatttgcttaataagcagctattttttatatcaaggttatggacacctagtccaccttgatcttttggtcgacatatgttttcccacttagtctgtattttcttttccggtcatcattactccaaaaaaaacgtgacctaaagtaatccagtctttgaagtacacctcgtggaatttcaaagaaagataacataaacaagggaaggctcgaaagaactgtgtttagaagggccaatctcccaccatatgacatgtttttgcctttccatgtgctgagtttcctctcaaatctatcttcaactcatttccaatcaacattccggagttttcgataatgtataggaataccaagatatctaaacaggaaagatccaaaattacaaccaaatagttgtctatattgatcctccacttccttggctttcccaaagcaaaaaatctcacttttatgaaagtttattttcagccctgagagttgttcgaacacgcataggatggctttcatatttttggcctgttcaagatcatgatctagaaaaaatattgtatcatcagcatattgtagaatggacaaaccatcgtccactaaatgtgaaatgactcctctaatttgaccatcgcatttagctctctcaatgagaaccgctaacatatcaaccacaatattgaaaagtatagggacattggatccccttgtcgcaggcctttgtgcgtttgaaaattattacccaagtcatcattgacttttatatggacacttcatccttcaaccattttagaaatccaatgacaccactgctgagaaaatcccttcatgcgtagtgtttgttggaggaattgccatttgactttatcataagccttttcaaaatcaattttgaaaataaccccatccatatttttcttgtgcaactcatgaatagtctcatgtaaaatcaccaccccttccattatatttctaccgggtaaaaaagccatttgggttgggcgaatgactttgtgagccaccgatgtaatcctattggtgccaacttttgtgaaaattttgaagctgacatttaaaaggcaaattggcctatactgttggatttgttttgcatcggctcttttgggtaataaaacaataattccaaagtttaagctaaaaagaggaagagtcccattatgaaattccttgaacagagccataagatcatccttgatgacctcccaaaaaacttgatagaactctgtaggaaaaccatctggacccggggccgaattatgttccatttcaaaaactgcttgtttgatttccttttctgaaaattcagcagtaagaatgtcattttcaaggtttgatacccgtgggatattctgaatctgttcctccatcaaagaaacatgattcacttccgttgacccaaataaacctttataataattggtgatgtactctttgagatttttatcaccggttattatagccccatcctgctccaattgaaagatcatttgtttacgatgcttaccgttggctaaaagatgatagtattttgtattactatctccctcgagcaggtgtttggctttggatcgttgtaccaatatagctcttcctgtcgtagcagctttgcctagtcatttttggcttgcttcaaagaagctaattccgctgttgagagaactgaaaattcagcttttttgtctagcacatcaatgaaagccaaaagctttaatttttctttcttgtatgcgccacttgtacttcgtgcccaaccacttaaatgttgtctcaagtgggcaatcctatgactccaacgctccatgggggtgttccccttatttatgttgtgccattctttagggaccatttcatagaaaccgtcccgttgaagccaacctagttcaaagcggaagagaggtttccaaaatgggcatgtgaaccagatctaagaataataggtgaatgatctgaaatggcgtgtggtagtgcttggcatgttaccaaagggaatttttgttcccattcagtgttcattaacactctatccaacttctcataagttggattttcaaggttatttgcccaggtgaactgcctccccgatagatcaatttctctcaaattgagactattgatcacttcattaaaaagaaaaggccaacggggatcaaatgaattattattcttttcttcttgcgacctgatgatattaaagtctcctcctaccaaaaggggttgagactcattactgcaagtatgcgctaattctgttaagaactgttcttttaaatcgggttgcgcagcaccatatactgccattagaacccatttaaaaccatcttctttatttctaagttgaaatttcacatagaaatctccctctgaaattgaaccgatatcaaaaacggctaaattaacccctaaaagaatgcccccgacctcccaacaggaggtttctcatgccataaaaaatcttttccaccacataggtttctaagatttgctgaagtgaatgacggttttctggtctcaaagatagcaataaaatccaagtgatgttccttaacacactcagagataaatctgaatttagctggatcaccgaaaccacaactattccaaaaaattcctttcattttttatgtttgttgcgtttcatttttggcttagccaaaggtggacataccactttatttttggcttttgtcaaaattttctttctttgaggtgcgttgcatgaatcaaaagactcgtcagcgctaccctcactttcttcttgccaatcactacataagtgctggatagaagataattttaaaagctcatccttgtcattatctacattactagaagaaccattgtaaacagaagaactagcatgtagagctacaaatctatcaacttcagaaatttttgtaccataaatagactcatctacttctatgtcatttctacccagggaaactcctagcttagaaatatttgcaagtagagttttgttaggcaaagatagaattgaacttgtagggttgaatttgttacctgctaccacttcgaggttatgaatcttttttagaaactctgctcggtttgccaccggtgcatccccgtttgccattgccttctgtcattcactttgacgtgttggtgtaggatgaatcagtcgacgagagcgacgtttagcttcttgagagggacgcttcccacctgcttctgcttgcacctttgcttcagcgatgatggtgcgtgctgcatcaagttgtgccccatcggcagccaactcaattaccgtgttaacacctgcagtcccgacatccaaaatcatcgagtcttgtgatgtggttacctctgtcacctcctgattcaccattggagcagcgtccattgtgccagttgacgaggacggcaagacctgagttgcatcgaccgacaaagttggagcatcggcagccaccaagcccaccttgtccgactcgatctcctgggctgcgtcgtccatgacaacaggagcagccaatgacacagttacagccccttctagtgttgatgctcccgtcgaagcctccgagagagatgcacaacctgccggtgccatctctcccgcatccgtcaatgtcgttgtaaattcttcctctgagatggcagccacactatccggtacagccaaagacaaagcagccacctcttcatttgccaaggtcacgttctgtccggtagttgggatctgcattgagctctcttctggagccttgttcatcaccgtttccaagctagaagccacgcaaattgttggcaaaacctcctcagcttgctgctctactgcagaatcatcaacaacagtgagcaaccctgcgatcgctgaaacacaatgtgaattaagctgagagtctgtaactgagcctcctcttaatgacattgaggatgacgcagcttcattttttagtcgctttggattccgatcttccataatgacatcatcatcgttcctcttttgttcactgtcatcacgctgatcatcttcgtctaacttttcctttcctttcgattcctcctcgggcatttctggttcaaagaaaatctcatacccatggttacggaacacaatgtacacactgggcggcaaagttgctaaatcatccaccgcaacctgcattcttacgaccccgtgtttccgaagataaaccatatccaccatcgttgtatttccaatgacagaaccgacagcatgaaggctaagaaagtccctaatttcatatggaacaccatagacacgaaaccatgtcttcttcaggacaaactttgcctcaatctcctgttcccatttgttaaataacaaatcaacaccaaaatcaaagctacggactctgccaaccctatgcaatctatctaattcaattgtagagggaaactgaacaacaaatgtatcctgtgccgtctcctttacttcaaatctgacgggaaccaaccggcgcagctcagtggtgagattatcaattgaaatgtgaccattctctacgcgaactgttgcagtcttactaaactcccttggtcttcctgataccttagctggtgtaggaatcatgaagaagccaccaccctctacaccccagccacacaattgcagtgggtttaggagcgagaagaagtgggcaattagagcatccctagcagctcatccatatttgatcctccaaatacctatatggatggtcatccaaaaaagattcatcattcatattcctttcaactctaacagatcatctatattacatcatccatatcccaccctcctatattttaataatatcttccaactaactttatatttatatttttaagggatatattttgaactactaaattttaactgcattttttatcgcaataatattttgaaatgagtaaattttaaccgatatagttttaatgaataattttttaattgatgatgtatttacatgaatggacttctaatccacattagcgctagcgactgaccttatcctctcgcttaaaaaaaagaaaaacagaaaagaacggaccttctctcgctaaaaaaaaataaagaccctaccttatcctctcgcgggtgcgtgcgtgcggcagacggaggggcgatgcgggacggcgcgggcggcgctgcagggcagggtggtgccgagctgaacaacggtgcgggctactgggcgacggcggaaggtggcgtccgcgcgcatggtgacgacggcggcggcggaggatgcaagcggcggccgcgagcatggcgacggcggcggcggcggaggaggcaagcagcggccgcgcgcatcgcgagggcgccagcggtcagccacgggcagggcgacggctacagacggcggtggcgcggctccagatctggtacacctctcgatctccactctcactccaccctccctctccaccgtccgctgactcaccttcaccggccggcgacgacggcgatggaggggaggtcgcgctggaggtgaggtcgcgtcgcggaaaagtctggatgggggcgggagaggcggctgttgcaaaatggcgtgaggagagaaacactccatttttgcttcttctctctcctaatttggcgcatccgccccttttggagggcctgttagcgtatctgctcgagctgatttttccccttctatacggcaaatgaaggacggatgaccggttagaggaactgctggggatgctcttaggtgccaaatgacctgggtcttcacatatgtcacaaataactgcattacaatcagtaacacggaaaaaaattctctgcggcagtgccgcacgccacaacccgtgcgacaccccgcagaatagcgacgcgtgtttaatctcctgctgcaggccgagccctctttggttggtgtcgagccgagtccatttcttccgctgcttattggagtcaagctgtccagggcacatgaatagtttttgtattaggtctgtaagttttcgggttcctatgtaagggtggtgtcttgcctctctttttatttctgcaatatagaccaaatgattttacatgctgtataaatatgatgtaaacgtgccaacctaatttcaacaccaggtgtgcttttaagttgtcaatcaacacatgtaatttttacttgtcaggttgggtatagcgctagaattggtttgtatgttgcaaactttcaggctttcatgttgttggtattcctatatggctatatagctccgcacctgtacaattaaaaattttcggagctactactctatgccaataaaagacaaactctagctacgaacctagacacaagctaggattggactttttttttttttgaacggagggagtactccttaaatgttccgtgatttgttatgtcatcaaaatgtaatttctgagcacccgagacatcttgataaagtttatgtaaaggatttatatattacactagaaaaatctccagcatattatcagcaacagttgcataaaaaagctctattgaaaaatgaaattattcaggcttcatgtgtagccagtagatgcggctcggtagcattttcaacgagctgacaggtgtgtgggtgtagtataccaggcatcggctcggctccaaagttgggctcaggccggctggggctgcagcgcgctgatggacaatggacacgcgtcgttattctacgcggtgttgcatagggtgtggcttgcggcactgccgcagagaatttctttcccagtaacaccatgtcccttttctttgcacctgaagcagcgaattttttacttagccgcggtctcatttgctgccttagtagccacaacttcattctccgttgcgtctggggcaggagcagctgcgaccgccgccacgccgtgggcagctccaccagtgccagcgccacttgaaggaacagcgctgctatctcctccaacggcagcacgacccctccccgctggatcacctcttccaacgtggccgtcagcatcagcccctgtggcgtgtaccagaacctgtggctgcgtgatacggatttcggcccctaccgcgaagaccgcgcctagggcctcttccacgcatgcggcgtccacctccatctcctctgcctaggttgaagtgctgaacaccagcggcagcttggttggttccatcgcctccgtcacgccggacgaatctcccaccgccgccagccatcaccccctctcgcacagcctcaacaaacgaacgacgaaaagtagggttttgcgacggtcagaccggcggcggcgacaggtgcggcgagcgactttggcggtcagaccggttgatctataccggttagactgacggcatccacacggtcagaccggcagattaatctcggtcagaccgacttccgtcgaattcgagggtaacttttatttccgctaaaagttttcggtttttgggtataacaactattcaccctccctctggttggcttagttattgtgattcgattctacagcatcgatctatatctctccatgagagcagatgggacttcacgcgagcagacgaacgctctccaatcgcccttcatccattcagatatatatccgcaacgatttgtgtaccgtcactactactagaaagattctcgcgtgcggtcaaaaccggttttcgcatgctggtgggcggcccgcacgcacccagagatctgcaaaaatcgcgattggagagaaaaaacagaaaattctagggcgcacccacacgagatatgtcgcctgcacggaaaaacaaaaatccaaaaaaaaataaaatttcaaaaaatgaaaacccttgaatccagcggtgccgccgccgccgcctcctcgtcgtcgtccgaggacgccgctcccgccctcgtcgtcgtcagcggcggactccgcgccgcccgccgctggatccgtgctcctctctggcgcactgccacgacgcccctcccctccaccggatctggggagggaaggaaggggagtggaggggagcctaatccctggggggggaggggggtgagggggcggccggcagccggatccgtgcgggggttgaccgccgcccgccggatcccgcacctccaccaccgccgccgccgccgctgtcgccatcgtctacacccaccaccgttgtcaggaggagaggagagggcgtagatgagtgaggccgctattgttgactgatgattgggaagaggaaaaaaggagaggagagaagaaaaagagatagacaggagaggagagaaagaagggaaaaattaaagtgggtcagagggaaaagagggagtggatatttttgcgtgtggccctcttaataggtccgcatgcgaaaattggctcattttagcttaaatgagcttattttttcagacgcgatcagttatgatccgtctgcaatctaaatgggtccctgtacaaggaaaatcatttttttagtagtgcgtgatcctacaggctttagagtcagaactaccttgcgacacgaagacttcatgataggctcatcgggagcacacgcaacctgaagacttctacagctcaggtgctgaactgctcaggtacaattctatttttttaatcaatcaggactctcgattttagcttctactgtattattttccaatcaagattagattataattctgttcttctctcatccgaattctgaaacgacatgaatcattactcgcccaagccatgtatcatatagatccatgagtttcaagttttagattaaattcacaaatcgaaaaatccccttgcattcaagaagatctattggtgatagtccaatgtacaatctataaaggtatcctatatacctatacaaatcatccccactactacaattctctgcttcctggtgcttccacatcatctctttccccctatccgttcgatctaatcgagcgatcaaccgttgctcggatcgacttagagcaagtataatagtgctgactaggttggcgataagaaactccacgtcagcatattcctacgtggaggagaaaaaaagaggaaagagagtgaagcgggcgattgcagaagcgccgagcgttagcatgccggcgcaggcattgccgccctcccgcagcaggtgcggatggtagttacgcagttattgttgatcccgtgtgcataaataattctgcctgctctcacaagtgcaacatgcaaaagattctgctctcatccggcatgcgacacacagatggtcacacaaatgaaagctagatttgatcatactcacatgcagtcaataaatgtatccaaacttctatccagacaatgtatagccaaaccattataccatccagctactgtgctgtcttcagatgacttggacataatctaccgccggcagcaagctatagtattatccttgctcttatccacccgcatggtcgcactcgcaccgcgtcggctccctctcctgcatcacgccatgccgcctcaccacagcgtgcttgctgcaccgctttctctccctgtcccgcatcacgacgctccgccgccctcaccgcatcgctctcgccgtgccgcatcctctccttctcctggatcgcgcccgtccagccgtcccagctgcatcgcgctccctctccacgcctcccctcccctcccctcccccgcccgattcccctacctccacgacggtttctcgcctgatcgctctgctccctcttcgtgaccctagccttcgtgcgcgcaaaatcaggaaaacggcatagacacctcaactgctccttgatggctaccgtgattgacgcatttaaatctgagtgctatgcccatcacaggtattgtgagtctaataactggtatccatcgggtgattatcaggtttggtggtttctatctgtagctctggtggtttagtagcccatgaatactagactccgcctttgctatgtaactaattgttgcaacacactagccaatttgttcttttgataaaaaaaaagatggattagccaatctccatcttgattagggattattggacgcaaacggcctcagctaattcatcctccagcgaggcagcgacggtgttgcattgcacacaccagcgacggtgtttcctatcatcctggcctgcactatttttttctgttcccaattggatcaggtgcattcttcttttcccttattctcccctattgagtttattggttcaccaaattaaaacatgtgtcttttggatgagttcatcggctgtactcatttttttcccatttagtactgtaaaaaagaaatgtcccaggtgtctgtcttcagtatgccagccaagatttaatatcagattcccccttcctttagatgaagatcatatacttttttgctgatggattttatgctgcatgttctcacctaattagaatgtaaattttggtcactaatttctatcttaaatcatatttcagctatggtatgattcggaagagattcagtttcttcttcagaggcattgatttctagaaattccaggctgtacccctcaaattagcttatttcttatactacaatattatttatttctatcaaataatatattaccactcttgaaataattgtgcaactgatccgtacttagtttgaagcagagcacagtaaacagtggccgttacacggcacatactactcaactttcatgatcacatcagaaggttagtattttacctattttcaacatttgtagtcaataaaattcattttcctatagttgatcaaataagattgtgctttgttagaaaaatacttggacctattcaaccaactcattttcctatgatcggtctaataataagattaaggtcagttggaaaatacttggatctattcgactaataaaatgtgtaaaatgtgatgataaaatgttttcataaaagtaatgtttttcatatacactatttctatttgtgatggatcaaacgttctcttttctttgcatgcacaatgtcccgatgcaacgcgcggggtaccttgtagttccatcaaactcataggccacatgacttatttaagaatttcttggattttggtttcaattgaagtaataaatatgctgatgatgttttgtctattgaatgataaagttcactgaaaaattgtatcgtagaataattttaagcagtgaacatatatagatagtatatatattgtatgcattacgtcgagtctgtataacgtattattcatggacatgtcattggatttttatccttctatgtcaattttacatgatagtagtcccaataccactaataaatcggttgcttcgtctggaaacatttgttctatttcagccaatcaatatatgtaatttatttgataaaaataatttagcagactaatcagcatttgatatcttcaggcacttttagaactcatttaatttgtgttgtgcctactattcgctatatggattctatagtaggtcaaatttccgtaattcatagaacttgcccgtaaaaatcacatggaccattagacttagaaactataaatcaacaaaataaatattataatggtttatatataattactaattttgttttcttggaacatataaattaaaaatattagtacacataacttccactaaaacaaattttacttataaatttgacgtatatattttaacatttataatacgaatagcaatatataaattcatcccgtgcaacgcacaggttgacgactagtaatctacagtctgacacatttatcttcagtgttaaaagtgcaggtcatcacagaagctcacaaaggagtgcctcaaagtaaagagttctctcaatgtaggggaattccgtaggagtgccggagttgtcggcactccctccactggagtcctggaggaatgccggatactttattcaataaagtaagtatttgggatttccttatggtatttaattagcttacttaagtgggatatattctcattggtgcggatttgtcgcttagcacttatacagagtgctctagtactaagactcgggataaagaagaaagttcttggccgaggctagagtattaatcgataacgtagacatggtgtgtagattagctgttacctccgtttgttgtgtgctccacagaaagtgaggtacgtgataggtggtgacagccctatccgtcctttacatccctccatgttcgggtatgtgatagagcttaaggccggactcagcctggcagagcaggagaggaccggtgcccactactacaaaaaccctcatagggaccggctcataggtgccggttcatttaaaaccggtacttatagagcttttcccacctcccagtaatagaaaaatgtagaaccggcacctttaaccatgctagaaccggcacctatacctttgagccgagccgatgagccgataccatccgcgcacgcacggtgcaccgcacccaccgcatccttatctactgtgacatcccagcctaaggcttaataggaataatagaatactcatatcaacaagtttcaacttctttttcggaaaccgatctccaaagaactccagggttaagcgtgcttggcctggaacaatttgggagcgcacgagtgaggacaaagtgtgcagaaaagacttatgttggtctgtgagggcagtctatgacctatgaaagctgccagatgtaagcgtgcctggcctgggagaggcgggacgttacatctactccctccccttctcgatctctcgcatatctctccctttctctctcgcgcatctcgatctccctccccggcagtctataacctatgaaagctgccagatgtaagcgggcccggcctaggagaggcaggacgttacatctactccctccctttctcgatctctcgcatatctctccctttctctctcgcgtctctcgatctgcctcccccctctctctcgcagcggctgccccgcggaggcagggacgtagggtggcggtgggcgagctcccaaagccagtggcgcaggtacagccagtgagggaggcagggcggcggcggggtcctcccctccggacccctcctccttcacctcatcctccgccgccctcccctccccccttccacctacgcgacgggcggtgtcccccttcccctctgcccccccatgggtggcgtccccacgggcggcgcatggagaggcggcggatcgcagccggcatgcggcagcagcgggtggagaggcggcggcagcggtggccgcgacctcccctctgccagatccggctgcccggcatgcggcagcgggacggggggcagcggcgtgcggcggcggcgacggcgtgtcaacgtgttcctgtttgtggttgtgttgatgccttgatgatgctcatgttcttgagttcttgatgctcatagagttcttgatattcttgggtgaaatcgggagcttctccatgcattgttgtttgttattgatgtgtgattaggattttgattttggacgtgaggattttgcttttggatgtaaggatgtgtagggttctggattcggctcgattcgagccgggggatttttttttggctcgtgcagacataaaggtgccgggtctattttacctataggtgccagccccagtaataggtgccgaccaattggtgtcggacggaaaaccgacataggtgccgaccaattggtgtcggacggaaaaccgacacctattgccagttttcaaccggcactaatagagttttctggactagtggcccgaagcattcgataaagttttacctttaacttaagttagctagttgaattcataggaatcctctctatcctaatattaccatttagttgtttgtccttggttgaatcttgtttttagatatacacacacgttcattgtgttcgataccattataatactctaaagggaagtgctatagtggtatctatgggcttgcggatttatctgtgtgcgtaacaaataccaacacttggatcagatactcgcataagagtccatgaagaattactaagtcctgagtagaataatatggaaacaattgaagaaacaaactcgttcattttgaattttgagtttgacttgaaatgaaatgtttgtcagaatccaaatcacacttacggttgcaactaaaagctttgatagatggaagccaagtacatcagtccaaccacacttagaaagtgtccaaggtgcatagcttcgaagtagtcaattatagataaaattgggaggaattcccaaatagaagtgtgtgatagtagcactcaaatacttggataattgcattaaactgaactaaccatcgttgaactatgaagagcctcgacatggctgtgagagatggttacactgccccagcaatcatgttttgaaaattatcttatcacccatcattttagaataatgcagcatatgacgcacaatgcaaatgagtcacatgaacaaactcactaaagaatatgcatctccatgttcttctatggacatgaatttcgtacaagcaacaaaatattgaatgctaagttatgtgaaattcttgcagatttgaccactagatcattgtacatcttctcttgaatagatgtgtccgaggaatcggaacaatgagacatatagaaatgcaaaattcagggggagaatttcactgactcattccaaaatcttgatatagaaaatcattgccatcaagatgaggcataggcatatttgtggagtttttcccattgggtttttgtggagttttgatgaggcataggcatcatgcaatgaaagctcaagagggattgttaggaaaccgacaggcccatgaaggcatggcctaggttatctactaatgggccatcactaaatatggaaagttcatgaggctatgcctatcaatagatgggaggaggtgatgtattgtacactagtgatatgcaatggaaaagtctcacccctacatcttgtgtcaacactttttctagaattatgcaatccctcttagactactatgtagcaggaggggttgcataataatgacgaatagtgattgacgctcatgtatatacacacactcacactttgtctccaggaaggatcacatcaacaccctaccctacctgtcagataaatgggaaccagggttctcattacaggctgctacagacgtccatggacatgtcatcaagatcatatgacacatgttgtcgtcaaccagattcaagcgacaattgagatacatcctgtcggtgacatggggccgggggtatcgtgactagaggcttgggtagccgtgatcacccacgtggcccgaccccctcgggggggtcgggcccgagggtgacgtggccacccctccctctgtctccccgaggggtcgggccgctcccgtttcggccccgagggctgggacgccccgaccccctgtggttttggcgccacgtgtgtgggataggtgagcccagcggggctcacctaaccgcatttatagcgggttggacgagcgcgccacgccgcatttaatgcggcgcagcgcacgcttatccggtccgtgaccagtcgcggtatgtgaccggtcacagaccggtcagatcgcgggttaggtggcaacaggcgtcctgtcgcacgcctcgcctcgtcccgtcggaatgatgagagtttcctggctctcgtctctagccggagctggcgtgctgactcctggagttggtatgtcagtcccggtcagatccattctaggcttcagcgcaagcatggcaagaaagtcgctggccattgaatgaaggttgaaacgggcgtccaccgggagagctgacgagcggagcagaaggcgtgtgcagtgcttgtcagaggtcacttccggctgtagactagccctcattgtaaaaagcatgtttcctttcttaggcagctagaggcccatgtggtgacccctgaccacataaaaaggaggcccaggcctaggagagggggctggactctggccacttggttctagagcctgagctctctctggttctctcgagctgtattccttcacacacagatccaccagaacacaggagtagggtattacgcttctcagcggcccgaacctgtctacgtcgcccgtgtcttgtgcgattcttctcgctgacattcctcagatcgagggcgaagaacctcacttagcgcccccggccgaaccggcaaaggggggcctgcgcggtctcccggtgaggagccccaagctccgtcatctggcgcgccaggtagggggcgcgcgtgtctttctaagccctcgtcctctttcgtgtgcgccaagcttctcccgctcagcccaatggccgaacgggcagtggcgcacaacctctctccgagcgctagcggtgacgacggggagcagaacccgcgccgtcgggctcgcaccccaccgtccccctctcgccgaaatcttgggcggggggaggcgctcgagggggtcgaaagatccgcgacttcgccgcccgcgggcgacgggggaggacggcgagacggggcgcgtcgccgcctcgtctacggcgatggcggcacgccccagggcgcgctccaggctgcgggcgcgctcctgcgtcacccgcccgtcgtccccgatccagagactccagcccgacgttggctggatgacgtggccgacttggtcatgacggcgcagcagcgcctaggcgccggcgggcagtcctccgccaacaaggcctctggcgctgccgccgccggctccacgtcgtcgaggcggagggcgcggcgagcggcggccgttacccgccgttcgtccgccattccctcgtcaacgcctccgacccaagaagatgtgcatggggggccggatgcccggctcgatatcgagcgccggcgcgacgatcgtcgcgccgcccacgcaacggagggcgcttcctcgtccggagcgccacttcgttccgggcacgggggccggccccccgtgtccccggttgacggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggccaggcgcggggttggttaatgaacttgccacccgcgtcggtccactcttgggaggatttgtgccagcagttcaccacgaacttccagggcatatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcaggggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggccgcccccgggtccgccgcacagccagggcggcgggacaggaggaggaagaagaagtcggcccgttccgacgacgagggtcatgtcctcgccgtcgagggcgcttcgcgggccccccgaaaggggaggcctgcgagcgacaaaaagaaggaggccggcgctcccagtagggagcgcccgaccggcaagtggtgtaccgtgcacaacacctccctccacgacctcgcggactaccgcgcggtcaaaagtttggctgagcggacgaggaagtgggaggaggagaagaggcaggagcgccgtgagggcaaggccccggcggctcccgccggcaaccggcgaggtgaggccaagcagaaggccaccgccgaggacatcgacgatggcaatgatgacctggggttccaggagcctgaggccaccgtcgccaccgtcgatgggggagcgtgcgctcacgcttctcgccggagcctcaaggccatgaagcgagagcttctggccgcggcccttacccatgaggcgacgcggcgggcgcggtggtcggaggttgccctcaccttcgaccagatcgaccacccgccgtgcgttgcccggggaggacagatcgcgatggtggtttcccccaccgtttgcaatgtgaagttggggcgtgtcctcatagacgggggtgcagccctcaacatcctttcccccgtagcctttgacgccatcaaggccccggggatggtgctccggccgtcccagccgatcatcggtgtgacgccagggcacacctggccgctgggtcatatcgacctcccggtcaccttcggtggttccgccaacttccgcacggagcgggtggacttcgatgtggcggacctcagtctgccctacaacgcggtcctggggaggcccgcgttggtgaagttcatggcggcggtccactacgcctatctacagatgaagatgccgggccccggtggccccatcaccgtccatggcgacctcaaagtcgcgcttgcttgtatggagcagcgtgcggaccacctcgccgtggcgtccaagcccgcgggtggcgacgagaggctcagcacctcgtccccgccaccccgaggcagcggatggtcacgtgcgacgaggtcccggtcaaggaggttgccctgggcgacggcccgtctaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagaaagtgcggcggcaggccccggaacgtcaagccttcatctgcgaggaagtggcgcgactcctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcgttcattaccccaataggaacttattgttatacgacaatgcctttcgggttaaagaatgcaggtcctacttttcaacgtactactcgaatttctttgggtagccagttaggacgcaatgttgaggcctatgttgatgacttggttgtgaagacgcgcaaccaagagaccttactctcggatctagcggaaactttcgaaactcttcgctccgcccgcataaagctgaaccccaataagtgcgtgttcggcgtgcctgcgggcaagcttctcgggttcttggtctctgcccgaggcatcgaggccaaccccgagaagatacgagctatagagcggatgcgcccccctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43662 - DNA, 876 bp, Oryza sativa
  unsure (1)..(876): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgttttttaaagaacttatgaatcacagacatttgttctagggttattaccaggtgaaaataacagcagggaactggctgcgtttcttcatggaagagtagatgttagggaacactccatgacctgagtagcagtagccatacaacccaacggcaatgggaattcctgggagattcagtgctgtcccttcatccttggcctcaatgtgatcaacaagtccaacccagaacaggcaagcaacaatgactatagatgcaatcactcctccagctataacagaatgaacaagatgagatccaaggcacattgtgcaccccttttttttcccgattatatgtatgcgcaaacaccacacttgcacatccgtttggtgtgtgtccacatatactcaaagtaacaaataccagcagcatatccttggcccactatttttttttttttgaaagagtacttgtgtgtgtgtgtaatattcaataagttcaagttttgcaaatatatttggtgaaacaaaggattccggtgacaagtgttgatacctgaaatgaagcttagacagctgagatcgcgaagccaagttgttggcatgacaatcagagtagtcaggattgcgaataatatatgcgcatttattgtaaatgtcccaatggtcaggtgtgcattggggaacaactttgacaaattatcactctctaatatcagatactca

SEQ ID NO: 43663 - DNA, 12678 bp, Oryza sativa
  unsure (1)..(12678): unsure at all n locations
ttttttttaaaaaaaaagaaacataaaattgtacgcatgaaacataggcaagctggcaaacggtgttctgtacacgtttaatgttgatactctaataatgaagtatttctgttcacccgtagtaaggttagaatgaagagtctcccttggaggaaatttttatataaaattacaggaatagagaaaacacacataactccgtcccaaaatataacaacttttagcctcagaatttatcccaaaatataataacttcttcaccacattatcttcccaaccaatcacaaccctccaccattcactttttctatatacctccactactcatccaatcacaaccctccaccattcacttctacctactttattaataaccgtatcaaactctaaaacttattatattatgggacggagggagtagaattttaaagtttgattttctaagaatgaagtagggagtttaattgtcctctcataatcatgaaaaaaaagaaatagacaaggaagtaacacagaaaaccccaaagggcctattcattttggaggaatttcaacgcataggaataggaaaaataaacgaataggattgcatacacgctttaatccataggaatttttccatgaggtttgtgtggatgaaaaattccctttgttttctgtataggaaaggaaaacttcctttggttttcctatatttacattcctatgaccccaatgacattcatatgaattagtatttaggaatctaaatgctttgaaattcctccaaaacgaataggcctaaaattaattatcaaaccaaatgcacccagaacataccgttcaagacgccctgagtgtaggtgcactgccggtagggcccaacctcgtggtgtccaaccaccagcggcttctgatcctcggggatcttctgcagagacgacggcctcctcggcggcaggaggtactgcgagctcttccggccatcttcgtgctgctgttgccggcggtcaccttcgtcgtcggccgccgccgtcgtcggcagcagtggcttgatgagcccggagatgatctccggcggctttccccggaacgaggcggtcaggaatgagtttgatagacggctcagcgtcggagtgcccaggaagctcaggttcggggattgcacgctactgtacatgtcaatcgactgcctgttgatgcatagaaagaaaaaaacatgatcaaattcttgtgattcaacgttgcttattaattctgagattgagctatgatggaaactgcatttgaacatttagtgaagaaattatgcgtgcttgttctggttcatataaacggaaccagagtttggaatttcggtttggaatttcggatctacttctgtttaattcttggtaggaatttactctggtctaaattttttgattttgtttcactgcaacgaaatttgcgcatacacagcaaaaactaatttcactgaaaattccattttgatatttctgaaaattttcggaaatttcagtcgccgtgtttcgttttcttaatttctttccaaaatgtaaaatactatatattcagaacagataaaaaattggcaaaggcgccgataatattgatctgaaattctgaatattcagattgcacaacgccccactgattctctctccttctctcagacaaaattattttggaagaacagatggggaccaactgaagctgccaagtcagcaccagggaccacaggaacagtgacacgtagcaccaattccagtactagccgtgacacgtcactatcgtgggcccacatgtcaatggcttctgcaatccacctataggttcaccaacacgtgtcctcacaccccgatgccatcccaaatggctactgcatatcctgaatattctggccatcataggcctatcaggatcagaaggcatctgaaatataatcaactaaaattttcgaagaatatgtcatgtggtatgtctatgccaaataaaaatgtataaatcattgttcttagtttcaaactgttcttgcagagactcttttagtgtgtttggataatgggataagaatagtgggattggaatagggaaatggataaagggctatgataaaacgagggagggataatggatggctaggattagaagaaactctttgtttccccaacccattagccaaacaggcctttgtgtgctagtaaaaagaagttagaatctaaatttgtattttgcttttctacctaccagatgttcattatccaagaaacgtaccaaatgagttgttgagaaacaacagaaaaactgccatactttctttttttttttgaaaaaagtgttgcattgcaaaattcacagttaaaaaaagtaagactagtggtgattaattagtacgggatggcaaactgaactctccagaaaagaatggaaaagactgaaattattcgactgtaaacagaaaagtttggacttttattgacgcgtggcactgcgaaagaaaagaaaaaaatataaagaagaaatgaacttgcgtcggcgaacctgtagctctgaggccactgctgcgtataggagctgggctggctgccgcggccgccaccgccaccgccggcggcggcgacccgcggggtaccgcacgaagacgacgagtccgacccgtcgtccgactcatcgccgccgtggccgcgacgcttcccatcctcgacggcggcggcggcgtcgtcctcctcgtcgctgtcgatgaggaagctccggtccgacaccgaattgtccatctctcgcagtagacctcgtgctgaatgcaaatgcaaatgcagcaacgatggatcggggggagagagagggagagagagacactctgtgtgtgtgtgtgtgtgtgatgaggacgggtttatattgcggcggtgtgggcgctagccgcttagcaagcggccgggatgcattcagtggcggcgacagcggtcgaacgtactagaggtgaaacgaaacaaacaataagatgagcatgtggtgtttattaaccgaggccattatccttagtagcaatgatgtcgaattaacctattactctccctctgtcccaaaataagtgcagctatgagtttccgtatctaactttaatcgttcgtcttatttaaatttttttaaaaaaactaaaaaaaatatgtcacgagtaaagtactattcatcttttatcatctcataacaataaaaatactactcataaaaaatttcaaataagacgaacgatgaaagttggacgcgaaaacttatggctgtacttattttgggacggagatagtaccaaatagaagacacgatactatggatttggatagtagacacgtctactccctccgtcccaaaaaaaaggcaaaccctgggtttgcgtgtccaactttgactgtccgttttatatgaaatttttttataattcgtatttttattgttgttagatgataaaacatgattaatactttgtgcgtgacttgtctttttaatttttttcataattttttcaaataagacgaacggtcaaacattgcgcacggaaaccagggtttgtctttttttgggacggagggagtagattgatatgtcctcaccacaataatttgtagttttcttgatgaccacatgatatcattggcagtcaaaaatagtcatcaagtttagtcattgtcttagcggttaaaagtttgttactctcttcgtcccattttaaatacattcatcagtttccgtgtctgattttgatcgtccgtcatttttttatgattagtatttttttctttttagatgataaaactttatgagtgatttatgtttttattttttttttcaaataagacgaatgattaaggttggatatggaaactcatgactacacttaaaatgtgacggagggaatatattttaagatggatgtactatttatcatcgctgatctgcacttggataactaacaatctagaattattagattaattatgatgaatgaaagcctactacttgtgttaatatttagtatgtaatacgctttaataatatgacatgtatttcaatattttgtaaaattttgaagagaaatataaatggttaaagtacaaatataaatagcgctagttgaagaagcatccacgtgagtagtgtcctaatgatattccgttggagtagcatggaagggtgagggtgagtagcatggaagggtgagggttgcttataatttgagtctcatgatgcccatcctttatactcaagtttcatgaatttttaagataaaaaaagtttcatgaattactttgatttttctctatttcccactaaaaatcatgaattctgctactcgatcccttcattttaaattacatgtcggcctaattctagagttcattttttttctaactaaaatacttttcattttcatattccaattaaacactttaaatgtgaatttccttttatatcctttattaatgcagtcacacgtcaatgtagtcacagctctaatggacttatttcaactaataaaagttaacgactactgcagaaaattcaattgcgtaatctacttaaggaatgggtaacaatgtaatttgtcatattttttttgtggaatttgctagaacaataagtaattttaaatcaaaggggtaaataaaataaaatcccttgccaatgtgtagttttactggtgtacatggtctcctcacaaagtccttgcccctatttcacgcgagccaacattattctgtcgatttagatttcgctggtgctatatatatattttgtagaattagtcaattcgaagtaatttataatgtattttttttctctctctctctcatgtggagcaaaccaagggcatgtgactttgtaacatgtgtggtctgccaccggccggttgcaatgggtgttgtttggttgcaaacttgcaagtgcaatacgcccgagattgcaatagctacttgttcttggcctcatttgggtggcttacgttgcgttcatttttcgaatgagatgattgcaatatgcatggattctccagctcttgtgcattggctttaacttgccctttgcagttgattagggccgcaaaatacaggagtgtgcgcccctgtgaatgtgaggttttgaggtgttgggctgtcccggttgcaataggtatttacgtttctttttctcatcgagagtaatcagaaacaccacggtcatactcacactgcacaacaccacacatctacatatgtggacgccctcggcatttagtgcaattgcaaaatattaaggaataattgctcttttgccactgctgggcgtcctatttggcaatatgccactgaaaaagagctaattgctccaatgccactagaacgagaaaaaaatcatttgagatgccactgccgttttgttccgtcgatggccgttaactgctcggtaaaaaaatagggccaactgttccaaaaaaaatattaagcatttactatatggggttaaaagttctattgaccattcaaatacttcatccgtcccattttaagtgtaaccataagttttcgcgcccaattttgatcgtccgtcttatttgaaaattttttataattagtatttttgttgttatgtgatgataaaacatgaatagtgctttactcgtgacttatgtttttaatttttttttcaaataagatgttggtcaaagttaggcgcagaaaaccattgctgcacttaaaatgggacggagggagtagttaaatttcctctcatttctacttcatccgtcctaaaatgtaagaaagtaggtgagactgattggaggaagtttccttcgtcccaaaatataagaaattaggtgagaatgataggaggaaatgtgtgattggttgaaaagaaaaagtaggtggaggagaatggttgtgattggtcgagatgaggaggtaggtggataaatagtttcattttgggacaaggtattgtgctagaaatagctacattttgagacagagtaatatgaaccctagatcgatccattcatgggcgtcgacggcggtttctgatgagtagggagttgtagctgcgtcctagagaacaagggcagaatggtaattaccccagtcaaacgtgttgactaacagaattatttgatcctaacgacagagtgccattttggcgtgcccaactgtgaaaccagtggcattctaccaattgaccaaaaaccagtggcagaatgacaaatacggtaaaccctagtggcatttgtgtaattggccctattattaaaggtatagaaaacttggaaagtcgactcatgatacccacaccaagggtcggttcactacaaccgctctttgatagtttcctgtctatttatatatattttaaaaaaaaacacagtacaaacgtgatgttgtttatatgccagaggaaacccaccgtctcttgtccgagtgcgtcaaatttgtacaatttctttcaagcaacatgtttaaaagatatggatccatattatttacttttgtgcatgtctgagttggttagctctgcggctgtactactcatctactcgtatctcctgcggtaatccaagatacagtgcatcttatttttctttttgctgatagatatttaatttcttttttcattgtaacaatggggtctcgcaaaaaaaatgtcgaaatacctaattggtgctgcctcgcaaaaaaaaaagtcaaagttaattacataaaaccactcaggatcgaacaaatgcatatcccgctgaattttaattttttaaaatgatttttcttctgatattattttccataattttggggattttatttttttcaacccccatttctcttctttcttcttgtttatccccaattcgaaaatcctacgcgcgcgggtcttttggacgagcaggccttcggaactacatcctctagagtatctgcacggggtagggaagcgtgtttctttgcacgactactctttgtttcgacaaatttgactacttcatctactttgtgttcatgttcgagatgtcgacgaaatagaatggcaacacagacactggcaatgctaatgccaacaccaaccactagtgcacctggatcaaatgtttctggtttattctctgggtatcactactacagaaacacaaaaaggatacggcactataggtgctagaatagctaaaccagcacctatagtgctttttacctctaacgcacgcccacagagcgccatcggctagaaccgacatctttgtgaagaaataggtgtcgtttctagagaaaaaccaaaacaaatactacatgtgctgatttatcaagaaaaaccaacacctataatttattaatctacatgtgctgagttaaataggtgctatttaattaaaaaacagacacccgtaataaccaagctgagccgagccggctaatcgcgagcggatatggagagggaagggcagagtgggtgtccttatccactctagtcacctccgccatctctctctctccactcatcacctggccacgagggcaccgcgaccagcgtcgatctgcccagaggcggtacgagccactgaggccaccgcgcacgaggtgctactatgggtggcgcccacagaggaggcggagcggcgccgacaatttggatctggcgtagatcacggatgggcgttagcggcttcccacggccgatccgacagcgaccacgtcggcggcggctttcccacggccgcggtggtggatgttcttgatgtgttcaatattgtattgttcttcaatgttgttgacgtgttcatgtgtttttggatgttgttgatgttcttggatgccaattattaatattgatggaatctgatcgagctgaagggatctgctcgtcaagccgctttttttattattatttttttgcatttctagaaactaaaggtgtcagtttaggaaccacacctttgagtcctcctcaaaggtgccgcctactaggtgccggttagaaaattcggcacctatggacggttcccaaccggcacctattccattttctgtagtagtgctcactctagtgttgaacatgttacttgatgctataatctctgctggtaaggttgtgattaacaatagcttactcttttccatagttttcatatttattctcacgttattctcgattaaattatgccgaaatatagatcttcaatatactcgagtacggtcagtgtctcactatatctatcatatgcgaagtgagcatagctcaactggttaggttccttgtggtggaactagccaacccgggttcaaatcctagatttgccacggtactcgcatttacggctaattattcttttagtggtaggtgatgtaaccgttaacagcatggcacccatggtggcttcgtcattctcaagatatgccagcaagtcttccggaagtgctcaaaggggtagggtgtgcgtatgtgcgtccataggagttagtgtgcgtgcgttgtgagtgcttgcgtttgtactatgtttctaaaaaatatatatatatactttatagaatttgagaaacttcatccttttctttaccacttactagaacacaaaataaatagcaacctgtcggcgggcgtaaatggcaccttctgtcaacaagatttaatgcatcatgtgctgactcagatgattaatcatcctttaattagatagtactaatgtactgagattcctccgtttagcatgcatcttgttgaaatatagataccacccacgatgatgaatgtattcttttaattttatacaagaagtcatatggccatatttaaaacactgccagttatcaatgtgattataataaaaagctacaaagttaatacatgcatagatctacaaagctacaaagttaatactccctacgttctatattataacacgttttggcttgtttatctcttataatataatttccaatatacatatgaatttggacacatatatataaagcaaatacatgaattcgatcaaaacacataacgtctatagtgtgtaatgtgaaacgcagggtacaccgaaaggatcttgaatttgcctagaggggagggtaaataggcgttcctaaaaaattatcacaacttcatagcgtactagagagatgagaactttcggttcaaatcggaacttctggtatgggattggaagttctggtcttaacataaaagttcggcggataatggaataaaatactagctatgaacttgtagctcgaataaacaaaatgtatatgaatcaaaaggtggcaaataaggtatctaagcaagatataaggtcaccaactatattaattaagcatgcaagtagatcgggtaaaaacaagctcaagcacaatatgagagatggcaagaacgagcaaaccaagagaggagacacgttgatttgtttcccgaagttcggatccacggatcctacgtctccgtgataggttaaagcttgtcatatttcactcaaatgataggttaaagctttggtttgtctcaaggtagcactacgataggtcacttttagcaccgagacatacacaaacacatcaacgttgcatccctcttaatagtacggcattcctaaactcaaatgtaaatacgaagagaattataccaataggaatgctttctttccatctttctttccttatcttaagggatgccaatgccgaaaccgtttcaccatatattcttcaaattattgatgcggttacttctagtttcaaatggccttgcacggtccatcatgacaaagccgtcgctcgcccttcaccgctggatttggttcttcggcgccaagctccctgcttgcccttcaccgccacatggtccatcactaccgagcatctcttgcccttcaccatcttgccatagtagccactttgtatcccacatcttcaatatccccacttggtattttaggtgtaatcatatcacttgagtgtcaacaccttttcaatccttggaacctatttttctcattcaactcaatgaaatcattagtctcaaatatccggttgtcaacctctacatgttgaccaaccgatcacatgtataaaaggatataaataaatgaggagtattaaattaacaccacaagtgtcatatactcaaatatatgctcaaatgtaaagatcccaattaaatgaaagtgaatagcatggatcgattacatgcataactaaagtatagatttgctccccctaaatgtatgcatacaaaatgtttgtgtgaagcaagagtatgcataaaaagaatgaaacactaggagcctatcctatacaagaatataagtcatttatcaaatataggcattaaaataaatgtataccttaatcatcttcatgttctcaatgtaaagagactaaacaagagaaaaaggctcaaacaaaacattagtctcacatatatatcattattcacatggaaatattatatatgaacatatcaatatgtacatggagagaaagattgatacatgtagcttgatctccatgcttttcatccttgtgatttaggtccaccatcaatgaacatttctatctcaactcatagaagtccgggaatcacctttcacacactccactttcatatccacatgagactaggcgaagaaatgcttataaaaaaattagtctcacataattggatttatcattaatcaccaaaaccaaattaatggcacatgaactttcgtacacaaatacattggtagttgtcctttgcataatatctctattcagagaaaataacgacatgctgtcagtagttaaaccggacaatatatactctactggagaaatgatctttgctaggtcatgcaaaaattacattagacccggttcgaatagaaaccgggactaaagaataggtttagtcccggttcaaaagcccagcggcactttttgatcgttagtcccagttggcagtcccggttcaatagccacaggtcatgtcaagccctcgaacaaacattnagtcccggttggtaataccaaccggggctaaatatcactcttccaagcatctcacgcgctctctctcttccttgtctccttggcatccgcacaagcttttcactccttgtcttcctatcttatcccctctcctcctccactccttctcctcctcctccactcctccgatccactcctcctcttcccctctcccggcaacaggccactcctcttcccctctcccggcaacaggcggtggccttggagggccatagcaggcggcggccgggcggagggcagctaggcggtggcaacggcccggaggggtcatcggtggcgcttatgagcgggctgacgcggcgccggagacgacgatgcgaggacttgtgttgtttttctgatgccattgtatatgtgtggtgctattgtggatgattaattttgttgagtatgtgaatttgtgatgctaatgatttgtgaatttgtgttgtcattttgatctgtgatgtttatttgatttgtgaatttgtgatgtttgtgagtttggcatgaaatcaatatgcaaacagcaaaaaaaaaagagacctttagtccaccaaccgggactaaagatgagcatctttagtcctggattgggcatcccggttgcatacccgggattaaaggggttgcaaataggaagtattgtgggtttctccagtagttatataattgaacaagtgaactgtgatagcgcataagtaatttaggagttggtgtgaaatgattatcaacatggaagtgataaaaaaaatttaaacatggaaaatatatgctatgtcatcgagttggcatgtatgcctctaagattttaccatggattttgtatctttttcttcaatgcatatgattttgcagattttacttcgaaatataaggcactattaatcattggttctaaggccgagggctacactagcatgagataggtcatctcaatcgggcggaaaccatcatctgcgtcgggaagggctcccgtcacaaaccaaaagtcacagatgtgagaagtcatctgtatcgggcatttagtcgtcacagatgacagttatctcaaacgggccaaaaatggtgcccgtcacggataggtttgacccagcagatgagtcaaaccaggaccaaactagggcccatcactgatgagatcatctatgacgggctcatacttcaatcacgggattggtatgattcccatcacagatgactcactcaatcgggcttgtttttaaccccgtcacggatgactcatctatattgggttttaatttaggctcgtcacggatgatatcatctctatcggtcttttatttaagtccatcacggatgagtattttacaaaaaaaaattattttttggctagcctcaggcctttgctagccatgcccgctgaaaatgacagaagaagctatatatattccttttcccaacaaccccgttcgcacatccattcacaaatcaaacattcagtgatcacatcgacattcacacacccattcacatatatatgtctgagacatatattcaatgatcacacatccacattcacatatccattcacatatgtcattcacatccattcagcgacatgcatattcaagagtcaagcatcaaaaacctgcaaaaccgagttataaattggaacaaatttataagtgattagcattgcaagtatatatagaaacgtcagacc

SEQ ID NO: 43664 - DNA, 5122 bp, Oryza sativa
atatatatatatatatatataaatgtttaaccattgtaaaatcacatgtatttgatcgagagcgttcaacccgtcttttgtctttccaggaatatttagcagtaaccattataaaatgaatggccaaggattgatgctgaatgtagcaccctcccgtagctctagaggatcccgctactcctgaatccccttggtgtgccttaactgacaagtggccctatgagtcgataagaaataaggaagttactggagtatttgccatcttttaaaataaaatgtgtatacgcttctagttttgaacatttttactgctcaagaaaagaatcaattatgtttgagccactcatttgtactagctcggccagtgacaaaacaaaattcaaatggcaaaacgaaatatatatcaaaatcgagagtagaaaaaaaaacccatctctgttttcgtgtgctcagtggatgttcatgttgttgtatggttaacaccatgtgccaatatgcacacgctgatcggcaactatttcttgtatgaaaatgacacagcaagagcgtctctctcgttttatggcaatgttggcttcatgtttcaataattgaggtgattgcgatagatgcaagctagattcttctattcttgtgtgcctcatctgctattcccggtggatagggccgcctgctatgcacactctgatgaatgcggggttgaggaattgatgatgacagctcaagggactgtggaggattccagttgcaataggtgtaaagttagatggcttttgagtaatagtgaagaaattgggccaaatgatttggttcgagaatttatctgggcatgtattgcgttcagcattatattgagctaggatgacttcatattcaactgcagcttgatttggaaaaaagatcctacccaaatacctataaatctcacaacaatttaactaaatgaggatatcgtaatcacaaatggatggcatcacttttttctaaaagcaaacattttgaaatgtgattttaagattaattttagtcaagttatttagtcgtcatctttgcaaccatgaaaaataaaagtggcaaataaccccccccccttccaaaaaaaaaataattctaaaaccaaattctataattcaaaatgagatgtggctttttaggggaaaacaatgccaagtgggattgtttaattagtgttattaatcaggagaaaaacatgtgtagtttatcttaagaactagaagcacaccgtgatttagaactatctagagttaaaaattctcttgaaatacttgttcttcaacctacaccatgatttgctcttataaaataaatttcataaactcctagatattgggtcgtccgtaacataaaaccccaattgttgtgttttattttaagtaacctcatattttggggaaaattgtttcaagaaacatatttgtgtaaactactcatattttaatataatttattattagttttaaaaaattcacatttgttgactcaaagtacatatacctctactttatatttttttctcaattttgcactgcacaattttagtgcagtgcacatcttaagtttttgtgcagtgcaaaattcttttggcaaagtttcgtttggcatgtgtaccagcagccttgggagagtcaggttctcaggttgcagagaatggaagtaaagcatagtgttagttatctgtggaaaataccctggcttcttctggacagttgtttaagaacttgattacatctgttagtgaacttggcttacgtccggttggatgtagaggtcggatttatccccttttgttaaaaaaaaaatatgtcggtgaacttacgatcagacgcacattcctgaggtccattggaatcctgatctcaaattacatggtggactcgccacctggcacagtgtaacatgtgcctggaagggttccaaaatgccgaagataactactatctccatctcataatataagggattttggaggaatatgacacatcataatagtacgaatctagacttgtcacattcctttaatatcccttatattatgggacagagtgagtatttggttattgtggttattggccttgttgagtcgtatccacatttattttttttgaaagtaaagagagatttcattaatgagaaaacagagggttacattcctggttcaagagatcaagaatttctgcaggggaacacaatctccagaccgtattagttcctgatcccattaccagttgggctaaagcataagctatcttattagaatctctctttatcctgtgcacttgcacctgagctaaacataacattgccgctttaacatctgaaattatgccactccaatctgctcttgagacattggtcgcgtttaactcagcgacaacacttgtattatctgattctaagataagtggcatattcacccattcagtagcaagccggataccttccagacacaccaaggcttcagcttgcattgctgagctgcaccgtggtagtttcttacaggaagccagtagcacgaggcctcgacaatccctgattattatcccagcgcctgcttcacctgtgtcctatttgaaacctgcatcaacattcaacttggctacacctttggtggagtttgccacttgcttttcgttcagctgttgttgtatgtatgtctcaacaaacattggtccttttcctttcacatcatcaggttgttgccgagtcattagagtgcaatcttcgtagttcttcaaaaagtcgtatccacatttagaagcgcttgaacaaacaagtcaagttgaaaaaagagtaaaaaaaagtttagaaaaattttgttcaactggtttccgatggcaaccgctcggttcaaactgaacttatcatatttactttgcaatctatcaaaacattgttaggatatgttttgccatcgatccagaacaaccctcatacactataactactgtctcagtaacacgtttattacattccaaacacacaaaaaagaagtctcctactacgtttgtcatcttctattttctcttctcatttccaaaatatggattaaaagatattcattgtattattcgatgaattattttagaagctataattctactaggaaatattagttgaatgtatagctataattcctttttttattacataacagatatagataaatatctagctcaaagagatggaccagttgtgtatcccactcaattatagctacacatgggagatctaaaagttgctacagtacaatgccaaattaataactatttgccttctgaatatagctaaagctattcaccaaatgcttattgttttgacgcatatgaaaacttatttgaccatgcaagagatactatggaagtgagctgatgaaggaacagggatcaggaggactggggattgcaactgcaccatcaagcatttgtgtcacctttagcatgttaggtcgcatgcttgggtcctcctgaaggcaccacaatgccactgtcacaaatctttccaccttcttaatattgtagatcgcctcatcatcgccctctaccagcaaatcaatcctcccagaccggtagcagtcattggcccagtaagtcactatcgtctgttcctcatcgacaacctctagctcgacattcctcctacagcaaacaagctctagtagtatcactccgaagctataaacatcaaccttggtagagatcccaatgttcttgaaccactcaggtgcaacataacctcgagtaccccgaataccggtgtttgtccttgtttggtttgtcaaaagaagctttgctaggccaaagtctgaaatcttggccacaaggttgtcatcaagaaggatattctgcggctttatgtcacaatggatgatttgcttgctacattcgtcatgtaagtagagcaaacctcttgccaccccaagcgcgatatgaactcgggtgttccaatgtgggcgactattgtcgaacaaaagacggttgagagggccattggtcatgaactcataaactagcagtctttcggctccttcattacagaaaccaagcaatctaaccaaattcttgtggaatgtctgcccaatggtctcgacttctaccatgaactccttctcggtttctggttggagcttgtcaatctttttcactgcaatgttggtcttgagttcatcctccaactggcccttgtacacaacaccagaggcaccggcacctagaatctcatggaagccagccgttgccttctccagctctttgtaagtgaaggtcttcaagggtagttgggatttacttgatgcttgtgacaatgggatattcttttttgtggctattctacagtaagtaccaaaaaggaaaatggagatgagtgcaaagttcaccaatatggaggttccaagaatcaaagaactccctaggacccagtgcttcctgttcctcttccatttgttggagcttgtactgatcatggattgcgaactattgctacttggcaccttgagaagaacggtcctctggacatagtcagccatattcccatttgacaaagggagcttcttcttccagcaagtgctggtgctctgattgtacaccgccatggcgcagaagcagtcgatcacacacagccttccacaatcatcttgtcctatgggctcatatttctcatagtcagacagtggccaatccacaccataaattggtctcagctcaaactgagcaagtgccgttgcctcatccaagtcgcagctatgcggttgaaagtcttgcttacaccctttgtacttcttctgctcatcgaagaacttgtaccatggtgggcattggcagcttgcaatctgattcctggtgccatcaaaggtgcagtaactgttgaacccacagacgccactgccaacatctgaaactatggcatggcagatattctggggctgcatgctcactgctgtccatgtctcaccacctaggatgcctgcattcgctttcttcgggtacacatattgccggaaaacaccgtcagggtccagtgtggcgcgatggaagtagtctgccattgatccaattcctgcacctgatgagatgttgatctgtgtaccatctgtcagtgcaagtat

SEQ ID NO: 43665 - DNA, 2748 bp, Oryza sativa
ctcttgcttcctacccctgataacagctggtgagctgccaaacttgtgtagttatagagctatcctaacacttgtcatggaaaggtcttcgtcaccatggaattctacatatacttgactaatcaagcacttactggaatttgccacgcagaaagcagcaatagggaattcgtgtcacgatagcagtaaatccgtagaaattcttgtccagacaaaaacaacaggtaacagctagtgagaccaaatagaccaaggcatcaagctagtcaattctggccattagtagcaccacggggaggatttgctgtcgtcgacattcttgctgaagtagacaggcttgacaggtgttaactagctatagattgccgagaaaatgtttttctaccctacacttcagggcagaagaaatgtttgcatacattgaactcctctaaaaaaaaatgaagcagaaaaaatgtgtgacatgtgtctctgaatcttttgccaattgcataatgactatcagtatcaggtctgagtaacaaatgtttgtactaaaacagcttagtatgcgataaatttcaggcatgcttttgcatagattatgtcaaatacagtgtaaagagtaatattttggtccgattttataagttcggaagttccctaggtcacttcaattctacatgatgaacaataagtagctgtatttggactcactagtcctgggatatttctatcatataacgaacttgaactgaatcacagtttactgaactgaactgaaaacagtaacgaatcgaagtgtcaaactattgggctctacaagcaattcatcaaacaaatcgtatgcattctcgacctaacgactccactgttggcatccaattcactgagtaaattaacaggagggaatcaggaatcaccactgaaccagtactctttgcagaccagttggcagttgccggcttgctgccgctgcgagttgaagcccctcgcccgtggcctccctccccttgccgtcgccgcggccggcggctccgttccggcggatcggcgcgcgccgccggcgatgccatgcatgctacaggctacggccgctcggctagggttggtctctcgctctcgctctccctctccctctccgagacgccgtgcctgccgcctgccgccgacttgacgagtctgaccatcggcgttgggctgcctgagcgagtgagcgggttgaggattagctaggcagttaacagctcattcgcccttcgctctctagctcactaattaccagtttaccacatctttagttagatattctctccgacccataatataagatattttaggtgtatttaatgggaataccctggatcggtccctcggaggagggagaaatatcgggcgctccctccccaccccctcccccgacgcgcgctgcctgcccctgggcccaccacatctctgccctcacctgccacttatctccatcatatactccattgcaacaaattacccacatattttggaaatattctattaaggaaatttagtttatttttgttccaccgataatgtttcatccagtgcactcacaatgtttcactatgtatatatctaatgttgcagtgaactgaaatactctattgcaacaaatcacccacatattttggaaaccctctattaagggaattcgttttattttttgttcgactaaaaatgtttcacctagtgtactcacaatgtttcactatgtatagatctaatgttgtagtaaactaaaacattctttcgctatttgttgaaacattgtttttatataaggtgaaacaacacccgatttaaacgggtgaaacattttcgatctacgtagtgaaacaatttcgatatacctggtggaacatcgtgtaacatttaaaaataattcaataataagctaatttttttatcgaaatatatccatgtgtggtcttgtttttaagatttaattgcaacaaatttaatggtgtaatcggatcatgatttggataagtagtttaagagaaaaatcaatttaaagttgttttgcacgtatacgtggcgttgacggcgctgacgtcgtgctgacgtcagtgcccgattttaaccccccatcgggcgcccgtgccgaagtcattcccgtatgtaacacatactagtataataaatctggatagacatatatgacacatacaaactagaacaataaatcttgacatatgtgtcacatcttcccaaaatcccttatattatgggtctgtctagattcattgtattaatatgtgtcatatctaccaaaaatctcttatattatgggtctgtccagattcagattcattgtactaatatgtgtctgtcgcgtcctaaaacgaccctaaaatacatcctctaaatgatgcctagaataattaaaatacttgtgaaagccttcaaaaattaaaatgtgcaaagttaaaagtcaattaaggcttggaggatttttgtatatttcctaaaagcctaaaatgtgtaaataaattttagtggaattttcagagcataaataataattattaagaaataaacaaagttaaaaaggttttataaaaagaaaaccctaaaaatcccccttccctctcttgggccgaatccggcccatctcccccccctctctcctctcccccgcggcccatccggcctctccccgcgcgcgcgccgctgacgagcgggcccgcccgccaccctcgctgacgggtggggcccacccatcatccccttcct

SEQ ID NO: 43666 - DNA, 5635 bp, Oryza sativa
cgccgtccccgtccgcccccccgtcgagctcgccgaccgccggagtgccgccgtccccgtccgcccgagccgcgccgccgccttcctttttcgtcgtcgccgtcgacctagggtgagccgtggaccgccgtctcgtttccccctttccctcccctctctcggccgccgctccaccgtgcctatggccgccgccggcgaccataggggcgcgggcgcgccgcctcccgcaggccgcgccgatgtggccgccttcgggcgcgccgagcggctgccgcgtggggcccggccgtcagccgcccgcgccctcgggtacggctgacgcgtggggcccacggcgccggccggtgtgagcccgggtgcacccggtccaccgtggaccgtgaggctgccgcgtgggccccactcccgtggacccggtcctcgcacctctccccctcggctgacgcaataaaccatttttaaattaaaatttaaatgaagaaattcgtaaatattcatttaaagagcatataaacttcaaatggccatactttggccatttgaactcggaattggaccgttcaagtctctaatttttccttaagaagtcaagaacccatttttgtgctttgttcctgtttgttatatgaagtttattagagtaaaagcctttttcttttccgttggtcgtgtagacgctgcagcttcggaagatccgctcttcgtggaggttgaagccgacgtttgggaaagcgagcaaggcaagtcatatcatctttgaacatattggatcccactttatgaaattattttgatttaaattaatgcattatcgctttatttaaattctcgcgttatcactgttttatttagccatgcctatttacctttgttatgaccttatttttgttattgttattattactttgttcaccctagaataaacaaaaccccaactagtgggcgctctactcatggttcccctagtatgaatttagatagatgcttcgctgattaataagacaacattaggtggtttttataactttagactttgggaatattcatatctcttggactttatggaatggttggactattgtggaattggatgcacacctctccctctattcaaaactctcaaaatggttataggctgggcttggggtgcatggttttgatagtagcacctcggccacataaggaccggtcttcgggcctctgttgcaaagcactaccgtacttccacatgtatagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacaaggctggtgtcctgctgctaggggctcagtcctacctacctgtcccggaggttccggctgtaggtggggttgggtcggtactcttgtctatggctaggatgggttggaaactatgtcatgtcttccgtccatatgccgtggtggtatgtggcacgtggttgcacatgaggaagacgtgtcttgtgggtaaagatgtacacctctgatcagagtaaaacctattcgaatagccgcgccctcggttatgggcaagcctagcaatgtacccaagttagtgtttttaattcttaaaacctgcttaataactaaaatgtggaatggttggcatgagttggcttgggacgagctgggacccagggtcgggttgccggttcggtctgaatcatcgtaggccttgggttaaggcaggttcgtgtgggttcacggccttgtttaataatattaaatagttctaggatcgtgttttaaatttggctttgagcaactaagagtcttttaaatgctgtttattgcaaaacctaacccctatactataactccattgtactcctttgcatttatgttgcacttgtgagtgtgtcttgttgagtacggtggttgtactcagtcttgctcaatttttcccaaacccagaagaggagctcctggatgatgaaggctttggtgtttagctcgtgcctgccgtcaagcgcctgtggtcgtcgccctagtcttccgctgtttttcgttgtcttcgtgtgtgctgggccctcgttgcccatgtaataattaactatttacgcttccgcttgattaaactctgaattgtatcaacttttggtgtaccttgcctcctaggacaaggaataatacacgcacatatggaacacccgttgggttatttccggtcgtgacatgtgtcatatctaccaaaaatctcttatattatgggtctgtccagattcattgtactagtatgtgtcacatttatattatgggccggagagagtagatatatatggacggttggtttaaagtttatataaatttaaaatttgaaatatttatgatcgtacggacagttgatttaaattttatatggatttaaaattttagatatttaaagtttattgagatatttaaattttgaaatcttttactaccttactatcatgtctatctatatatacgtgagattcttaactggacccaccattcccttccattcctcttcaccacatagctgaatcttttggcgcatcatagtgtccggctcgagtggaacaaaaaaaaacagtaactgagctgaagaatattaatccatgggaaactgaggtgatgttgcaacaaaattcattgaacaaaacaatgcttttggcttgtacatgtcaccttttttttctacaaaatttgatttatagtctaccagctcagttgcaaaattaagtccatattgatctagctacaaatgttcgggtggttgcatttcctgatttacatttcctgatttattttattttgcattgatgcaatgctttcctagctctgacactgcttctcctttccttgggcggttgaaaggcagaacaacaattagagcaccaatcaccaaatctttattcaacttttattctgaaagttttcagatgattttgcaaaacaaagctaagttcctcaaatgattcactcaatctctctaagtatatcaatataaattcctcaccattttttgccctttttattcctattctaaggtttgatatgtggagtttggtagagataaaacatggcttacttgcattcatatttattactaaatcaaaaacccagactaaagcagataactaaacatactcaagatcaagatcgtgcaaagtgtgtgtgatatatggtggacatgatatataaagaaaatgcttctcctttatgcttattttcttctcccaaaaatcgtttttttattgattaggagagagcatgcaagtacatattagtattatcactttttttccattgtgtgtgtgtttcgaacaatagttataatttcagttcatattaattgtggtcagttccagtacatattagtattaaattcgcatcccaatcaatttctattacaatttagttgtcatgctaatagtgcctattatctcagttatttatttagcactccagcagccacatggatattgtgagcaatatttatagcacattaactcttgcgttccgtaggagaagctgttgtgcctaatggaggaaagaaagaaaaatatagtgtcattacactttactctttgaacgtatctggttgagaacttctatttttaaatgactatagttaattatgttatttgctttattccgcacccatgccacttcgggttacactcagaagcccaaggctgtaaccaagaaagaaaagtaattcactgcatccctctgttggtatagtgggtgctttatatatagtttttttttaaaaaaacggtccatttttacagctatagtgctactgaatacttataacaatttatatatgtttgttttgcaggcagcatggtcactattctactgtaaatatgatccagcataagtgcagtttgtatgtacatactagctaccaaagaaaacccaggcttcctatttcagcttgtttagttcggttagcactggggtcaatgaacatggaaatgtcatgcaatgtctctgcgtatacgcagtccagacagcactgtgtgtgcttacctctgacgataattttcatgtatgcctgctttcttagattttgtttctaaatacttatttgacttttctaattttcacctgttcttttaacctaactgttcttctagtttgttcaaagcacgccttattccttgctttccaaatcgaccacgtcacagcaactacccccactaacaggacggagttgttttgtatctttgtcacagtgttgtccatataccaaaagtatgttgaatatttctcacaggtttcaaatcgaaagcacaagccaccacatttcaagtaaagtcatggggcagtaaaaaaacagatgttgtattgtctcttttttatcacagaactggaaagtttcagtcccttttttctatcctcttttcttaaaattatctttagttaacacgttgtttctcagtagtaaccacacaaagatcctaattttaagaggtactttgatattccgaattttttttatgcatccccccaccgtgccgggaaagggatcctctgacttaaccgccatgtagttaagtcactgacatgtgggccatagcaaagtaggacccacatgtcagtgactcaactgcatgtgcagttaagtcagaggatctgctccccccccctccccaaccattgaggctgtctcttgcattttcattgcagtgtagaaagttttgacactaaaaactcctttttttttgtcggaccccaaattagttcatccctatccttactcagttttagtttgtcacaatatattttgatgctattccattccaaaagcttgttatttgtcagatttcttctaaaaatcatgttcccctcatcccttttattttacctaggccagagtcatgaaccgtgtgtgtatttctgtataagtgagggaattgttgtgccagaggtccccccatccagttgtcttcccaaaacaggatgttggccccatttcctgctttttttttttccaagcaatggataaagaaagtgtctttgatctccatgagcccttgccagaaatgtgatgcccctgttttagttttctgggctgttaggatttttcttgataaatatttgtctctaagtaattgttgccacagaccctcggttttttcaagattccaaagccacttgcctaatggggctttattcatagcctccagatctatgatacccaacccaccttattccttaggcgtgtgtttggttctgggactaggtgggatgggatgaaaccatccctgatttgaggattgggatgattccattcggatgtttggtttgtagaataggacgatcccagttttttgtttggttcaaggaacgagggagggatgggatgagcgccatttgcaaccaccgacaacgccgtttgcaacaaccatggccgacgccgcctctgccctcacctccggacgtggtcgccgccgacctccttgatggcgtcgatgagcggctgcggggggctcggcgacggcggcggtagacggctcgggcgacagcggcggcggcgggctcgggcgacgtcggcggc

SEQ ID NO: 43667 - DNA, 14612 bp, Oryza sativa
gccgccgccgccctccccaccaatggatccgccaccaccgagccccccgccgccgctgtcgtcgagcccgccgccgccgccgtcgtagagcctaccgccgccgccaccgtcgcccgagccatctaccgcgccgtcgccgagccccccaccgccgccgttgccgagcccaccgccgccgtcgccgagcccgccgccgtctcccgaggaagagcgcacgagcaaagcggcggtttcacgccgtcgctcgtcccaggtaggacgagttcgtccgccagttttggccggaccgattggtcccggatctgagaggaatattcctctgtagggccaacctatcccactacccctgaaccaaacacccctaaaaatgggttcatcccatcccatcccatcccatcccagcaaccaaacactacctaggagagcaaaccacacaccattgaaccaagtggacaagtgttactttctaaatcctgatttcttgccaaagaaaccttctcctcacaaagtcaattttctttctaatccctttgggtattctataaaaagattacatgtacaggggtactacttaggcatgagtttattaaggtttttacaaaaggccattatttgaccttgtcaatgcaaccatcatggttatgaatcctttttaacaaccatgtttaaagcaatcaaaccacattattgacaggaaatgaatcaaccttattgctacatttagaatgagaattgatgtattacactaaatggaccttgagatcaatgagaaatgacaactatttcactattcactatctacatttctaacacgtcattagcacgcagctctaaccagctgagcaagaaaggtgaagaactcacaggtaactctaaggataagatggctcgacgttttctcattcctcttgacgtcggatcttctcttccttgcaaccttcgtgctcgctatctacgtcgcctcatgcagcagctcgacaagcttctccgggctcctttgcgccgtcctcgaagttgcaggggctgtggtgctagctttgctggccatggcccacggtatccttcctctggctttgccagatgtggaggatgacgccgcaacggcggcgtcgctgcccgcacaaccaccagagctggtagcattgtctccagcaccctcacgacagtgatgctcgacacctgcaatgcactagaatgcattctggtggagtcgccgcgccacttcaagtcccatggatggacggcaagggtgcggttgtagcccgattggccgccgcaagaggtgccagatgtggtgacgttgtactgtccttagcacggatggacgagctacactcgttgcgccatatcaccatcaccttcgccggagcactcaccggcgacgccgctgtatggtccaccaccggctgaaccgccgcggagcgccgcccttctacatggcagcaggtggctctagcaaacgtgcagcccctccaccggcccctccgttccctggcctctcgaccgcaaccgcggcggcaaacgcgcgccccggcctctaccgcatcatcatgcccaggcatgtccctgccgagttgagcggcggcgacaaggccagctgtcccccgcccttgagtgagggggaggcctgagcatggggagggatgaggtccaggaggtcagggcagaccggcggcggcgtcggtggcaacccaacacggcggcggctgcgggcggtgacaatgaccagacgacagaccgtagtgtgctgccggcgataccatgctacaggctacaggctacggctgctcgctagggttggtctctatctccctctccctctccgagacaccgtgcctgccgccggcgacttgacgagtccgaccactggcgtcagttgcgccgcctgagcgggctgaggcccagctaggtagttaacagcccatccgcccttcgctgctcactaggaccgtgtaattaggctaaggccacatttagcataactttacatatccacgataaatttaaagtttatatggatttaaaattttaaatatttaaagtttatatggatttaaaattctaaatttaactaaaatggaaataaaataatttatattagtattgttaacgtaacagtaggtctatatccataaatttgtgggagctaggaatatccaacttcaaatatttatgtatctagagctttgtcgaagaggatttaaggtgtgtttgaatcactcgtttttgatccatacgttttctaagttagtaaatgtgcaatttttttttgaaaaatatagaaaaattatcttttaaaaaaataatattaacctattttttaaatttacaataattaatacttcaattaatcatactcaaggtacaaaagtgaactttttgcactgtgtaattaggctaactttataattggatccgttcattccaatctggcccggccttgaggcccatgaagcccacgaacgtattcattgtcatcgcctcattggcaagctatccatctcccaaagcgagatgcccatgccggagtaccaaaattccccagtagcagccgccgccgccgccgccgccgattcaccaacccttctcctccatcggcatgtcgcgggggggaggccggctgcccccgcgcttctctctacccagctgtacctgtacctgtacgccccccacaatcccagtcgcctcgcttccttcacattttctgggtgccaagctgctacgattagtttttgctgtgctctgtttttttttttctctctcaatgattcaatgtatgcgggaatacatcagtcatggttgaatttatggtgaaattaatggggttttgaactatttggttcgtctaatcgtccgtaggaccaagtaatttggtagaacaaatggaatctttttagagcatccccaagaacgcccgatcctgcacattactgtagagacgcgtctaattaagtggccaacttacttacggagtacatctcgatctcgatgaaagaggttgccaagttattctgtgaatattaattttgtgtattttctgttcttttcctttccaatagaaaaaaggaggtgtttttttatagatgtgaaatatgctggtaagaacatatgtacactctttcagtataagaacatataagaagtagccaaggattatttgattccaaatttccaattgcaggatcatgtggttgtagaggagataatattacttcatgatcaaacatatttaaagtcatctatttcagtaagaaaatgtttgactcaaacagattcagaggctcagagctcattgtatcataatctttcatacgtatgtaaacattatttgttgcaggcaggcatgagtgccctgaataacatgactcatatcatgctttaagcctttaacacgaagccctatatcgaagaagtatcagtctaaagaatgctattgcttcaaattacaatctgttgtttattaacaggaatgcttctatcatgcgagtgaactgatataggacgaagggtcaggaggcgttgggatttgtactgctccatcaagcatctgcatcaccttatgcattgttggccgcatcgatggctcctcctggaggcaccacagtgccacagcaacgaagcgctccaccttttttatgttgaagattgcctcgtcatcgctcgccaccagcaagtcaatcctcccacacctgtagcaatcatttgcccaataagttagtattgtctgctcctcatctgcaacttctaattccacattcttcctgcagcacacaagctcaagcaggatcactccaaagctataaacgtcgaccttagaagtaatccctatgttcttgaaccactcaggtgcaacatatcctcgagtaccccgaatgccggtgtttgtttgtgtctgattcaccggaagaagctttgctagaccaaaatctgaaatctttgctacaaaattatcatcgagaaggatattctgtggtttcatatcgcagtggatgatttgtttattacactcctcatgtaggtagaacagtcctcgtgaaaccccaagtgctacttgaacacggaggctccaatgcggatgactatcgttgaagaggaatgtattgagtgagccattgctcatgaactcatacactagcagcttttcagttccctcattgcaaaaaccaagcagtctaactaagttcctgtgaaacgtctgcccaatggtttggacttccaccaagaactccttttgtgcttcctgctgaagcttttcgattttcttgactgcgatgttagttccacactcatcttgcagctgtcctttgtagacaatacctgaggctcctgtaccaagtacctcatggaaaccaccggttgccttttccagctctctgtaagtgaaaatctttgaaggtaatccagaattactgggtagttgcgataactgggttttcttcctcgaggtgatactacaataagtaccaaaaagcagaacaaagattaggagaaagttcaccaatacagagcttccaaaaaacaatgagctcccaagaatccaatactttttgtccttcttccatttgctggagccgctgctgatcatggatggtgaattggtgctcctaggcaccttaagaagaactgtcgcctgtaaactggaatccatattcccatttgataaagggagcttctttttataacaagtgtttgagggtttattgaacacggcaacggagcagaagcaatcaatgacgcacagccttcggcattcggtctcatctatcgggctgtactgctcatagtcagatagaggccaattaatgcgatcaattggtgtcatctcatactgcaccattgctgctgtctcatctagatcacagctttgtggctcaaaatctggcctgcaacctttgtatgtcctctcattgtcgaagaacttgtacctctgtgggcatagacaatttgttgtgttcttggtgccatcaaaggtacagtaactgttgaagccgcatgcaccactgcctacctttgtttgaattgtctggcagatgttctccggaagtgcatccaccgctctccattgctcttgccataagctcctggcctgtttgctctttgggtaaatatattgccggaacacaccatctgtatcaagggttgcacggtggaagaaatcacccatagagtccactcctgcagaagtgatgtttatctgtgaaccattagtcagcgtgaagtatatccttccagtttcattgaacaccagctgtgagccattccccactgtgttactggcccagtatggatcatggtagtatgcagaaggtacagcaactagatacagcacaagattaccgtcatcttgaacatttagttgaaaccggccattggaatagtctgtggcgaggagacggctgtggagtgctgtccctagtgggagcacttgtgtgggtaggatggtatcagaagggtcaccaaaggactcccactttgttgcgccatcagtgcctaaaagcctgaaattaccggtgtcgagcattctagcatagcccacatcagtgactcgtggattccatacctcgttgccagatggatcgcgaagagagagtgctccatcagcgagcttgaggatagagccagcttggacttgtatcggtattgtatcatcttgcctattggagctagtcttggcataccagatgacggtcttgtcagcgatcttgttgaaccagacagcgagcaggtatgaggaggagtttccatctaccgccagaaaaccgaatgcaaaatcagcagtgggcgagatccatgagttgtttatcccctggggtgtcaaagaggagcctatgctgatgtttagctgagcttgggcagatttggtgcagtatagtagcaagagttgcaggatgggcaagaacaggagaggtgccattgctattgatcaaccttttgctcgtactagatgacaacaaaacttatagcccttggagagcggcatttgttagtcttgatcacttccatacttgactaaccaaaagtttctctgcgaggcaaccggttgaacctgtcaaatgcaattacaaagctgtcaatatgatagacataagagggagattggttcacatttccttatcaaaactatagaaaatgtcggctttgaatgcattgaccacctgtatggagagagaaagaaagacgtgttcagaagtctttagagaaagaaatacgtgttcagaagtctttctatgtgtttctttcctcctgaggttggtctttccaaccgcgtttcagaagaacagttttggccagcttgtatggttatggtcaagccaggtgtaatcttttcatggtaatataggagtacactgtaacattaattgatcaggttttttgacgcagtcagaacctgctttgctgatcgtaaggccattcctactgtgagattcattttgaggtttccaaaagtcacctaatctagataagctcggataggattaaacatatagacctccaaattacagtttcacatagatgattttgtttccttccttctattcataaattttttgacaatgtcccatgtggcatttaatttaatcagaataaaacctcttatgaaacctgcactaaaaatggcctaatatatgttttagccatttctaccacgcaaagtcagtgctccattcaaggggagctaggacacattgactaatgatgtctgtctgtatttaatttaatcagaatgaaactcttatgaaaccatggtagcaacatatattttgaacatttaactggtcaattggaatcagtacttcctgagtcctttccaagcttgcgttgcagaagtcttcaagtcccccaggtccacgttaggtcaagacggtttagtccctagccattctagtcttaaaacaatttagtccctcgtcagttcgaaaaaccctatttgccaccctgcgaaagaaatctaagtcaccacaccttgttctccatcctcgcagccacccaagcacactgtatgtttgtgacaggcttgaagaagacggcagcatggctatcttcttcgtttttctcctccaccccttccctctcaatgacttagggatccttggatccgaagtctctggcgccagccacagttccaatgcagtgtcgaggaggacggttgtgactttgacattggtgcggcaaggtatcatcaatcatggttttggcattactgacaactccgactttagccatggctctggcatctctggtgtgtttgtgacaaggccatgtcggtcatggctctagcatatccggcgacgataaggcattccggcatggcacggtagagatatcctctccctgtcatttgctgcattgtcatccgagcacgacagtagcaggttgcaaaggcattgcctagcttcttgtgcgatagacaaaggatatgggggcacccagatctcaccaagaacggtatgacttcgccgacaaaagttgcgctggtagctaatggcagtgcaacaagggcgtcatgccttgatctagccttgactgccatcaccttgtagctaatcctcatgacagcattttcatcaatagttaagggcttccacaccaacttgtagagcaatgtcattttagctataatttatggtattatctacaccctcatatcattcattcttcatggatcatacggattgcggaaatgtgtattggcttgactgcaacacaataattgtatggtagcatgtctagagaagattgcagactgtcacaccctgaagttttctctttttctagccttaattcaattaataaattgcctcaagaaataattcaatttaacctcgagctaaacccaaattaataaatgcaattaataattggaaatagcatggtgggatttttcttgagttccccatgtttaaatacattaagaggattattagtggaattttctgagcaaagaaaataattttaataattaaaatcaattattgaaattaaattaaaagttaacctccttttatctctcttttcggctgtgggccattttcagcccactcctccgcgcacacgctctctcctttgggtcggcccgtagccacagcccagctacagccgccgcgccccatctctccctaggtgtaaacatccctccttccaaaaccgcgtagctagcctatcccacttatacataccactccacttacacttttcattctcacatcgtgtaaaagggttatctcgagagtgatatggttgaagggacaagcccttataagttagttccactcttgctaaactagcaaggtggtactaaacatacgtatacaatgctcatgggccacacatgcctcatcctaattgggccaggatgttacatacacccccccaaggacctgatgccccgttgacacaacttacccagatagccacacatgcacattgggaaatgtccaggaacacactccccccttagcacacgtccagtgtccacatgctccatgcgccatatgcttgcacactgacccgtacatgcaacggcgagggtcagctctgataccatttagaacaaccctccctccaaaaccgtgtagcccagcccaactgacgggcaggcccacttacacatactatccaacttaaactttcatccccgtttcgtgtaaaagggttaacccaggagtgatatggttggaaggacaagcccttataagttggttccactcttgctaaactagcaaggtggtactaaacgagcgcacacaacactcataggtcacaaaggtctcatcctaattgggccaggatatcacactgggtcgccgtcaggtaggaccactgttgggcccatcttcaaccttcgcaggcaaagccagagggcgtaaccgccgccccgtgcgccccgtccacctcgcggcgcccactttgcacatgtcgccctcttccacgcccccgcaccccactctccccacgcttcgtgcttgtggagggcgtggtattcgattttcgaatcccggccacatctctctctctcctctcccacatccgctacaaaatccaccccctaccggccaagtctgagctcccaccgctatataaacgatcctcgtgatcccctcctccctttccctcttctgccgctcgttcccgtctttctcgaagtggttgtagaggttcaagtagcgcggagcaaggcaagccatgcatccctcattgaacatattatacctatattgcaaatgtctcgctttcttattttataatgtcagaattatccgttataacataagggtatatggttttattttaaattttaaattgaaaaggttaaaaaaaataataagaaactaaccactccagcttgtgtggcaacttgagagaagaggattgagattttagacatcaattctagaaattgatggtcagattaacatgggaatttgatttttagtcccaatcttttgtttgttagaggtggtaaaatttcattgagaatttagttagagactagataaatcttaaatgaaaatagatggttaagttttgtttaggtaaattaaaagaggaatttcctccgaattaccacccatgcccacgtatattttgaaacagtaaatttttaatggcatgattataattaaccctattaaaaatgtcactcaattccctatccccgtcttacgaaaaactctcgtctcccctaatcaaactgaacattttatagccacatcccacaactccccctaacctaaggaccgttcgtgcgcgttcggctattttctgcccttcctcgtatccatctgcgacattacccaccgcgcacggcggcgacacggcagtggccggccggggtactgggcttcagcggctacagcctatgggagtttctgggcgctggccgcggccgccggaccggtggtctcctgacgcgcttccacaaggtccgggtgccatatgattgttgcaattgatgttttcacccattttttttttctcaaaatattaattgcgcgtcaggtagggtagaattcgctatgtgggaatcgatttaatgccgaataaattactcttgtacaagtagaatcgcatttggttaatttggtgcgtcgtctcatctactgaggggatttagagggtcagcctaacgggattgtggaggatttgatttttctttttgttgttggcatacgatgaatcgaggtgctagttttatgttcgtggatttgtttgagtgtgtcctcttaagagagcctaacaatgcctattaactgaagatagacttttgcttttatgcagaatttatctagctaagtcaatattggtagtgaagtttattttcccttttttccctcctggaaaatgcaagtgtagttttgaagatgtggattgtggaatatgctggttgctagaacagttttttgccacattttggttgtcaataagagaagtttgtcccttgtgatgagaacaaacatatagcccttagagaatgaaatttgtagctctaaaaaaaaaagaacgaaatttgtcagtcttgatcaccttggaaatttccatactagactgaataaatccctactgttcttcgtgatactttgagtctacagatatatggcacagtgcagtttcctggtagatgtcacatgaagtaaaaacgttgaataccataagtccagaacttgtgaggctgaggctgtacttctcaaatgcaattactacctgtcacgccctaaaaatcgcctaaattaaaaatgcatattttaaattatttttagaaattattttaaaagcctacaagctaaaccctaattttctaggaaaattttcaacataaaaatgagctagataaaattttattaaatactatgcttgctcttctattttctagaattttctgggaattatttgagcaagggaagtatttttaataattgaaacaatatttcacaaattgtttttattgaaaaagttcaaaaaacccctccctaagccgttgggccaaattcggcccaacatctctcctctcccgcgcggccgagccggcccaatcggcccagccgacgccgcccgctcctctctcctgtggagaccgacaggtggaccccacctgtcgggagctccttcaacctccagccgccggccggcctagccgagctgcccgagccgcctcctttctcctctcaaatccgctccaatccggccccgattcctccgggtttttgaggggattttatcctctcgttctcctctatctttacccccaagaatcggagcaatccgttgagtattctctccgaatcgagttcgtttcgagtttatccctaaaaaccgagtttggatttttcccgagtcgattcctctcgtttggagttcgatctcttcaatccaagcttatataaagcatcccctcgtcgccctctttcgtttgccccctttcccgagctctctcgtgcctcgtagtgccgtcgccgcgttgtttttgttcgccgccgccgccggccgtcttcagtcgcgccgccgcgccgctcccgttgtcgccgccgcttgccgccgccgccgttaggtgcactgtggtgaggagaacctcggtcgcccgtccttcttcgccgccgaccaccggagtccgccgtcgtcgtcaagccgagccgccgccgccgtcctcttcgtcgccggccgtcatcgttcgtcggtagacgttgtggtgagtaccgttgggttcgcctcgtcgtcctctacgcgtaggtgtcctccgatcgctcggcccaggtccctagctccggcgagcttgcaaccctaatcggccggccgtgggtgacgtcatgctgacgtcatcatcttttctttttcccgattttctaatagattaaaacttcggaaaatcataactaaataaccgtagatccgttttaggtggttcaagttgctaaatttttttaaaatcaagatctacatgttaaaaatatccacatgtactgtttatgcttgtttttgtactgttttgttgattttgtttaattgctttagtttccgacgttccggaggagagcgtttcctttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccggttatttattggccgaagatgactttattttcctatgggttataatttgattagcatgaaccttatatattggattggttcagctaaatgctatatgtaagtttgcttagccatgcctagaaacatagctaattaaagggattaattataaactatgttattattattaatgatggttattaaatggtagctcacgatggctgatcgtgtgatgttaattaattgataattaaaacctggttaaggtgggttgtgagcacatggttttgatggttgtgctcatgacaattaaggaccggttcgcgagctactgttgtgaaacatttatcgtgccaaccacaagccagcgtgggcaacggctttatcttttgtatagcgtgattcattatagtgcgtcatactgagaagtggcgagaagtccacgggggtcgctggggagtccatgccttgtttataagggggtgattatgatccaggaaaggtgcgctgtaatgggttatgttgtgcgaggggtattgtcacaactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtctcacactactcaataatgttaataatgtgataattaattggactcctggtttggaatggataattcctggtttggaggtttaatttgttcaactggggttggttgttcaaatatggttgggcctatgcaacatgggtgtgttgtatagtgttatttaatattgattaattattcaactgtttttactattctcttaaatgtttattaaatgctgtttctgcaaatgagctatattatgccatcctttgttatcctgtgcacttgcatatttgctgtgtgacttgttgagtatgtcatatgctcattcttgcaatattcattcatcagaagaggagtatctcagtgaaggtgatgatctggaggattaggcttgttctcggttaagatgcctgtggagtggagtcgccatagctgttccgtagtttgttatcgttttttttcttttccgctgcgtagaatgttattctttgggaggaactatccacctctgtaataatttattttatttgcgaatattaaatagtcttttatttgaactctattattaatttgtcattgtgtgcctcggttgattcctggacgagggtttaacacacatgtaagcgtttggaattttggatagaaattccgggcgtgacactaccttttcaacaaaatcctgtcattcagactattcctcatcagtaattcatttcctcagtactactttagaaaagggcgagctctggatgcattgactaggaagatgaaagagagaagaaaatatatgtttcagaacactgtgtctcagaaaaattgtgtgtcttggaaaaattgttttggccagcttatgatcattttaaaaccagctagaatctgtttgccagaatccatttaatattaatcagatctggcacaatcaggtcctgcattgctgattgaaacattgtgtttcatgttccctgttttccagttagcaatgaacactgttctgcatacctcaaacataattccctctatcactaatgaccccataaaggtacagttaaaacaaatcctgttagtttgttcttctctcacaatttgtatatgcactatgctttttgtttgtttcccaccagaaatagattgtatcagtaacagacttttgttaagaactacacacttctattacataagtacatgcttgatccagtagtttagcttaactgataaagtaaatggccggtcctgcacattactgtagagatgcatctaactgaatggccaacttacttatatctccaaagaagtggtctcgttattttgtgaatattaatttagtacatttttctgttcctttccttttctttctttcgtttttcttttttgtaacggacatgttattttgaagatgtaaaatactatatatgctgataagaacatatatacaacatttcaagaaaccatatagcttttttttattccaattgcagaaaccatatagttgtagaagagatgaaataagttcatggtcaagaatatctaatatcatctctttctatataagaaaatgttttaatccgacaggttcatagtcagtgatacacatagtgacatgcatctatctgcatctttcatagatatgtaagctacttattgtaggtaagcatcagtgcccgaacacaatgccttattgaggaatcagtctaaagcatgctcttgcttcaaactacaatctatttattaacaggaagactgttttcatgcaagtgaactgatat

SEQ ID NO: 43668 - DNA, 4343 bp, Oryza sativa
aagcgctccaccttttttatgttgaagattgcctcgtcatcgcccgctaccagcaagtcaatcctcccacacttgtagcaatcatttgcccaataagttagtattgtctgctcttcatctaggacttctaattccacattcttcctgcagcacacaagctcaagcaaaatcaccccaaagctataaacgtcgaccttagaagtaatccctatgttcttgaaccactcaggtgcaacatatcctcgagtaccccgaatgccggtgtttgtttgtgtctgattcaccggaagaagctttgctaggccaaaatctgaaatctttgctacaaaattatcatcgagaaggatattctgtggtttcatatcgcagtggatgatttgtttattacactcctcatgtaggtagagcagtcctcgtgccaccccaagtgcgacttgaacacggaggctccaatgtggatgggtatcgctgaagaggaatgtattgagtgatccattgctcatgaactcatacactaacagcctttcagttccctcgttgcaaaaaccaagcagtctaactaagttcctgtgaaatgtctgcccaatggtttggacttccaccaagaactccttttgtgcttcctgctgaagcttttcgattttcttgaccgcgatgttagtcccaaactcatcttgcagctgtcctttgtagacaacaccagaggctcctgtgccaagtacttcttggaaaccaccggttgccttttccagctcgctgtaagtgaaaatctttggaggtaatccagagttattggacggttgcgataactgggttttcttcctcgaggtgatactacaataagtaccaaaaagcataacagagattaggagaaagttcaccaatacagagcttccaaaaagtaatgaactcccaagaatccaatactttttggtcctccttccatttgcttgagccgctgctgaacacggatggtgaattggtgctcctaggcaccttaataagaactgtcctcggtacattgacatccattttaccgttcgacaaagggaaccttttcttccaacaagtgcttgaagctttatcgaacacagctacggcacagaaacaatcagtcacacacagccttcggcattcggtctgatctatgggattgtattgctcatagtcagatagaggccaatcaacgcgatcgattggtgccatgtcatactgcaacattgctgtcgtctcatccagatcacagttttgtggctcaaaatctggcctgcagcctttgtatttccttttatcatcgatgaacttataattctgtgggcataaacaacttgtcgtgttcttggtgccatcaatggtgcagtaactgttaaagccgcatgctccactacccaccattgtttgtattgactggcagatgttttctggaagtacatcgactgcagtccattgctctggccataagggcctggcatgtatgttttttgggtaaacatattgccggaacacaccatctgtgtcaagggtagcacgatggaagaaatcacccatagagtccacccctgcagaagtgatatttacctgtgaaccattaattatagtgaagtatatccttccagtttcattgaacactagctgtgagccattgtccactgtgttactagcccaatatggatcgtataagtatccagaaggtacagcatctggatacataacaagattaccatctcgttgaacttttagttgaaatcggccattggaatagtctgtggcgaggagacggctgtggagtgccgtccccagtgaaagcacttgtgtgggtaggatggtatcagaagggtcaccaaaggactcccactttgttgcgccatcggtgcctaaaagcctgaaattcccggtgtcgagcattctagcatagcccacatcagtgacttgtggattccatacctcattgccagatggatcgcgaagagagagtgctccatcagcgagcttgaggacagagccagattggacttgtaccggtattgtatcatctttcccattggagctagtccttgcgtaccagacgacggtcttgtcagcgatcttgttgaaccagacggcgagcaggtaagaggaggagtttccatctaccgccagaaaaccgaatgcaaaatcagcagagggcgagatccatgagttgtttaccccctggggtgtcaaagaggagcctatactgatgtttagctgagcttgggcagatttcgtgcagtatagtagcaagagttgcaggatgggcaagaacaggagatgagccattgctattgatcaaccttttgctcgtactgatgacaacaaaacttatagcccttggagaacggcatttgttagtcttgagacctgtgaggcaacggttgaacctgtcaaaagcaattacaaagctgtcaatatgatagacatgagagggagattagttcacatttcattatcagaactttagaaaatgtcggctttgaatgcattaaccatgctgggttctcctgacatgatccttgctggtctttcctaccgcgtttcagaagaacagttttgaccagcttaggttatggtcaacccaggtttaatcttatcatcataatataggagtacactgtaacattaattgatcaggttttttttgacagagccagaacctgctttgctgatcgtaaggccattcctactgggaggttcattttgaggtttccaaaagtcacctaatctaaataagctcggattaatggatgaaacatatagacctccaatttacagtttcatatagatggtattgttttttgacaatgtccctgtggcatttaatttaatcagaataaaactcttatgcatgaaacctgcactaaaaatggcctaatatatgttttagccatttctaccacgcaacgtcagtgctccattcaaggggagctaggacacattgactaatgatgtccgtctatctaatttaattagaatgaaactcttatgaaaccatggtagcaagtagcaacatatattttgaacattgaactggtcaattggaatcagtacctcctgagtcctttccaagcttgcgttgcagaagtcttcaagtctccctggtccacgttaggtcaagacggcttctagaatacttgcttctttgacagaacagaaggcaaactctatttcagattctgtttacggtaagtacaatgattgtgcaaagtccttttttattggctaagcttacaggtaggtatgaaaacggtcggaaatgatcggaaaacagcctcaaccatttccgtaacctttctcggaaacgaaatcgaaaacggtaaagtcagaaacgaaaacgatatcggaaatatcggaaaaccggaaacagaacaatacggacagaatgtcggtacagatcggaaaccggtattaaatacgaaaacattaaactataaaaacatatatttaactttacataagtatgttatatgtatacataaatttaagcttatacaatataaattataaattaactccattttagccatgcacaaaagttagatatttgattgaagagtcaatcaatctgtaagtagagacatgccctataaatatcgacatatttagaatacggtaattatcatattataagaaacggtaatttccacaagaatacggtaaatacggaaacgattggtataatagcaaaaccatttccgttttcatttccatattttttaccatttccatttttattttggtcgattaccatttccatatggctcaactggtagaaagtcgaaacgaacatcggtcggcggggaattactgttaccgttttcacccctacttacaagtttgcacaacttcaatccccgttaaatggctaaaaaatgggttaatttgatctgtgccattgcaaatatgtctgttcagataaataccattataattcatttatgcgtagccgtgccactcaaattttacgaaattagaaccatgctatcactgtcaggttttccatcttccgaatcggcacatgggactcacccatcagattcttcttcttccttacaccctccattatcttcttccttccccatctcttcgtcgtggcaaggagcgcgggcaggatgggagggggtcggcgacgtgtatggtgtggccctataggagagcaccgactaaggcgacgaggccgtgagcccctacgcttccatgacctagaatgatgggacacgcagcacggtcttcgcctccctcctagcggcggcgaacgagcggatggacacgccgagcgcggcatcagcggtagcgagcgggaggaaggcaaggcgccaacacggaat

SEQ ID NO: 43669 - DNA, 6780 bp, Oryza sativa
tttaagttgttttgtctaatacttaattaacaatgcgctaatccatctcatgcgctaattccctactggcggctcgccttcctcttgctcgctgctgccggtgccatggtcggcgtgcccatccactcgtttgccgccaggaggaaggcgaatggcgtgctgcatgtcccatcgttccagatcatggtcgtgtaggggctgacaggcttgttcccttagtcggcgctgtcctgcagggccacgccatatgcgtcaccaaccccctcccatcatgcccgcgctcctcggcatgacggagagatggggaaggaagaagataaaggaggatctaaggaagaagatgaatctgacgggtgggttacacgtgtagataacaaagaagatagaaaacgtggcggcgatggcatggtttcaatttagtaaatttgagtggcatggttacaaatagatgaattataatggtatttatctgaatagtcatatttgcaatgacacatatcaaattaacccttaaaaagtagggaacatatcctatgcacacaaactttccatgcacaccaactggcaactagcaaacattacgaaaaaaattggacatttactcgaaatagtattacacatatctgcaaagtctcatattcaaattcattatattttagccgtaagaaaaatgtaacatatttaagggtaaaaatctgtcaaaattttatcttttttgtgttacggctgaaatataatgaatttaaagataagatttcgcatgtattggaattatttgttcactttcttctataattttttgtgacatttgctagtaaacttatcagtatagaatacgttccaagaaaaaaatgttggattggatatcggtccatgagacgacgagtgctttgttagtgagtagtgacagccaggatagtcaagagttattgaattgcaatacgggagatttggagttaagccttgaagtttttgttgcatatgccaaatagccctgcaatcaattcaccgcgcgcacgttaagtaattaaacactctaacagctggttggttcttatgtctattagattagtttgtatacccattaggttgtgttattttgtacatgttactaactttcttgtttttcactcgtatgcttcccaactactaaatagtgtgcattttttaaaaaaattctatagaaaattgctttaaaaaatcatgctaattctttttaagttgttttagctaatacttaattaactatatgctaatccatcctatgttgcatatcgggggtatgtgttcccaactcatacttctgagcttacatatgttaagagcttggcatcttctttccagcacaaaggtgaaaccttagccattccaatcttgaaacaatttagtccctcaactggaaaaagcctatttgccaccctgcaaaagaaattcaagccaccacagcttgttctccatcctcacagccacccaagcgcgctctatgtctccaatacacatgaagatggcggcagcggggctatcttcttcattttctcctccacccccttccctctcaatgacttaggggtccttggatctgaagtcttaggcgccagccacaatttcaatccaatgatgaggaggacggttgcgaattaggcattggtacggtaagtagcctcggtcatggttttggcattattgacaactctgactttggccatggctctagcattcccagtgatgatggggcattctgatatggcaccgtagagatatcctctccctgtcatttgctgcatcgtcgtctgagcacggcaacaataggtttcaggggcattgccaagcgtcttgtgcgatagacagaggatatgggggcacccagagctcaccgagagcggtatgacttcgccaactaaagttgcgctcacagcttcatgctggctaatggtggtggcaacgagggcgtcatgccttgatcgccttgactgccatcaccttgcagctaatcctcatgacaacattttcatcaatagttaagggcttccacaccatcttgaatagtagtgtcattttatcttcaatttatggtattatctactcccacatctcattgattcttcagatggaccctacggattatggaaatgtgtcttttggcttgactgcaacacgatcattttatggtagcaggtctatagaaggttgcgatcattttatggtagcaggtctataaaagggttgcagattgcagtatttgtggcattataattgtgctaagactaggaggcatgacagcaatggctcagaacaaaggaaggtaataccggggcacttcgttttagtgttgctcgtcgaataccagtttctcaaattcagagttaaataactatgtttggccttacatggttgtttttttatcatagttcaattgttagtttgatggactatgagcaacactgaattattttcttttttatatgaagcgagggaagctcgtccccacgagaaggccggaaaggctaattagcgcgtacgtgccagatatgtttctggcgcagacgtccacgtgtcaatgtcatcaggaagatgattagcgccgcgctgtgccgtgattagttccgacttttccgtttttgcaattaagacgtatcagaatatattattaccgatgtgatcgtaattagcatcttgattagttcctttttgggaacatattagggtctagttgtttttttgcttttgaaatataatttaatttaagactttatattctaaattaaaaactttcaacactaattttaaaactttcaacccaaatttgaaactttcgagtcaaaatttgaaaaaaaaaatcaactcaaaatttgaaaactttcaactcaaaatttaaaaactttcaattcaaatttgaaaactttcatctcaaattttgaaaactttcaactcaaaattttgaaaactttctattcaaatttgaaaactttcaaatcaaatttgaaaactctcatcccaaattttgaaatctttcatttcaaaattcaaaaacattcaattcaaaattcaaaaactttcaactcaaatttaaaattttcaattattttaaaacttttaactaaatatttatgttttttaatatttaatcctaattaccgtaattagcactaattactataaataagactgattaggcaattagcggtaacaacatgggtggatgggcctgaactggaatgttccgcgtgctgcttctgtagccagcgcacacgcgccgagtaggaacccccgaaaaggctggggcatgacctaatatggctttcaatattaacatggcttctgatattaggtcattagtagtaaaaatgttctaaaataatatggtaaattagtagtaaaacttttctttaatagtgcaacttattagtagtaaaaatgttctaaaataatttggtaatttagtagtaaaaattttctttaatagtgcaacttattagtagtaaaaatgttctaaaataatttggtaaattaacacaacacacttgatttactgaattactatataaccacaatttcatttatattactaattttttatgtgatttgttttgccaaaacgtattcccaaccgtaatttcttattttctaaacttttctctgatataattttgaaaacaaataatctaaactgttattttaaaatcaaaacccaatgctagaagaggggcatccaaacaaaacgatgttcctatgcaaagagagctaccttgtgtgcctcacaaacatttacatgccatgccatttcggatgatgcggtaaaaaaagctttatttttctataccatcttaaaagcggagtggttttacttccatgtcctcctcccaccatatgcagtgcatccgtacatataatatacgtaaccaccagatccaacattttattttcaatcatcatcctagctcatccatgcttatatgggacttttccgttttatccgttataacgtaacgacatacgactttattttaaattttaaattgaagaggttaaaaaatagtactccatctttcccaaaatatgggacggaggttataagaaactaaccacacatcggttgtcttcttcatgcgcctgcggtttggctattttctgcttttcctcgtatccatctgggagtctgggaccctacccaccacgcacggccgcggcgcgccagtggccgtccagggtactgggtttcagcggctacagcctatggggaggttctgggtgccggccgcggccgccggaccggtggtctcccgcggcacccgacgcgcttccacaaggtctgggttcagcatgattgttgcagttgatgtttcacccatttgtttttaattttctcaaaaaattgattgcctgcgggaatgcgtcaggtagggtagaatttgcagtgaaatatgtgggtatcgatttagtgccgaataaattactcttgtacaactagaatcttgcatttggttaatttggtgcgtacgtctcatctacttaggggatttagagggtcagtctattgggattgtggggatttatttatttttttggctggcttgggatgaatcgaggtgtgaattatgttgtgaatcttggtggatttgtttgagagtgtcctcttaagagagcccaacaatgccccttaggctgaaaaaggcttttctttgttttgtgcagagcgcatctattcaagttaatgttggtagcgtagtttattttcttttcttcgaaaaggcagtgtagctttgaagatgtaaaatagtggtaagaacatatgtataatgctactaagattatgtgacgcccattgccacaaccatgtactgctagagcgtagaagggtgatattaggtggtagcaaaagattttgctcttttcgattgtccagaataggaggatgtttgactcaaacaggtttacttcatgatagttgatgacatgtaacatgttacaagtattgcaaataaaagttcttttgcaagtaaaagtactgaacctctttccaattaagagtaccaagcgagttctgatttagtttacaaactgtaacaaatgtcattgtcgttcctcaggtttggatttaaaatttagatacgcgttccagtacaaaaaaaacacagatctttatcccttaacatggaagaagtctttgactggtcatactagataaaataacgatgctgcaaaatttacttcatgatagttgatgacatccaatagaagtgtagaagcatcatgatatgcatgtaaaagtattatgcttaaaattagagccattttacggtccttcaggaggtaacaggaggtaccacattttgtagtataaaatttggtacatcttggtacctctggtactaggaggaattttcaccacaaattttggaatttcttgtacctcctaaggattgtataatttctcctaaaattaacatgaagaaattatggcgagaactggcgaaccgatgtttgcactggtaacccaagcatataatttattatataatgcttgggtttaaattctatgacatgttcagggctaaatatgcgcctgagaacaaagttaattgttgttaattatataactttccacaccataaatgttgatgttagtttatacatgcattaattattcaatatctaggcagtacattatggaaacgagttgaccacagaagatgaatctggaggagttgggattgcatccgctccatcaagcatttgagttaccttcaggatgctgggtcgcatagttggctcctcctggagacaccacaatgccactgctacaaacctttcaaccttcttgatgtttaacttcgcctcatcatcaccatctaccagcaggtcgaccctgccacacctataacagtcatttgcccagtaagtaagaatactttgctcttcttctgcagcctccatttccacattttgccggcaacagatgagttccagaagaatgaccccaaagctgtacacatccaccttggcagtgatcccgacgttcttgaaccactcaggggcaacatatccgcgggaccacggatacccgtatatgtctgtgtttggttggttcggagtagtttcgctaagccaaagtctgaaatctttgctatgaaattatcatcaagaaggatattttggggctttatgtcacagtggatgatctgtgtgctgcattcctcatgtaagtatagcagcccccttgcgacaccgagagcaagttgaactcgaagactccacagaggcctgacaccactaaacaggaatctgttgagcgatccattaaccatgaattcatacaccaacagtctctcagttccttcattgcagaatcctagcatccggaccaggttcttatggtacgtccgtccaatggtttggacctccacagcaaactccttttcagtctcatgctgaatcttatcaattttcttgacagcaatgtaagttcctaactcatcttgcagctggcctttgtacacaataccagatgcacctgtgcccaacacctccttgaatccgtccgttgccttctcaagctctgcataactgaaagctttgaggggtaatcctgggtctcgtgatggttgcaatggctggacatcctttctggtgattgtacagtaagtaccgaaaagaagaacagaactcaaggcaaattcgctatcacagagcctccgagaagcaacgaacttcctagatccagagcttcttgtcactcttccattttctagactttctgagctctggctgcgaactgttgct

SEQ ID NO: 43670 - DNA, 1601 bp, Oryza sativa
ttcacttgttcttggggtgttcttgggtttagcaccgggggtttcttgggttttggaggatgatttttggcgtggttgtggtttcttgggatggatggatggttttttcagggtggcgagattggtttcggttcttgctgttctttggtttcaaggatttcagtttcagggtggcctcggtttgtggtagagatgattggtctctttcacgcgcttctgttgttcggagggatcttggtttctgcatgttcttggatttgatggatacccgtttgtttgttcttgcatgtgtgttagtagttcgtggagtcgagtcagagttcagaaaaatgcagattttttttgtgtgtgcgcgtgtgttcgaagttcttgtttggttggtgggctgtgcagcaaaatcggcatgaactagttgtttcttgtgaattccagaatgtcaggtgatattcttggaataaaggttcatttttttatattcggttactgttcttgtcactctctgatctctgattattatattcgacggtaggatatcgtctttcccccacatgcagatgttgactgcttgctttagttttctcgtgtgtgtgttttttttactcggttcatatcgttttatggttatttgcatttgaagattgattcttgtttattggaatctgttacagttcttggttccgtggaaattggaatcataggtctcatacttgaatgttgaaaacatattttattattggtagtcaaatctttattttgtttttcttgggttaccatcatgacaattgcgtgcaggttctggtaactttctttgtgccgatttttttaagaataaaaaaaaactaaaatttcaattatttacaggagaacatcccgatcgaagaagtattccagaatttgaaatgctgccgacaggggctcacttccgaagaggcgcagctgcgcctgcaactttttggtccgaacaagctcgaggagaaggaggttgagttccttcatctcatcttgccattgctatcaaagatttacctttttcttgttggaaagtaatactataattcagttcatttgcgttacgtttccgcttatgctgggtcattgatggttgcaggagagcaaattcctcaagttcttggggttcatgtggaatccgctgtcatgggtcatggaggctgcagctatcatggccattgcattagccaatggtggggtaagtacttaggagtcttagacataatgacaaaatctgttactcctatttagtacttggcttctgtccttttctctgttgatgaatgcagggcaactgtgtaagtggtcccgttccttttaacaatatatgtggtgttatcatcaggggaagccaccagattggcagggctttgttggtatcatcacactgctacttatcaggtcaaatatcagtttcattgaggaaaacaatgctggcaatgctgctgctgcgctcatggcgcgtcttgcgccaaaagccaaggtctttcttcaatctccacttttattatgagatatccactctattgtccatattgaggtggagcacttttgaatattgaaactcatgttgtgttggttgttaggtgctc

SEQ ID NO: 43671 - DNA, 21018 bp, Oryza sativa
attttattcacaaattatttttcgtttccaaaatgtcgtttcgcttattctacaaataggcgaaacaatgtggctgtaaacttcgattgaaagttcccttcgttgtgtgtaatatttgtgataattaggatttataaaattagccctaatggatgggtcattttcctacgattcgacaccacacaagtgcttttccggcattcctaaattctaagcttgattaaggttcattaattgcatcagctgccatgcttgtggtggagattgcaagagagaaattttggtttctcgagtcacctcactcctactactcctatagtatgggttatggcgagatgttgggagttggatatgtgtcatgtcatatgaattgatcacgaacaaaacattgtgcacacgtacgtctggtcacttggtcagaagacgtgtccacatttcaattgtgtcttgatcgcaacaaacaaacaaacggtagtagctagcttagctatatctgagggattgggacgcattactagcgatgcaattaaggggggtagctcacacaacagctcatttttcatccattcattttgtagtgggtgtgttgttgagaggtgggaaggaaaaattatataggtaaaacaagttaatctattagcacatgtttaattgagtattagctattttaaattctaaaaataattaatatggtttctaaagtaattttttttctctttttttcaataaaaaacgtaccatttaacagttcggaaagtgtgcgcatgaaaaatgatatattttttctcgctttgttgtaggaacaaaacaaatacggcttaagctctacgcgcatccgtcttcaggtagcgctagggatgccagtggagtagacaagcagtttttttccctgattattataattctagtttattttttcttctaaaatttttaggatataaaatatttaaatgggtctttgtacgagcaatagtattgcccacttgtatatttttaaataaccgaataaattcttaacttttttcgaagaaaccacagacacttgcatgcctgaagcccaggtcgttttgtaccctttgtgctggaatccacacggcatcagctagatcgaccccagctgcgcggcatgatgaacaacaaacagatcagggaacaacacacagaaaagctaaattaagcatgcacaaaccgcaggctaatagatcagctgactagctgcatactccatccgtcctaaaataaaccaatctcatatcggatatgacgggcctcatcgtttggcatattcatatgcttataagccaaaatttaaattttcaacgttaaatttggagctgattttggggttttttcattgaagtttatttttcagcctttgcttttagatcgctaagaacacatatataaaaattttattcacaaattaatttttgtttgcaaatattcaaaaaatatgccaaacgttgaggctggatatgttgtagtacaataaatgtttatatctggtacgatcgtacaagatcgatttattttgagacgtagcgagtatatacgatacgaggccaaattctgcatttgagccaaaggcacctagctatacacgcctacaccgggagaccaactcaatggaccgacgcaatgcaagaggcagcagcaactcgacacttcgacagcaacagaaaggtatgggagaaaaagaagttgaataaaaaagaacagttcgagctagaaatggttgtagctagttggagatcgagacagcaaaggtatcaggtaattttatagtaatcctgcctcttggtagagctgtccctcgtactaggaagctacgcatcctttcatccgcatcaaaacttcagattcgtacagggaaattaaagtgttttctcaaggataccatctcgtttatataaacatgttagctaaatagttacatttttaaaaggaaacttaataagatatattaatatgagataaacacctacaagcctttaaaagaaaaagaatatagctgtaaatttacgttaactagtttcggtttaatttgttctttcgctgcaacttgttcatatactactagtatgcatcatcatgcagtaggagtatgcatgatatatatggtccctttctttcttcatttctcatctctactactcactgatcccatctctcgacacgacgtagccctgaagcaaagctccctccctcactggtcgtcactgcctccctctttctaccccctgctttgatcgatcgaccatgcatggcaaagcatcatgcgtgcacactgatgcttcttaccgatcaaattaagttttttttttactcagatcagctcatatcattcatcaaaaaactatatttgattgattcctgtctcatttttttcttctctctttctctgtcgatttgatctcattgcaattgcgtagtagaccacttcaagacatcgacctcttcttatccctcctctcttcctcccgcccgtctctctccaccatttgattcacactatatatatatatatattttgcggcttaatttcccttgtttctttatgcttcttgttcatccaagctaagctgagctgagctgagatgggcgagagatgtagaagtagatagaattaagctagctagagaggtagatatatagctgtggtgaggaagtttccagaaggttctagaagatcgccatgggcaacacgtgctgcgtcgctccggctaccaccgatgaggtgggcgcgccgccgcgagatcatcatcacgcggccaagaagtcgccggcgccgtcggcgacgacgacgacggcgacgaggcagaggcatggccaagaacccaagcccaagcccaagcccagggcgagggcgaagcccaacccgtacgactgggcgccgccgcgggtgctgccggcgaggggcggcgccgccgcgtccgcggtgcgcgtgctggagggcgtggtgccgcaccacccgcggctgcgcgtcacggacaagtaccagctcggccgcgagctggggcgcggcgagttcggggtgacgcacctcgccacggaccgcgcgacgcgggagcggctggcgtgcaagtccatcccgaagcgccgcctccgcaccgccgtggacgtcgccgacgtgcggcgcgaggtggccatcatggcgtcgctcccggaccacccggcgctggtgcgcctccgcgccgcctacgaggacgccgacgcggtgcacctggtgatggagctctgcgacggcggcgagctgttcgaccggatcgtggcgaggggccggtacacggagcgcgccgcggccgccgcggcgcggacggtggcggaggtggtgcgcgcgtgccacgcccacggcgtgatgcaccgcgacctcaagccggagaacttcctctacgccggcaaggccgaggacgcgcagctcaaggccatcgatttcggcctctccgtcttcttccgacctggtcagcttcttcccttcttcttcctctgcaatgcatgcacgcttgaacaaaacttttttttttttgcctctcttccccatttaatttttttagaacatattctcaaaattttttagtggtagtagatattctcaaaaatcccattcaaagaatttttttagagattttcagtacctcaaaaaatcccattgcaagaaattttggagattttcactatatgaaaaattgatctgcaaataaatttggagcttttcacaataatttttcacaatctcaaagattgaaatgtaaataaattgggagctttttcaaaatatcaaagatgaaattgcaaaaaaaagaggatattttttccttcacaatgtcaaaagatctaattgcatgaaaacagagattttccagaaatgctcaaactagttttgcagttgtttttttgggttgcacgtggattctttgagaattataatactataagcacagttgggaatagttaattagtcccctgctacaacttttcaaaagatcccttctgttataaaaggtgaaattttatcccatttcttaaacacgttatcttttcacgggtgccaaatcataaagcacaaaacacccccaaatgatcaatgggtaggtgggagtacatataaaacctcagtagagccttttatgtttttatatatgaaaaacatatctttaagagaaattttatggtacttaaaagaggtgctctctccaatcatttgtacttgacgttggaagaaccaatcgtaattctgttaacgtcaaatataaatgaaccgcgagggagggagaatcaaattttgcagagagagataccgaaaatacgatgcctcataaaaaaccgcaaaatcactcgtattaaaaaagaatcataaacatcaataagaacacattatttctaacaaaatgtgaacccatagttggtcggctaaccaacccaaatttgaccccctcccttagtaaatttggtgtgcagtgaaaatagaacaggtcggcgtttcggtgccctcttgcgcctgaatttcactttcaccggtggaagaaattaagaacagtctgcatttgaaatggcagctgatcgtgacggtgagccgaaaaaccgagccaattctgcccgaaattttcagagaaaaagtctgtggatgctgggtcatcagatgatgctactcctctctgcagacacgcatcacgccgtcccctgtgtttagcttactcggtcagtgagttcgtcaacctaccacaaagctgaatttcttttttaattaacgatagtagaaaagaatataaaagtataacctgaatatttttattttgaaaaaaaatggattggaaaaccatgtgtttatatctagaccgaatatacgcagccacgaaaaacagtgattaaaaaagagaacaaaatcaccaccacacgccgagttttttttttccatagttgcgtccagactgttaagaggtcgtggtcggcagcagattgctgtcaagatcttaattaagataagcaagatcggtgtcaaggatcttacgataatagacgactcgctcttgttgagtcctcaggggagaaaaaaactgtcactcttgttcttaattattgttcctctttgatgttgcatggccgaatagattgagctggacagatcatttcagaatacagtcaactcgtaccgttattgcttggaatgtaagaatggtggtaaaacatatgaatagcaaataagcagagttttaatataaatacatttgcataacaaaggatccgtataataaaagaagtacaagaattggatcagagagacgggggttgttttaaccttactccaaaatattaatgcattgagcagtccaaaggaatttcatgagatttttagatctccaatcctttcctcaaataaatggaaagatttgaattctacaaaactccttgacaagtcctttgttataaacagaggctctccattttgcacattcatgttcaagcaaaaaaaaaagacattttgcacattgacatgatctttcaaacataatattgaccatcactttgcatcataatatatacagtgataaaattccagtgtattttgcttatccatcttgaacgtttaaaatggatttttatttataccttaagtctaaatgcatatctaaagcatcaaaatatggggttaagtatacatttgtggataaatttgtactaaccacagtacaatatttgtgacgagatagagcctagtgagagtgtgactctgagatgggccggcctacatgcaatctgtgcagataggcccagtagatttcatacggcccatgtttcaaatccagccttttcttcaacctcaccaaaaaactagttatacatttgttgtcaaagatgtaattatagcacaattgtgttgtaactatattataatttagtatcatgtaacttgtaagtaactttcaaaaatcaataggcgacatgttatttccatgaaatggaggtaatggaaccgaattcccttacatgcgtgtgcaatgtgattttttcttatctaccttgcatgaattttaaagcaaaatcgaacggtttaaaagtatgtgaaagttacgtacaaattacattatagttacatgtgtgattacacatatttacatttgttaaatttttatgagaaaatttgccgataaatatacagaaaaaaaagagaaaaaaaactgacttggcaagtgaaaggaaacaggggagaggttcagggagatcgtggggagcccgtactacatggcgccggaggtgctccggcgagactacggcccggaggtggacatctggtccgccggcgtcatcctctacatcctcctgtgcggcgtcccgccgttctgggccgagacggagcagggcgtggcgcgcgccatcctccgcggcgccgccgacttcgaccgggagccatggccgcgcatctcccgcgccgccaagtccctcgtccgccagatgctcgacgtggacccgcgccgccgccccacggcgcagcaggtgctcgaccacccctggctccaccacgccgcccgcgcccccaacgtccccctcggcgacgtcgtccgcgcccgcctcaagcagttctccctcatgaaccgcctcaagaagaaggccatgcgggtacgtggcgtgcgtgctctgctcttgatgtcgtctccggcgacggcgagcccgtttctgtgtctgaccgcccagcgatgcacgcaggtgatcgcggaacacctgtcggtagaggaggtggaggtgatcaaggacatgttcgcgctcatggacaccgacaacaacggcagggtcacgctccaggagctcaaggacggcctcaccaaggtcggctccaagctcgccgagcccgagatggagcttctcatggaggccgtaagcttctttacccttcttcaagatagcaatggcggcaatggcgagttcttgattttgcattggcaggcggatgtggatggcaatgggtacctggactacggcgagttcgtggcggtgaccatccacctgcagcgcctctccaacgacaaccacctccgcacggccttcctcttcttcgacaaggacggcagcggctacatcgaccgcgccgagctcgccgacgccctcgccgacgactccggccacgccgacgacgccgtgctcgaccacatccttagagaagtcgacaccgacaaggtaaacacacacgcttcccttccactactccatttgcaacaaaaatgttcttcaattcagctctatctcttttgaagcctagccagatagtttgaactccactcagaattagagtgaaattagttgaagcgctcttacaaaatgaactggagaaatgtaactgggtttagcctcctccacaactccacttcaaactcggctctcggagttaaatttaggcgttagagctctcccaaataaactctgaaactgatcaatctctgaatttgcatgcaggatgggcggatcagctacgaggagttcgtggcgatgatgaaatccgggacggattggaggaaggcgtcgcggcaatactcgagggagcggttcaagacgctcagcaacagcctcatcaaggacggctcgatcaccatggcgcgctagctagctcgacgaattcagtcgattcaggcttgagaattcattgagaatatgaggtcgatgcaatgctcgaattttttttttttgatgcatacttcattcgaatttgaatttgggttttccatttcgtccaatttttcttttgtacaatctactgtagatcgatcggtcgtctatctgaaccttctttgtgtaggatgtgttagtgaacgctgggattgtttcagcattcgttgtacgtgtttgaaattgcgtcgggtgtaattatgtggtaacggtggtaatcaagcaaatttacagcaaattcattgtgatgatctgtactaatatgcatatgaaacatcaggttattcacacaaaatctcttgtcagcttttctcgtcggcggtagggaggacacgctcttttttcatggcgccgccgaaataatctcctcgttggacagtttcactataatatcacgctgcacatagctttttttttttaacgaccacacacaagacagtgcgaagtttcatattcatcgtaggcggatatagagggtggtccggggaaaaacggcgatggacccgtatatattaagaaaaatgaaaatagcgatttttgaaaaggaaaaaaagcgatctaatcctcttcctcccgtcgttcccgagtcccgactcgcggcgcccacaggcccacacgcgatcacgcgacgcgagtcctcctcgcccttcgccgcgatctcatctgatcactccacgtcagacgtgacgcgacgcgatcagcagccagacaaccaatcacagggcagggccacggcgccagcggccagcccacgccggcacgcgcgacccagcggccagcgcccgcgcccggcgcccccacggccacgccgccacgcgcgagtcccgcactctgccgccttggccgctgctgtgctgcgtctggctggcactacattggtgctgacctgctgtgcgtgtgccgccgcgaggagccgtcgtcgagctgatcagccgcccgcgccaacaaggcaacaattttaggttttctatgtgtatacgtttttcaatttttagttttaaaatcttattaaactcttatgcattgtgatatatcatggtaatttttttacaatttggtctattctattatctatacttgcattgtatatattagtatcgttagatttactgtgtttagaaaaaaaaattaggtcggaccacccatatcctaaatgctagatccaccactaatattcttgcattgcacgtagctttgtttttgctcggcgtcctggttcaccatggcggcgagcttccatgccgctctcctcctcctcttcttcctcctctcggccgtggccgggcgagaccaccacctggtggtggagaagtacggtgtcagcatgaaaggcgccgacggcgacgtggtgcaccgtgcacctggccgtgcacaaacacgactactccttcgctggcttcgccaaccgaagcggccattggcacgtcttccccggtaatgaggacgtcctccccgacaacgccaggcgtctcccgttccgcaacacctaccgcgaccttattggcggcctcgagaacatccccggcctgccgctcaggagggcggcctcgctgcgcgccatcggggcactgtcctcctacgacgccggtgccaccggcgaggaggcgatgaggcgtggcgtggcaacactgtcgatggtgctgacccaagccctgcggctaaggccagtcggggagaccgtgtcgagcaggtgggagagcggtgaggcgcgcgtggcggcggagcacctgccgtacatcgagcactggtacaccatgtcgttcgaggtcctctggtggaggcgcaccgggaggtgggacagcccgttcactgagctgctgaggaggcgtgccggcgaggcgctcgccgtggtccgtgtgatcgcgaacaagagcttcgtgcagctgctgcgggctcacagccacggcgcctgatgctaaattactcgggcatcgctagctggcgcgtgagcgtcggcggtgctcgttttttcgagctaagtagttatactaatctattagtatattagataataacagtttaggataatgatggtagtagataagattttattttttctgtgagatttttttaactaacaaattaaaaagaaatctacatgtgaagttacagtttcaaaattttaaacctagatttgaaaactttcaactcgaaatttaaattttttaagtcaaatttgaaaactttcaacctagatttgaaaacttttaactcggatttaaaaactttcaactcggttttaaaaactttcaactcgagatttgaaaactttcaactcaagattgaaaactttcaactcgggattaaaaactttcaactcaaaatttgaaaactttcaattcgagatttgagaatttttaaattaagatttaaaaattttcaagttaagaattaaaaactttaaaaaaaattaaaaacacttgctgctggaagattaaaaagtaatcaggaaaaaacgcaaaaaaaaaaaggaaagcgaaaaaaaatcacggaaaaaaagaaagcgaaaaaaaaggaaaacggcggtggttaccgaagaaaaaattgcgcgcgcgtgccgcgtgggccgggagtgcacgctaccggcgcgcgcgagaattaggattctcgaaattactctggttgctgctttgctttgctttattgatcgtggtgcgtggctgcgttgctgcatacctgctgtttctctgaataaacgtatctctagtgtagtagtgtatccggtgcggagctagaatgaaattgaggagtgtgttacttgtttaatttactttatcatggatcttgtttaaactggtacggatgtttaagtttgtattgagtggatgtacaaaatatactagctataggttaaaaaaaacctggtcactcggcaccccttcgtatgctcaagttccgccctgactgtactagtagtagtgtctcagcgttcggttactgacttcgtgtgtgtttcgtgtttccattccgaacagacgatatcttaattttactgtgttcgagtccctgttgtttttgagatcacgccatgttcccattcaagacatggccgacagagacgaggatacaaaatagacttattttcagccatataagagaggaaaaagtacaccgaaggtccctcaacttgtcatcgagttacaaaatcgtccttgaaccacaaaaccagatacaacgtatctctcaacttacaaaaccagtgcaaactagatctcctggtggtttttaactctgattttatccgatgtggcagctgactcagtgcgggacacacgtggatcccacatgtcaacctcttattccccttacctcatctcgcgaacgagccaccggagcagctaaaacttccccgccgatgcaagcgccacggcgagcacgttgtactgccgggtggtccgccgcgcgcgcagcgacaggaggaggcggaacacatcgagtcgtcgaccacctggtccacgaatcccgcggaggcgaggtgctcgatgacgacagtgtaggtgcaggcattcaggagcgcgccttcgccggaccatggcgcggaaggcctccacggcgacggcatggtcacccgcggcggcgggatctggcgcccgtgccgtcggcggcggcggtggcggcagcatgggggaggctctcctgcttccgcgtcgtcgcctcgtcgcgcggccgcttccaccgccgcctccttgccgtcggactcccgcctcccccaccagcctcctcccacccgtcggctgcgctgccagtgcccagtgagagaaaagaagagcagagaggaagagaggtggagaagggaggggaatgagaggctgacatgcaggacccgtgtgggtcccacgctgagtcagctgctacatcggacaaaccggatcaaaaccgtcgagggatctattttgcattggtttttataagttgagggatacgttgtatctggttttgtggttcgaggacgattttgtaactcgatgacaagttgagagaccttcggtgtactttttcctataagagatgacccaacgagattagggaggcaagatatactttatttaaggaggagcacggtgggttttcgtgtcttcgggtcggtccggcacgacccgagtcttattggatcgtgcttgggctgatggtgcagcaagtaggtgggcatggcccggcccaccgtgtaggtcgggtcgtgccaacccgactgatttcagcccgggtccgatcgtgctctggccgtgccggtgaagcaccgaagactatcaacgagagcctggtgggccgtcacggagcggcttgaggcttcccaggccatgccctgtggatgggccggaattcacaagtccgggattaggtgggtggcactgatcagagcaagctccggcgacggcgagacgcccgccgccggcaagctacctcctgttcaccgatcacctccggcgcgcgtgatctcattcctcgatggccctgacttgattaatactccatccgtttctaaatatttaatttttttaaatatgtttgactgttcatcttattaaaaaaagtaattattaattcttttcttatcatttgattcattattaaatataattatatgtatacatatagctttacatatttcatgaaagtttttgaatcaaacatatgctaaaaagacaacggtattaaatatttagaaacggagggagtaattggcacactgaattaagaatatcgtcaggaacataaattctgtgcgctagaggctttgctgaggtacacagcgctgcattactttttttcgccgggtcctactctgtttttgaccgttcaattgtattctcgatttgttaaggctcagcatcttttgctcagcttataagacgctgctaaaatttaacttttataaaatatgattttgattttttttgtcatcaaagttaattttttaccattagtttttaaatcgtaatgtacacacacatattatatataagttttgtccgattcataagttatgaataatcaacatatgttcgccatttatctctattgtgttcatttgttattatgacgggaagatcttgaactaaatagcctggaatatacgtatatgatgaaatggactttttataactaaaacaatattattataagcacactaaaactcactgtactctgcatgtatataagtagaaaaaaaaacaggtgaaacaatttcataaaaataattctcataatttcttaataatgtcacattatccagctagccacatgcacgcagagatggaatccagcggtggttcctttcatggcacaacgtgacaaatacatgaaagaaagaagcaaggagaatcatctttgatctctacgtgtccattactctccgtaaaggtgacaacgatgatacgagaattatcacgaggcccactgctgcacaaacacatggcgattggcgccttattcggggaatgggaatggttaataattaagggcaaatagttaatacagtcctgaagtggatccggatcgtctgccgtaatgcagaagagcactgttcatgtgaggggaacagcagctaatgccatgaacagtgtctattttactgtagctacaggattcaaaacactgtagtacactatttggtactgttccgaatttactgtagcacacaatctggtcctttcactcttgatccgacggtccacagttattctaatgcgtggtactgttcatcctctgcattagtacctctaatgcagaggatccgaattatcctgaagtatcgcttcgagtttattttagtccttgaggttttaaattgtccaaacaagtcatctaaattaatcatttagattaatatagtccttgaaaaaaaaagtgtcacgtgagtataccaagtcatcttcgcatgcagtgctatgaatgaaatgaccattatacccttatataccatatagaaaagaaagaaaagaagaagataaatggttcacgcatgtatgattgttttagaattgtcacttacgattgctgcagccaagcactgatcacgtaaatttctttgtcagccacccattcgcaacaatgctgacatgggctggcctgtttttttatttgtcttttcttttttttctatatggtatataagggtagaatggtaatttcattcataccgctgtatgcgaggatgacttggcatgctcacgtggtattttttgtgggttcaagtattatattaacccaaatgattaatttggaggacttgtttagacgatttgaaacattaagaactaaattgagccaaagcgaaattttagggacgtattggctattcatccaataattaacgtgcagtgcttatcgctaattgattttgcttcatttattcgcatttgtcctaatcctgcatatataaaaccaacccaagttttagcgagatgtagttggccagttgcaatatctcaaaagagtagctgacactcttttcgggattagttaattaactgattattagtaacaactgacgacgaatctgaactgagattactacagtagttgtttttttcttttccttttgcgaggttgggcaagagggcgtagataaattgctgtattggcgcgagcacatgcatgtcgccggctgggatatcgcaggcaggttttaataaaccggttatttatctcgcggttatcaacgaacagtaacattttaaattttcaaaccacgacatatctcacggtaaatgttgtgggctgagatatcccaggcaagttttaaaaaaccggttagttatcacacggttatccatgtacggtaacatttttaatttttaaaccacgatatatctcatggtaattgtacgatttataccgtaactacgtaattatcgtggtggccgttaaattatgagatgacgatcatcttattttaaacggtttgggaatcctgatcgcagctacggaccaagcggcggatgcgcgtcgcgatgagaacgaacacgcggcggcggcacgtcagtttctctggctgcttgctctacctgactccacgctagcagtagtcgtagctttcttggcgttttctgctgtacattgcccagagaaaccaacagtttggctgtcgtcaaagccttgttcttttccgacgtcgtttgcttgttttatttacaaccgcctgtttctctctgccgactagtagtagctacggtcgccgagaatgctcgagctgttcgagcttgtgtcatgtctgggagctcgtgagattacgagaaagcaaccagctcataagatttattttttaaaaatgatcttttttttagcttgtgagttctacttattctctatacttatagctatatatgtaatcttaaaatagtttaaatgagagtctggattatatcggaagtaaaaaattttagagaaaatttaaatgagaaaaagtttcgaaacatgtcttaagttgtgttctagttaaagtggatttgagctaaactaattcctcgtttatcacgagcacaaactgttaaataagtatgcttcatactaaatataagtttatctaaaatatttaataaatttatttttcaagtttacaatagacaacacttaagtaatcatcttcaaaaatacttaagtaataatgtgctagtaacttatacctttttaattagtacagctaactagctaatgctaaccgttatatataacgcacttagagattgagatggaactgcatgcctaccgatcgccacgggtgcatatatatcgttttgtgtgtgtcatcgctttcgctttggcttctcttacaaaccgatataattttctgcgaggaaaatcgatttaattctcccaataattgagaaagtactctaaccatctgatcgccatcagatcgaggataaagatcagtatatgtcagcacagccaaaattaaacgaggacagtgatgactgatccctgcaattattcttttcttttcaattttcctcttcttcttttatggaatggaaccaaactccagcacactgcgtgatgtgattaattttgccagtttggctttacagacagatggtaaatggtttggtcgctgttagttttagttcattgacgctttaacagtagtactaaacaaaactttgatgtcaacttgtgaagtctctactggaaagttttacttctacttgacaaaagcgtgacttttgacctgatcttttgttgacttccatgtagattacgcatgcgaccaaaaaattgcaggagcaaaagtcatatcaatatcaagctcattaatttaatcgtgctagtttaggcattactaaaaacatcttttttgaaacatcagttacatatacaatagcagcattggtatatattactccctccgtcccataatataagatattttgaattttcggttgtattgtttgaccactcgtcttattaaaaaaatttgtgcaaatataaaaaacgaaaagttgtgcttaaagtattttggataataaagtaagtcaaaaaaataattccaaaattttttgaataagacgagtgtcaatcaatgcaagaaaaaaactcaaaatcccttatattatgggacggagggagtatgatattacgatggttttacaatttagccagggtaggtgaaggttattttgctttcgtttcaagatattctattccatgaggaattcgggacgaacatatactactccctgttttgtaaaatatagtaatttgtaactataaatttaaacatattttatgacggagctgaggttatagacaagaagtcaactataacgatctcatgtggaaataactgtactgcaccagtataatctagtagtactgcataagtacatcttccttttttttttttaagggtggcatatatccccctaaaaacaagggttgcatatactattattcacagatggaacctgtattaattatttcctttgtacagtgggattattgtgaaagggatcaaatcaacaatggtagtgcttaccccccacgtgaagatgctaaatgcaagttattcctttgatttgtatttcagcagcgccactcaatctatctcttttacgctcaggagcttgagacggtgaaccacatcctccttgactgcgtgttcgcttggcaggtcttggttccgttgttgtcgccttgtgattgggctgccctctctcctcctcgtggcaattggctccagaattggtggccatcttttaggacatgcttacctgatcatctctgtgccggcttcgactctctggccctcctggtttcttggcaactgtagaaggaacgaaactttagggttttcgactttactctctcttcggtctcagtggttctagagtccatcctcactgagggccatctatgatcgttagctggcgttgcttctttcgggtttttttagagggtagtgtggctctgccccctccccgctgattggagctgtgtccagccgtcgtagcagtctcttcatttttccttgttttttttttgtcttttctcatttcccttggcataagccggtatggttgattgcattgtgtaaacaaacactcttttttctaatatattgacatacaatctttttacgagttcgtgaaaaaaaatagtgcttaacccccgaatcatagcgaatagaccatagtgattactactgaatattacctctctagtttacaattcaaagactaaaataagtcaacaatatgctattccttttgtgctataaaaaatcaacctaaagctttatccagattcataatattagaatatatcatatctgataatagattaatatattataggacggatggagtatggaagagaccttctgggcccacatggagataatgtaactaaagctacgatcccggatctcacattcacctgggctccacctgttgccatccaaccatatatcataccagtaaatatatgttaaactgctacgagtccccgagaactgatggtcgatcagctccgtgagttacacaagacctaaaaaacttctcaattgaaaaggcaaacgctgaataaatgttatttattgtcaatgtctaattagacttttcttaaaaatatatataaatatgtgtaattttgtagcgttttacttgctttcttcttcgttgatagatgattacgataattagccacctgtttttttagcaataactaggagtaactaagaaaagtaaccaattcatttgagtagggttggcaatagggtgggtcagggccgggttgggctggaacgaccccggcctccacccggccctagccccgagtggagttgcggggccaaatcaaccctcggccccggcccctacggggccccgcaacccgactggggacccgcagtcaccaggggaggactggcggaggaagaggctcgcgtgcgtcgcctgcttgtcagtcgtcgggcttgccgtggctgtgcgttgcccgcgtgtcgccctcgctccgcccaccgccagcccgcgcgtcgcttgttcgctcctcgtttgccgcccatgcgccgcccttgtgccgccaacccgcgcgccgttgcctggaaacaggagggagaagggcgtgtggctgcggcccgcgtgcgactggaggcggagggaaagaggatggccggaggggagagggcgagatagaggggcgcgccggcgcagtggcgtggcggtggcggctaggtgaggagggggagagtacgccatgagtgatgggtggtggggttgtgttatgggtagggtttttctcaagtcgggttgggtctaatgggctatatttaggattgacgctatatttaaaagtccgatatacctcctccggagccccgcgggtggaatgcctcccccggcccctcactcgcctaattgcggggccccggccccgactccctgcggggtaaaaacctcacccggccccggccctgtgggggaaattgctatccctatattcgagtatgttaaatccgagtaaaccaaaatagtaaaaaaatgttaacgaactagccgtttcaatacttctatccacattatagcagtttaaaaaaacaagtatgtgaggtggtgttggcggtgggatacatgttgagttgtctttttttttctctctctaaatttgtaagagaaaattagtgatgtgtatgtagattacctaatactacctctgtcataaaataattgtgattctaagttatttagtacacattaagatttaaaaagaaaaaaaatatgataccccttattaaatgatgtataggtaagagtaaaaaggtagttgagggtaaaatatggagacatttgaatgatatgtgattaataggaccattagtattctattgtgacaattattttagtacaaatttaaatcacagaaatagaattattacgacacaaaagtagtatttacttatgaaatggaatcaatggttattatccaagccctctgctttgtagtagtagctacaaaatgactcatgtaatttcgttttctcattttaaatttcggagattatgatgcattgctggttggctaaggatgaaatcaggagcgttgattacgctaatctgatcaaagcatctcaaaacctgccttgaagcaattaagcaactttcaatgtaacaactccagtatttcttgttccatcccctgtccaaagcaattcatcaattaggagcgtctagctagttccataaaaagcaactactaggagtgtccagctagttcaatataaaaagtatatgatcggctatgattatgtctaccttatgttaaattagctccaataattgattattatttttgaatttaaaatcactcgagaacgatcaaataaacccgatcggtatatagcagcaagtcattagttggtactggtagcacgcgtcatgatagacaaacgtggataaccttgctatttggacagaaccaaacaatattcttgtaccacagctttattaccattgaaaaaaacatatgaaaatacatagttggcacacccttttaaaatagtattgttttaatgataacagtaaaccactataaaaatatatataattaaacaaatacattgtcccatgagaactatatagtaagtttgtcttaacaaatttagagctagcgggctacaaatagcgaaataaaaattcgtcgacaggtgattagcccttctcatcttccacgtacatacatgacaacaatcgcatttatgttagccctatcgtgctataataactaatggcggtagaattagaccgttgcatgtctccgttatagtataacttttagttgtgacgtgaactccaaccaatttacgtgcatgcatgggaaacgtttgcgtttctaatactctagcatgacgtgtattcatgcacgacattcgtctgtaactgttcacgtgtaggcctctcgttttagtgctaacgagtctctatctagatactttaactgtagtactagttctcatcaagtaaatagaaaatatattcctatcacctatgtttcaaataaaattttctcttaaactactcatccgattacacggttatgttcgtaagaattaaatctttctaacaagatctcatatgattatattttgatgaaaaattacaaattacttttatagtatatctaaattacttttagatttcactaaactacttcttaaacatataaaagtaatttcagtaaagcttaaaattaatttacatatattatagaagtaacttaaaacaaaaaggaagtaactttgtcatgacattaaaagtagatccgttatggaggtaaaagcgtgagtatatctagaaattaaatttaatcaacacaaataatggaattgactaaaaatgataataaaataaacaactcaaaaatattatgaatgtataataagtaatttaatcaactcgaaaaagtaatttatatatatgataaaagtaacttagatatataataaaggaaaaagtacgaattacccccctaaactatcacggtcgtccgaattaccccctgaaccataaaaccgacattcttcacccccaactatacaaaccggacgaattacccccctcgacccaatccgtagtagttttggtctacatggcgtacgcgtggcagtccagtcagtattatatatatatatatatatatatatatatatatatatatatatatatatatatatatatatatatataatattgggacccacctgtcatagagccttcctctctctctctcactcttcccttctctctctctcggtcatcggcaggcgggggcggcggcctcggtgcggagctgctgcggcgttggacggtgacacagaggcggcggctgagggcggtagcctcagcgcggagctgcggcggcgggggc

SEQ ID NO: 43672 - DNA, 4494 bp, Oryza sativa
tacaactgcagcaaggggagggaggagagagagggcgcgccaaagggaggagagagagggcggcggctggaagcgctgcaactgcgagctcgccaacgcgtagctccgcgctgaggctgaggacggcacgccgcccgcggccgcgcgggcctcgtccgcctcgccaacgcgcagctccgcgccgaggccgccgcctccgcctccgcgtcaccaccgccgtcgcagctccgcgcggaggccgcctccctcagtcgccgcctccgtgtcaccgtccgacgccgccgtagctccgtgccgaggctgccgccccagcctgcagatgaccgtgagagagagaggggaagagtgagagagagaggaagagtgtatgacaggtgggtcctacaattatatatatatatatatatatatatatatatatatatatatatatatatatacatatatataatgctgactgaactgccatgtgtacgccacgtagaccaaaactaccgtggattgggtaaggaggggtaattcgtccggtttatataactgagggtgaagaatgtccggttttgtggttcagggggtaattcggacgaccgcgatagttcatgtgggtaattcgtactttttcctataataaaagtaatttataacatagatatttcttttattaaaatatagtcatgtaatatcttgttataaagatttaattgcaacgaacataatagtgtaatcggattataaatcagataaataatttaaaagaaaaatctgtaagaagaagaaaaaatacatgtattatttagtgtcctagtaggcaagatgagtctcagttaagacagtatagattgcggtctctgaatagtcacgtccttttgaaagcaaacgggattcattaacctaacgggggtggccacagcattaaaaccaaggcaatcccccacagcaccgcctccaccctccactgtgcaaccgataagagccagcctcggccttctcctccttcctccttcctgcgactgcgagcgggagcccgcggctaccaacccggcggcggcggcggcggcggagaggagaaagctgtgtggaacacggagaggtggagagcgtctccggtctcttccaaagtttccacccgaggaggagatcaaatcttggcctctcgagtcaggccccccgcgtccgcgtgggaatctttccagattcgcgcgcacgctccgtggacgcggatcgggagcggggagggggacgtaatggtggtggaggggaatggccgcgccgactcgatcaccattggcgtctgcgtcatggagaagaaggtcggggggatcttgccgccctttggttctaggactctcgttttcttttctttttcttcttcttctcttctttttttttgggtggttcacgtgatccgcgaacgcatggatatggctgtttgatttggttttcctttcgttttttttccttttcgatctctcctgtgttcactaatcacttatctgttctttcttttggacgtctctggttccttgatcgattcgtgctgttgccgtgcgtttctggttcttgatttgattcgccttgttgccgttactgcggctgcctattgattgatttggccggttcttgaggaatgaggtttctagtcgcgccgctggttcttgactatgattatgatatggtctaatcaatctcttgattttttttttgtttttctctgcaggtgttctgctctcctatggagcagattcttgagaggctccgtgcatttggagaattcgaggtacgcgagatttttttttccaagccgtttctctttctttgttcgatcaatttgcaaaagtggaaacgggtgtgcgattgaagcttgtcatgtggatcagtggatgggtggatggaattgcatacgataaattttcttctttttggtaaaaaaaattgctttttcgaaatattttatggcgagacatccgtgaatctttgtggataccaatttattctgcatcttttctttgtggataccagtacttgaggtccccatcatgtggttgcttttgcggtttgtccccaaatgttttgtcttatagcaactaggtcccttaatctgtactggacacgagtgatctctcagtttctttgcaatattctttttgggtggacttaagttcgcctactttgctctaccgataatttagccactattgtcaattaaatatttgaatgttagcacttgagtactccatatcccccattttttatgcaccaatgttgactccttttaagtatataagctattgagcggtgctttaatatgaaccgggattccctatcaattaaacaatggtgtgaaatgcaatggaaatcttaactttctgcagacgataaggcatcggatttggtccacggcatgcatatattaatccatttgcatgttgttctttgcattctactcgggaccactgaccacttcgtcattctttatgcattaccgtagttcgagctacatcacatgtcactaattactccttgcttccattaattcatcatgttgcttcttttgttttatgttccatacttcatatattttatcaaacctgttgataaacctggactgtacttattattttacgcttcaaatttctctattttttatctcaggcatacttaatctcattattaattactctatctgaacttcattttattaattgatgtttaagttatgtgcagaaagttgaaatgtttcagatcaattgtcattcagcattatttatttgtcttgcagattataatatttggggataaagttattctcgaggatcctattgagatgtatgtaatgacaactcaggttattgataacttaatcattgttcttttcaagtataggtttatccacactacttctgtagtatttttttatggcataaatgtagtgcatgcttggctgtaagtttacgagtaatgtctcacttatctgcattttatgtccagttggccaaaatgcgattgcttgattgccttctattcatctggtttccctcttaaaaaagctgaggcttatgctgctttacgaaggtatgaactgtttccttctacattgttatgttggcataaattctattatgatttagcaaatacatccctgtttctaaaatgatttatagagcacttctcaaaatttttattataatttgtcgtatcatttttcttggaatgtacatgatgattcttatacaacatttagacaactaggccggcgtcaaggaagtgttccttttatttttgaagttctgtttgttcctcttcaatattatcttacgtcttattttaagcttttgctagtgtagtaccatacgttgcactggttttcatataaatgtcatgcattctcattcaaaaaatgcccaaatagttatatttaaatgtaaactaaatacaaccatatggactattcatccatatatacacatgtgtacacgatgcaattattttctacaaccctagaaaggttcacccttgcctgcaaagacccatccccagaaaatcagtgtagtgtggagcacactgcacatcatcaccatcttccatcccaactcttatcaacaagcttcttatatgcatctagatattggaacattgctattgatctgtgtagtataccagatatctcactggacatgagttgatcaagagagcattgagaaagtggaaaacttttactgtttcttacaaccactggaatttctttgctgttaattactttaaataaaatgttaaagtaagaaccgccttcacaccctcaccagctcaccttattgagggtgattttttttttccttgaagtgaatagaggttaccttttctgttacatttggtgattttagtttgcccatatctcccagttgtcttgcattttgtaacagcagtcttatcctctataaatgtcaggccttttttagtgaatgaattggagccacaacacctacttcacgaccgcagaaaagtatatgaggtatttccatggcattcatagtgtcttctcttgcgctcagtaaaacacatgatctttattctctgattacgtacactcctagaataaatatatatgttttatctttaacctctgtgagaagtgatcttgttatctatgttggaacagcatactagcattgacctattaagagtttcagtttagcattactgctctcaaagtgtctttacttaaaagtggattttccagagctccgataggcactcctgtcatatttatagtttcaataaattgtgttatggggtttcccctgctagataaaaaaaaattctgttgttgctctgcgtggggtgtttaccaaggtgtcagtgaatcacttgacatttttggaagataaaataaaatgttagtgagccagttgacattcttggcagattcatctacaggtagtatagaagatattcatttatgcagttactagttgaatacccatgtgttggggtgca

SEQ ID NO: 43673 - DNA, 2825 bp, Oryza sativa
ccagtaactgcacaagtcaagctacttgctgaagatgaagaggagaagcttgcattaacaaactcgttgtctagatatgaccaagcaaaggcttttggaaaaacaacaattgatgtagctcgtattgctgccgggttgccttgtggtagtgagagcttcctctcgatgtttgctcgatggaaaaaacttgagagggatttatataatgaaagaaaggagtgagtaaaatgtttcacttttagacttcttgatgtcagaaatcattttattaaccaagtataacttccttctccaatcacttatatagtgctccataaattttactgcagccgatttgacattacacaaatcccagatgtctatgactcctgcaagtaagtgaacaaaccatcttcaagtaactaggttatttagaaagaaatcaggagcgtgaattaactgtctgttttcattagcaatctctattttctagcttttctgaatccaaagccgctaatatatttgaagggtacctaaatactcattatgacataaagttatttaaatttgacacagaattataacgtgatgccattattcttccttatatatctaatgtacttatttgaattatgaaagatcatttacatctgtcatgaaccgcacaatctaagtgctgaattacattgcagatatgacctcctgcataatgcacatcttaaccttgaaggtttggaagagcttttcaaagttgctcaagtaaggaaccttaacgttctgtacttccatttgatctctcttttaaattgcatgaatgttactgatggacttcttgagtagccacgaagtcatattgactaagtacttcctgcagaagagaaatcagtcaattgcaattgtaaatatatactgatatgcaattgcaaaatatggccatattatttttgtatgaacaactgggtagatagggcattgaagttctgacttctgaggatatcatttgacacaagtcacctgtgccacataaagaatgacattcctagttttctttgcctccacaagtcttggagtgcagactattgcattgtggtcacataggccttgaaaagatcgcaagtggttaaattatacagttccaatgctcaggtgatgtgactatgtgagacaaactgtatggtcagtgcttatgttatgatgattcctcatagaaggttcaatcttatattctttttgtatagccttatgagagatgtgagtcttaagttcattatgctagatcttgtggagtgaagtgacctggaacagacattgtttgtttagtgcatctgtttggatgattcaacgtagaaggtccaattccacattctttttgtataatgttatgtgagatattagtgagaatttcattaagctagatattagtgagatatgttcttttcttcatacttttatcatttcgtataaatcaattactccctctgtagaaaattgtagggcatattttatttggaaagaagtttttaagacaagactttgaccattgattgcgcataaatatattcataatatctataaaagcaatgtttatgaacgctctttgaaaaatgaatgtattggtataattttatgcactaaaatatacttataatttgactaattgtttgtcaaaaatttacaaagtttgaccttctgaaaaattatagcttttatctattagagccacatatgatgttatagttttggattttttttgttagtttatttgtgtagattagttctctttgacgtttttaatattttcatcatagcttatctaacattgattgttgtagcttcttgctgatggcgtaattccaaacgagtatgggatcaacccaaagcaaaaactaaaaattggctcaaaggtttgttttaagaaagacgttactgtttgttccatccacagatgattatatgctctttgcatgccacaaactgattaatcattttgaatgctttgattggttttcctagatagcacgtcggttacttggaaaaattttaattgatctacggaacactcgtgaagaagcaataagtgtttcagatccaaaatttacagaagatgaagctacattcttaccaacgaaagaatcagagtaccaacaaaaacttcaaactagaaatgaggatggaagaagatctagttccacaagtgagaaatcattggatcaggaagatgaagatgatagagaaactaaataccgcttagatcctaagtatgcccttggttttatcaatcctaatcaatcctaatcacatgtgtatttaatttctctaattcactttattccaggtatgctaatgtaaagacacctgacagacatgtccggacaaggctttatttcacatcagtatgcatgagacttcatgttcagctttgcttttgttcttatcatcatttttggatttaattgttattctaacattctctttaacaggaatctcacatacactccttaatgaatgtccttcgctattgcaacttggatgaatgtctacaaggggaggatagccttgtctgccaaagcgctttagaccgactgcatagaaccagggagcttgactacatgagtaatattgtgcttagaatgtttgaaaatactgaggtatggatctttttcatatggctcacaagaaaacttgccttgttacaaatgctatttttattctgggtaagatttctgtttttcacaaaatacatgagaccatatgtttccaaaccgccattttatgtgcgatgaggtcctggatctctttatcttatttccttgactattctctgttttgcacctacttatgttgat

SEQ ID NO: 43674 - DNA, 2759 bp, Oryza sativa
gccttttcacaagggcgcgactaatgggaaataagtgaaaaagctacaaaatggtagaattgatccatgtgaatatttctcaacttttagcatctggtggcaacaccatttgcccaattttggtaactttgtcgaatgtttcagagactggatcctttataaatgctcttgcccaatgtcttcaaatcctgttggtgaagcacaaaaatatacatgcaattgtgtagctaactctgaatatgcaatctcctcaagttttttcaggaactgtcttgtccagggatcaaatatactttctgctcctgatcaagctctgaacaatgttggcattttggcaacatggacaatgttcatcagacaatgtctgttggagaacacctatgctaacacctaggcatgcactaattttccttgcatttgatttccaccttgcagctggttagctcatgcacatctattttggcacacttcaactctgctgaaaaaaaaagctgcacggtcaaccagctagacacgatcattgtctgatgaatgatattagaatttgattgcgttgtaaattactataacttacgtgtgcttatgccatttaaactccatctggtgagcctggtctctcaagaaacatgagcatgggtagcatccgtagtttttagtgtattttaagagatctggtcaaaacctacaacagtaaggcaaaattaaaataaaatattttgtttgcatcaacgatatactcctaaaggcaagattttccaattgtgatgaaagccggaaacctagcgaggtaggtgaagaaagacaagggatgtgtgaaacatgatatctttcatcttgtctttctttttggccattttaaaaatgattttaactctaatttatatttgggagcatgattggattacacgttgcactgacaagtgccgctctacatttggatgcttccattgactgaaaagattacaatagcatatcatttcatttttcttaaaagaaattaatagataaagacacagctgatgataaaaggcaagaaaagattgtgtcaacttcactttagtggccgaagagtgagttgccttctgcagcaattcagcaaagtgcagcttggaagcgtctggcgtattatgccaagtatttggacagcaggaatttgtcgcgatgggtctttgacaggcattaccataccaatagttgagagcttgaggctcaatctgaatatgtttccgcctttattcttagtaacgtaatttcaattatatatggataaatattattatccgtaaaaatttattctctagtaactatattcacaagaaaacaatgtaaaataaaattagaaaaagtaaatcaaacatcaaatcctgttcctgtttggcagcctgtaactaaggtagagtttagttccaaacttttttttcaaacttcccaactttttcatcacatcgaaactttcctacacacacaaacttctaatttttcaatcacatcgttccaatttcaaccaaacttccaattttaacgcgaactaaacacaccctaagttgtaacgtggctgctagactcccaagacaacggctggctgcaattccatagtgtttactaggtgaaaccctgcatactcctgtgagagtttaatacgataataataagtaaaattaatgtataagatggcttaaacaatatgagcttacataaacataagttgatgtgatttaaatttaattactatatagaatgatgattcaaatgtaaaagtaagatgatgtggcttatgagaaaacaaaagaaggaagataatttagatcatacatctaacggctaaaaaaattgagattatatggcttaatgagagaagaaaagaagaggtataatttgaaccaaagattaataatcatataaggattaaaaattaaaaacaattgatgagatatgacttaatgagagaaaaatataagtaacatgaactaagtggggatgaacttgataggtataggagataatatagaaaaaacgatgaagagatatattaaaatattatatgaattatgtggaatgatttgacatgcttacattttaagtctctaaaatttaataaattattaaattataaatattacagcaatacatgtacgatacttaaatgtaatagtaattgttagtggatgataatatggtacctttgcatataagagaggattatcttggttagaatttgtacataataaaaaatggctgtacataccatccaacggtgcgtacaaccttcgttctatataactattttgggataaaggtgcaattcaagtatataacagtactagttcagtttttaaatatgcgatgatttttgacacgatgttttaatattcatcatgttcaacaatttaatgtaatattaaaaactataattcatacttaaaatatatttaatggtaataagatcataactgaatggatgatatttatataaaaaattaatagtaaaacgaatgattgaatatcatgtataacagttgacaatattgccatatactgtatttaaaaactggaggtggtggcacaagatttatactactccagtattagtacggtaatgaagggcactttaatgatagggtcagcatagcagttgataccaattaagatatcaatcacacgtactcctaagtaaagagagtttatcacgcttaatagatcaaaacaaacgtgccagatgtgaaaacagcaaacgatgtgatgaatctgaacaccaataa

SEQ ID NO: 43675 - DNA, 3288 bp, Oryza sativa
catgtaatgcttgtcttcagtagctcatcaactgtagcaggctcccaacttcccaagcaacgacgcattaactccagctttgaaactaaaggccatagccacacaggtcgcatgggagtttttgataaaagagctacactaaagtttttaataggggtaaaacaggaaataggcaacctaattaatcacttcttggtaagtgagatcctgtccaaaacgtcaattaatatagaaccggatgagtactaattactccctccattccataatataaggcacaaccactttttttagatgttccataatataaggcatacatgcatgcctacaattaactactgacatcttctccattaaattattaacttttttaaatccttcactctcacatcctctaattctattggatacatgcattgtatttattaggatgatccaaactacaagatgataataattatttcttgatatttgggttaagagtggttgtgccttatattttggaatggagggagtagtaaactccactgctgctagctaccccctccgtcccaaaaaaaaaacccaaacctagctaggaacctacgtatatacatgtctagattcgtagttagggtttatcttcttttttttttggaacagactagtagttaataggattactgtaacaaaactatattggtgtatatctcaatagtgcttctataaggtcagagacagaccaacctggtatgaaacagattaatggctgtgttcgtgtatagaggttaggaacacatgccctgcacacggaaaacaaaacagtctattagcgtgtgattaattaagtattagctatttttttaaaaaaatggatcaatatgattttttaagcaactttcgtatagaaattttttgcaaaaaacacattgtttagcagtttgaaaagcgtgcatgcggaatacgagagacaggggttgggaacccatgattccaaacacaccctaaaagtactcaacctcagtagatcttggatcagatttatactcatattactccctcaatcccgtaatataaggcgcccacgcatttcaagattcctatcttcaaaatattttgaccaatatttatgacaatatgaattgaattttacttgctaaaagttatattattggattgacatttgaatttactttcatatgattacaattttgttactacacagattagttataatatatgagaaattataagacaaaaattagttttggaggccgtgtcaagtttgatcctgccttatattatgggatagagggagtattgctcaaagagtaagactcatatgtggttttgctatgtctaaatattgttgaagtagctgattgatttttcactgcggcgtctgaaagttccctcggtttattctaggttcctttacctgaaaaaggtgagatgtcaacaaaagaagccattgaacatagaattcagcttgttaagaacaaacacagttttttttcaaagaaaggaactaatatcataaacattaatttatttactgatccagctgcgaaatgtggaattctagaagaaaaagatactaaatagatgatcccttacatatgtgattggtccctctggatttcttgttctcgatgcctccgattctcattgacacataagttgacatagcaaaactgaaggataagtagactccattctcctgtgcttcttggtagctactcctacatgccatctgtgctctgttttaaaaacaactggtttggcctttcttctattttcccctcggctcgttttgatacctcatataaccttgagtagctgcaaggcgagatgcagaactggctacggagaggggggagggatggtggatagagtgattacagcaggtacaatagatcgtttttgttggctacactgcatccatgctggagaaattgacgagctggagtaggaatgaatggaaagagagtgaaagcgagcgactaaataagcatcgattgctcacccgctcttattggatctctgcagtagttctattctcacagagagaatgattgaacagggatcaaaaggatatggacatgcgtgaaaagcttagattaaaaaattaagaatagatgcatagtgtttgtaccataaattggcttataattagtgcatttactcaggctaaattatgtaaaatagttggtgtgattgtttagtggtttaattataagagtagcgcaatttatatgtgtgcaggattatttggtgcactggaaggttaaatctggtgctagcttgttgctcgatggtctgcatgacggtgattaaacagaagcagatggatggatggatgtggtcatctgattttatggatgcattaggctggctgctggtgctggcgtggcgtgttagagctgatgaagccggttagcgcgtgttgcggcaagatagatagaaacggattagccggttagtttgtttcctttccgattaaacttttccatatttttgtgggatcaattaggattgttaaagattgattagagtgaccagtatatatactggtgacgacagattagaggaaaccccgaacaaaattatcaatctactattttcctgttatttactttcctgttattttctattttgttttcatggctgagttttgacaaccctagaatttaggtaatctttgccgttttgcgctgaaaaacggtcgtgcttctccaaaaaacgagaagattatcctttgctagtttgctcggaaactagtcgttcatcgtcacgtaagtacgatatttatcctctttgctaatttgcttgtaaattagtcgtgtgattccgcgaaagtgaattaatctcgaaatcggtttcactagccgattttgatctatcgattttggcgactctattgtttacaccgcaaatcattaggtgatattgtgttggccacaaaaaaacgtcaacacatagcaaattgggtgtagataattttacatctacttattgtacacatactacttttattcactatttctattactgatgtggagatttttggagccagcgatcggctatactattaaacttgctcttattgaaacagatagtttggaggtggtggggatgctaacacagattggagtaaaccgttctatctatggacatgatccaagacctcaagaacatgttaaagacgtacttcctgggaaatgaaggtccaatgggtgcagcgatcggcgaataaaagctgctcatttggtagtcacggatgcgtgacgggcgaaacatcgaattggt

SEQ ID NO: 43676 - DNA, 2464 bp, Oryza sativa
gaatgtaattttgatagctatatttggtagttcattttgtgaggtcttaccctaaaataaatttttccggaagcaaatacatgacaaaaggtctctgtcttagtgtattactccctacgtatttcatattataagccgtttgattttttttcctagtcaaactttgttaagtttgaccaagtttataaaaaattctagcaacatttaaattattaaattagtttcattaaattaaaaatttgatgtattttgataatatatttgttttgtgttcaaaatactactctatttttctataaacttagtcaaactaagagaagtttgattagaaaaaaagttaaacaacttatgatttttattttgtttttccatggtgcttcccatcctcacacttcggcagatctctgaggaacgggtgtcacatgagatctgtaaccagatggactctacaatgctagtgcataattatcagtcatcactttgtgaatagtcaccactgactcttgatcaactttgcactgcccgctgctctgtttcatatcactgaaaaagtaggtcaatcagaaaaaaacatgttacaagatcagatatacataactggagaatagttctccagtttgtttcatcaaaaaaaaaaaaggtgcaccacaaactgaattttcttaccatcactcctagtgtcggtgagtttcttttacctaatgcttcccatccccatgcacatatacttccagaaaacgaacaatgacgctgctgggacagtagacagagtctacaatgctaccaatgttcagatcgattccccttcgtcattgccttctgtcctcagttctttctcctgtttcattttggaagttatattaaggaagatagggatcagacactgcaagggaaatgtggtaggtgttccattgatgttggtgtttgttagtagccgctgccattgcatatgccattttgcctaagatgaaaccaggaaagcaaagattttgtaaattagcgtaagaattcagatgtcccctccttctaagtgcactggtggagctcggaggcaaaccggataagattttactccctccgtcccagaatataagaacctagtataggatgggacgcatcgtagtactacgaatctggactaacccagtccagattcgtagtaataggatgtgtcccatccggtattagattcttatattctgggacggaggtagtaatttattgccaccgatcacggcgattttatcttcttttcttgttagggaagaaaaccaatggaatttaatctcatcccttaatttgtataggtagttcaatgatatgatcatcccctaaaatgtcatttcatagttttatagaacagatgtaaagcagattcagcctgtgctagttcactcccaaactgcagttcactagaatatgtccatatgcttctttatttaggttatactccaaagtgattttgaattttgaagtttgatttttaaagaatagttttaggtaaaattcgtacttcttagggatcatgaaaagagaataggctaacgaaaatgatagagaaatccctaaaattaaccttacaaatcaaattctagccatcaaaatcagatttggattagctcagccaagcagttacacgttcgctcattaggggcctgttcaaattgtagccaaaataaaccttatcaaattttggtattgccaaaattttagtaagaaggtaatattgctaaaattttggcaggatttcttatgtatttatcaaattcagcaacaaattgaacgtaaacattttttttggcaactttataaaaaaatggtatggttaaaaatggcatcaaggtgaacagttcctaggtcttcgtgtagtgattactaggattaaagtttgattcaccgagttggatcttacctattaattgtatgatatattaggattagggaggcctgttgtgtatgccccagatataatatagatcatgaactaattaagtgatatcagcttctgttctacatatcattcggatgtttttgcagtttctactatatatttgagaatatcaaaatttttactcaaaacaacgaaactccgataggagatacatacatctacagtagtttttatgctttctcatgcatgccaaccctgccattttctgatacacaattgttcggcttgttctactccatgtattagtaaaaccaaacaatcagattagctcctctgaaacggagagaaccaccctggtctgcaataaactcaactgttccagaccttgggccatgtctggactcgggtccatctacggtttcgttgtcagagtacggttgaaggctttgaagcaaagaagcagtaggaggcttatggaatgttgtgctgcgaagtgctgtatgagttcattctaatatggttctcatacctgaaaaattagacgagtaaaatcaacaaaagagggcactgggg

SEQ ID NO: 43677 - DNA, 1429 bp, Oryza sativa
agtgacatgccttagcctcagtttgcgaataatcatcactgtctccaaaccagtgctggctcctccatattatatccctgaaaaaaaaaagatacattggagagaacatgttacaagatcagatgtacacaactggagagtagtttcctagtgtgtttcataacaaaatcatgccatgtgcaccaaatttctcaccatcactcttggcttctctggccttgtttatgctgatgcttcccatccccatgcacattagcacatatactttcagaacccaacactttgtgggaaactagatatactctaaaatatgctaccaatattcagatggatttattgcccaaagtcacaatcgttctttcattttttttctatcctttgccttctgtctagctagtgtccacagttctttctcatgtttcattttggaagtttatataaggaagatggtgatcagacactgcaagggagatgtgctagagtctctcgctttgtgaatagccagctcagttaatttggtagtgctggctgttctatttcatatccctgaaaatgtagatgtatgggaagaaacatgtagttctctactttgtttggtcaaagaaatagatgtggaaaaaactgaatttctgaccacttgaacctaagtaatgcgtgtcactgcattaagatgaataaagtttggtacaaccaaaaacaaaaaggaggcagaacccaggaggacataagcctaatctagcgacattaggcagctaacctagcgacattaagctggcgtaagctggagcagcgcggcaccagctgcactccagagtgccgcctcttccgccattgatctaggcctgtagcatcctggtgccaagggagaaggttgtgatgtagacattgttaattagtacttctttccttccagattgagaagacccagtactgtgatggtacgtgtagagaactcttctaagctgtttaggcagttttaatctactttcacagtgccacaggggagagctgagggagggggaaaagatgcttcacctctttggttggtccacacgtctgtccttttacgtcctcccacaatttttgcaggtcgtgcctaaaaagttgatttttacaagcggggtcttaattaagagccctgcttgcaaaaatagaggtattttcgtaagtggatctaccagcgaaaataaaacccagtgttatgaaaaatcatttattaaatagtgaagctgcagtgacatccttacaagtcttttttagattttcctcatgaactcattggctgccacatgcaatccaacaaagtaactccactcttgttagttcatggaaataaattgtacccacaacttctgtaaagctagcgcccacatattgactctgatcttttcggcttccccgaattgctaaagtcatctatggttttgct

SEQ ID NO: 43678 - DNA, 1680 bp, Oryza sativa
tatatatatatatatatatatatatatatatatatatatatatatatatatatatatatatatatatatatatatatatatatatatatatatatatatagcccggagtttgattcagttatttaattgcaaatatcagttttgcaattatggtcttgtggatccatgacttccttttcttttccaaaataaccatataattcctgttgtaaccaaaactcgtgaaaccaacagaataataccaaaatcatcaacgtaataatgagtaatacatacgtagatgaaataactaggcaattatgtaggcaaatagccaatcaagcgtctttgtttgcttgcgacaaaaaaatccctccgttccatataagttgttttgagtttgtcccaagtcaaagtttttaagtttgaccaagtttacagaaaatatttagcaacattttcaacaaaaaaaatattcgatgatggagttaatgaaactaattttgtattgcaggtgtaggtttttttttttacaaacttggtcaaaattaaaagaagtttgacttcaagacaacccaaaacttcttataatatgaaatggaagaaatacatacgatagttacagtatagtggtatacaaacatgccactcaattagggtttcatcaggtattgtcggtgcctctcaaaagttctattgagcgttcttggcatctcttcaatatcattgtgtcatatgaatatttcaccatgcatgtctctcatgcatgtttcaactacttccatgttagtcttgttcaaatttcagcaaccaaatgaacaaaagttaaagcaagccgccctatgacaagtcgatttcccatgagttatatattgagtccacctcaacacttggcagaaaacatatacaattcatccgcaaaaaaaaaatctataaactggttgacaagtacacttgatctctcaaatgaacctactccaaccccacaccacctgcgcctgcagcctgctactctactagtacttatcgatgcatggtatatctggttctatcatcctatagagagagatcacattgccattgcctttcttgctttgtgcagtgcctgctttgtctcttgtcaattgtatcatatccatccgttatgcgttttactctacttcatatccctgaaaaagtgtatcggtgtatgtaaaattatgaagtcgttctagtttgttcataaaaatgttatggtacctactgaatttctgtaagtaataaacattataggtattgggatgtcttacatggtatatgggtgtttctcattttctttctcctgacgcttcccatccttacgcttctatagatctctgagaaatggacaactcatgagacaaaagatggactctacagtgctagaattactctagcatatatatacattacccgaatgaaaaaattattttcatgaaaccacaaatgtacactcccttccactatttgccttttatctcttgttcattcttgaccttttccgtttcattcgtatgtctatgtatcaaagatggacacagtgatgaaataataggttggcgtggcattgatccccttaattatttgggaaagtcattttaccctttaaaggggatgccccttttttttgcatgtcactttaatcatgaaaaattcttgaaaatttgacaaggggtgcaggaa

SEQ ID NO: 43679 - DNA, 801 bp, Oryza sativa
agcacttatttacatctttttatccagatttttgaaagaggagtcactcaggaccaagtaattctgatggctgctagagcatcccgaacagaaaatcaagatgctattgatactgcaatagtcgggatgctcgctgatccaaaagaggtacatcgatttgtcagataggggaggaacgactatcttgtttatttgaggaattaaacaccaggaaatatttcctgcaggcacgtgctggtattcaagaggttcacttcctgccattcaatccgactgacaagagaactgcattgacatacattgatagtgatggaaagatgtaccgtgttagtaaaggcgcaccagagcaggtacaacaaaaatcatctgcagatatgttaaaaaagctttgctggaaatttccatttatatgatggagttattgattgatttcataaattgacatgcagattctcaacctggcacacaacaagacacagatagaacgacgagtccatgctgtaattgataagtttgcagaacgtggacttcgatcacttgctgtagcatatcaggttagcacttcttcggatactctttgcacaatttgaatgttttaacattttgagttaattaagattaggaactatccagagtcattatatatgttgaaaaatcattgttccctgggccagtttaattttcattatggtctcctttccctgtcatgtaggaagttccagatggaaggaaagagagtcctggtgggccatggcgctttgttgctctccttccactctttgatcctccaaggcatgatag

SEQ ID NO: 43680 - DNA, 984 bp, Oryza sativa
aaatctaaatcaactagtctcaagtaagtgcacaaagaagctagcctatgttgaggtttgcaccctaatagcacaaataaactctatatgtaaacttgctcaaagtaaatttgcacaaaataaaggagacaagagacaggaatttttcaccgaggttcggaaactcgccggtttcctaatccccgttgaggcgagcccaactctaccgctcaaccacgaagccatcgcacgccccctttgtcaaggggtgggcaagacgggagccagcccacggagaggactaccaaagcctcaatcactagggtagttcttcctacactccgaaggtggtaaactccaaaccactcacaatcggcgccgggcctcctccacaatctccttggagaggtcaccgggcaacacctccacaagccatctaggaggcggcaacctccaagagtaacaagtctaggatgcttgctgaggatgatcaagtgctgcactagctataacaatgaagcaatgcacttggattggcttaactcactctctaatatctcactagataaactaagtgcacaagggtatgagagctcttgcaagggttcaagataatgcaatggagtgccaaaaccttacccttgctgctggggagtgggtatatatacccccaaccaccaaaactagccgttggaactgaaatccccaactcagtgctctgccggtcagaccgccattgtgaggccggtcagaccggactactttttaacggctagaaaactagccgttacagggcaatcattgagcccactcaacctggtcggtctgaccgcagtatagtggccggtcagaccgtccacggctcggtcagaccgccgtcggcttggtctgaccggttgcggctctgatagatctgtatcgctaccaaaaaccagaccagtggggccggtcagaccggccttaccacgtaggtcagaccggctaacagccctggtcagactggcc

SEQ ID NO: 43681 - DNA, 1059 bp, Oryza sativa
agaggcgatgggacgacacgacaatgccctcaagagggaatgtgacgcaaacgccatagttgtcggcctggccaaaacctggctaggttttcacccatcgtccgccgcctgcctatccaccactgatgctacattgctccttccctatcaaacctccgtcggcgcgtgggtattgctgcaccggcgcccactgtcggccagcctcaccaacctccctatcgtcaccagccactgtcgcgtcagctttcctcgccatcggttgggccggcctccctgtcgtcgcccataccgaacctcctgacgccacccgctctggtgtaccgttgccactgtcgctacccactctcagttgcaccacgcctccatgccaccggtcattcctccacagcggcctccaggccggcctcacctccacgcgcgccaggtgcgcctccacgccagccacgacctcgcaccgttgtcggctgcacctccatgcgccatggctgcctgtcgccgacggccgaacctccttgctccatcctccaccgccagccgtggcgcctcctcagcctacccgcgctacgccagcgccacctcaagccccactgctaggcggctgccggctctagccgaggaccagatccggcggcacataccgcagtcgccgccgtccctactgcgaccccgccgcttcctcccttacctccaccttcgccgcctctagatctggcggcacccaccacggatttggcctcgctgtcatcgcagccaccccccccccccacgttgtttgcacctcgcggctatcttctcccttccccgcgtccactttcgtttgtcgccgtcgtccgcgcgccggcatcccgcctcaatgccgacgtctttccagcctccaccttcatctgtggtggtcgctgtcgctgtcctcgcaggccgtcggctttgagcgccgactttgcggccactcactcaagcggcgcgaggtaggggagaggttagggaaggtaggcggcggcggctagagtttcccccgagtcacatgtgtgggaggcgacacgacagctaagggtatgcagt

SEQ ID NO: 43682 - DNA, 1389 bp, Oryza sativa
attcctgcaccccgtcctgtttggttccatgagctaattattagcccccaccttttagctctgaattagccctcaaggatccaaacaggtggtttaatttgggggtagagtgaattagcccctctcagaacattagcccctctaaggggtgctaatggggctaattttctgtggagaccatcaaaaagcagccctatctctccctctctctcctctctttctactctttctccaccttttagccttaaattagctcatggatccaaacatatcatcttaggctaatatttagcctaccaattcatgactaaacattagttctcaaaattagccatgggcaatcttccaaacagggcctagttcctctcgcatacctgaaaaagcatcatatgcacaaaagacggattcggacacaactaaaattcaggtttagttatttgttatataaagagagaagatttttcatgactagaactaatatcatagcacggctaacttgtgcagaaggttcgcctgataacactgttcctgatacctctcatacctatgtagacttattatatatgcagtactctttttttttccttatatgtgatgtgtgtcctctggccaatattattgtttcatctgttctgcatttggaggtttatatgacaacatgcataggaagaagagtagtgacaagaggtaggtgctacaaagatcctcatagatgttcatgttcgccagctactttcttcctgcttactccactttttacttttttcatgcaatttaccctaatatgtaaaaaaaaaaaaggaagtaataatgtgagaatcatgacgaggcccttatagatgtcatagtctcacaggatgataatagcagagtagaagtaggtgctgtaattgcttgccgatgtaaatagttaacgtccaatgtggatgcacagcaagctgagtaaagaaccatggtggaatgatcagtttttttagaggccttcatgaatgcagtactgtaaaaaattcatggccattttatggctcattctacactgcacaatatatcagcagtgaacttatcatttcagttccaatacaagcatgtccaagaaactgcatacccatagttcatacatcacgcgataggcatccgcttcgaatatcaaatggttcatgagaatctagacacaatagattatatgcatatcaacgccttaacaccagaggctcgcagatgcttccctcttcaggcagcagcgaccgctggaggaggcaacagggttatctcaacattgtcatgagccccctgtagaagcagctcaccatcatacttaacaatttttctcttcttggcagcccgcaaggtgccgactagtgcttcaaatatgtttgcacaacggtcatc

SEQ ID NO: 43683 - DNA, 3804 bp, Oryza sativa
actaaaaaatcagccatttcttttactagttttgattgttatttgttgcattaccctatgctatttcagtatgtgaatcatgcaaaaccaggctagtatttcataaattgtttaacttggatgattcaaaaaaatagaaacaatccctgaactatgatacccatctgttcaaattgaaccctgcttcacacattcataatgccttgaacaattaacatttacgactgaatccaaaagtgagtgttatacagtgtatcaaaaattaattgtaatgtagcgtataatgattaaaaattaatacaaaaaccatcatacatgagtctggatcaaggaataagtcctgtccatgaagatatagaaaaaaaatgtttttttcaagtgaaattgacaggaattgttttgatgaagaacagaacaattaacagggaggagtaggatatatttaactcataggataaattgacaaagcaacacatcttgcgtatataggtagacgaatgccagggatagctggagttgtcgattcaatggaaaaagagcttggagaaaatgggagaataattaggaagtactcaagggagtaaagtgcctaaaaatggtcaaaactatcacttgcaaagctttcgttggttgtacctaacataaaaataaagaggaaaaagagaaggaatgagacaattaacaaggtaaaagctgtaaccaccaaagaggaaaatgaaagtctgatcaaaatgataaggaccagttggtcatcacactgtttatagaacacacaactaagaaacaaaatttgtgattcaaaattacaatatgagatgatgattggaaattgtaggctgcatcagaagaaaagacggataatggcatcaccacatacttgttgtatgatatgattatacatttacatgagtatatgtcgtaatggaacaatgatggcagaaaataaaatagaatgcacatgtagtgttctttttttcaagaagcatatacatcaagaattctgggaaaaaaaatatatacacaattctagttcttacttgttggtcctttattgtttcccatttctttcaactgcctgacagtcacagtgggcatctttctcgtcactaggacgttggacatatacaacaaacgatatctaacatataaaatgcaatttcacaggcttgggggcatatgaacattacaaaataccaaatcaagctcaaaattttcaatcacgaattcaagatcatcaatagcatcactgatccctctattttgtttcatgaccagctacgcactaactagggatcttcaatgtacacaccagcagataaaagctctcttcctctgaacaatgcatcgccaattttccatagagacacataccagcattaccaataatggtcacctagaaatccattttttttgggcaatggacacaaatagaccaggccatgatttctggaggaatctcatgtcggtgagattggaaaagcgcacacgatgacacccaagctgcacaatggcgtatgaatcgcgaagaggaaagcaattctaactcgagggatcaccgaaaatgcggggcccttgctgcaggcgccagatctggtgctcgtttcggaggagaggagaggagatgagaaaaaagtgatttaccttgtaggatccatcgggctgcttctggccgagcctctggatctcctccttgagcttccccacctcctcctccacgttcatggcgtcccccctgttcttcgcctctctccgcttttgagttctttgatatttttgggtgcggaggagaagcagagcaggtcgaggaagaaacaaaatcggggagagatgaaagagcagttgaagtggctccaaccgtcgcgtccgtggagcgtgggccgtccgatcggaagatgaacgggtgagatggacgtaacctgccgcgctagatttcctggtcgctgcatcacactgagacgttttcacatctcgccagtgcatattttggttgatttggtttcaattttttgaatttaataatgtaattttagaaaatattctattcgagtccacaccatagtcacgtaaaacggaatcagtggtagcgttcctcgacccaagaacgttatacccgtcaggccgtcacggaaacacggggttattttcgtcccaccttataaaaccctctcacaaatagcgtaccacgttcctcagtccagttcctcgatcccatcgacctagaaactttgttactataatccataccatccaaatacataaaaccaattatggtcacattttccatcttcttccccttttttttccttcttctcccctctctcccttcccctcatgttgctcagccacgacagcgatgccaaccttcatcgccaccccacatctccaacctctcatcgacccaaaaactttgttaccatgatccataccatctaaatacataaagccaattatggtcacattttccatcttcttcccaattcttttttcttcttctcccctctctcccttcccctcatgttggtctgccacggcaacggtgccaacctccatcgccacccccacatctccaacctctctctctctcctgtggagcagatgacgatagtgcttgccaactcaggcgatactaggtgcctcatgcacatagctctgtccgccaattttgatggtagccccaaggaaacggtcttgagtcgccaaatctccggcgccgggcttgggtctctcatcctcccaccggcagtcgtgaagacgacgacacgatgaggacgagtggaacttgtgaagacgaggagggtgtcaacctagatctggcgagaaccgtcttcttcggcaccgggagcaagcggggccattgggaggagcttgggacgggtggcagcttagcggcgagctcgagtgggggcacatcgagtttcctccttccttctcgaaccaaggtgaatagtaccaacgcttcaccggtgcgttggacaccacttctccattcgcctccctcatcgtgtcctactcgcctcctgacacttttggttcagcgaggtggagagagatatgaagaaagaagagtgatggatagagaaagaagatggaactgacatgcgggtctcacgtctagcgtattttggtctatatgatagaaaacgtaacgtcgatagcatggttgttattttgtacgtattcgtatagcatggatacgaatatatgaattgtaattatatttttttaaatagtaatggtatgtatcgagaaaacgtctagaggtgtttcagctagctccacatgatgatgagctagccgacttgaattcgaagcctcactcgtataatcatttgatattagctcattctctaatattcacatcgtagtggtatgtatccaataaattttttaaatcggttttgtttagcatattcgaaagtaaagccagctgcaggttgttttaagataagattagcacacacactaatccaattccaacccaatcaggtcgctccaaactaatccacctcacctcgtcctcgtcgtcttcttctccccacgcttgcggcatctacgcttctcacgcggactacccccgcctgcctaacagtcactgacacgtgggctccagcattacctgtccccacatgtcagtgacctcaccctagaaacccgggaggccagcgtggggcccacgtcgtcgccgtggcagctaaacacaactcgcacccgtgcgtgtcccgctctcccactcccacccaccgcccagccgacgcgacggcgacggcgacggcgacggcgacggcgagagcgcggggggagatg

SEQ ID NO: 43684 - DNA, 3116 bp, Oryza sativa
gggctgcgcggcggcgctggacgagcactacgcgcacaccatgagcttcggccggggccgtggccacgccgtgctccgcgccgccgccgccgacccgcggtgcgcgctcgcctcctccctcgccgcgcaccacgtcgccccgcgggaccccgcccgggccgccgccttcctcgccgccgccgccgacaacctcgtaagcgtcgtcgcccctcacgttgtcgctcgccgccttaattttttcccccctcctcgaatcctccatttactcggtgagcttgcgctttcgtgttgctctaaacttccaccagggtgcagcgacggagtacgagagggcggtgttccgcgcgctgtcggcgctgatcggggaggagagggacgagcaggtggcgatcgagcggcacttcgaggtttgggggtagcttgtctccattttttgtaaattgagagtatgtgctgctggataaattgattaatggcaagaattgattggtggtgtgtgctttacatgtggcagttgctgaaggaattccccagggatctcatgtctctaaagagagctcagctcatctgcttctacatgggacgccctgatacatcgctcaaatttgttgaacaggtaagttcactacaaaggctcgtgtatgtttatatgcttacaaagtggaaatatcgtatataactaatgaaaccgaagttgaatctaacactgtttgttattatttaaaggaacacccatggtagcaactttattgaatcatcacttcaaaactttggataaaaataaaatattttacaacagttgatcaaaaaagcatcacttttagtgctgggattttgtgtgcatgcgcgtgtgtgtggaatagaagaatgcaggattttctggatgtgcttcaaaacacttcctcttatcaatgtaccatagttctaggtactattcttttcattagctttgttgtactcattcttgatcaggttttgccagagaatcaagaccagaactacatttacggcatgcttgctttcccattactagaacttggaaggatggatgacgctgaaaaagctgctcggaaaggcttggccataaacaagaacgactgctggtcacagcataatgtatgcgggtggttttgacataattttgttattttaagaagtttatcggcataacagattgtgttatgcatttatacctaatcgttcatattctaccgacaaacttctttaatacaagcttcatctgccattccatcttgcagctgtgccatgttttccagcaggaatgccatttcaaagaagctactgagttcatgaaatcgtgttctccatcatgggcagcatgctcatcgtttatgtatacaattttccacatgatgctctctcgtttgatgctagtaataactaataaccacagaaatagttcttacaaaatcattttcttctttctgtaggctaacccacaactggtggcatgttgctgtttgttacttggaaggtgaattccctacaagtaaagttctggagatatacgatcataacttcatgacagagcttgagaaaagtgattgtgaggcagcagaggtattaatgctggccatttttcctgtacatcaatgttttagagacactgagtaatttctcatgcatcaggtgtaccttaatgcactagggctgctactccgtttgcatattcgtggtcaggttgatctggccaaagatagattggcagcattgctagatgcacttacgaatgaggtactgtctcagcttcaataatttcaaatatattcgtaaaaactgttcagatttaagcttcaataatttcaaatatattcataaaaactgttcagatttaagtaagctgtatactgctgactgccaagagcattttacaggtctgaactaaagctgtgcaggactcatttttctgactatttcgatttgaactttgtactttgttcagaaaatatggcatgtggaatggctccttgatctacttgtattatgggcactgtcaagtatgggtgagattacaagagcagacaacttgttggaatcacttaggtcaaggtcagatacattaaacttttcttcagggaacacaagactctgctattaatactagtcaataatgctagaataacccattaaccttgcagagttagttcgatggacacaaaaaaacagcaagtgatgcaaaaggcaatccaggtatgctgaattctgtttgcaagattaagtaccaagacacaagcaatatataactcatgcacaatgaaaagtgtggactatcatttgtctagtgtttctgaaaaatgaacaccattcacttctgatgcctcaatatcattacattgtatgtttttgtggcattactattacctgctaactaattttaagatatgtttgctttcctgtagctattagtttgtaatttatttaactttttacatgcatgcctactgtactgttgaggagtattttgaaagataaaattgcatatttattctataaaagatactatatttttgctgttatttaattctttccttggcacagctagcagaggctgtgtatgaatatggaaaaggagagcacaagaaagtctttgacatcttgggtccagatttcgatgcactcagttgtaaagtatgattaacaaacctgttttcgttcaagacaagtagttatcgtatttgttttcttttactgaacatcaacatacgtacaagtagatgattggggcatcagatgagcaagtggatgtcttcaatgaagtttggtacactgtgctaataaataccggagagagttccagaggtatttgcctatttgttcttcatcattagaaaactaaattactgttttgtcgctccttaaggagctaatgcaatttggattgtacacagcaattgaggtgctcgagaaacaaattaggaaacgagagggtgcacccttcttgtggcgcttgctggtaagtatttactatttatccattttgcattttcttctcgctaatgtttcttaactgacttgttaaagatccgaaacattaactccaataatctttaaaatatcttgtcatgacacgtaatgttggttgctatagatcgatg

SEQ ID NO: 43685 - DNA, 5459 bp, Oryza sativa
  unsure (1)..(5459): unsure at all n locations
ttgcctgaacatagcatttggacaacaatctactagtactgtcaaataagttggtggctgtgctataggcaaaatagaaatatttgcgtcaactttgtatcatctgtagagactgctggcatcatctttgcatataagcagaatgctacaaggcatttgagattaatacgtgtttctgtctagtatcaacacatcaactgatatctccatgccaaatgtaacatgtgaactaaggaatgaccttcggtgcaatcttggcctaaccttggacttcttgcaaacttattttatcggccagaccaattagtaccattctgatattcatcccaggccctattctgaatacaactaccctcagggtttgtggctttaaaaaggtcaagccaattcagttgttgcttggtaatccgtaatcatacagaagacactagtgaggtacacatatttccattgtatttctaataggatttagttgttttctctctaccaggagaaggcatactcattgcatggcagagctgcagatgcttcagtcgcatccgaaaaggcaaatgctctacaggctgcttattctcgttaatttcgagttatgaaatacagtataccaatatgcttacatgccctatagagtgcacattcgctgtttgacataataagtggccgcgaaccaatttatatatgatttgatgggacccttacgagttactccctccgtctcaaaaaaagacaaatattgggtttccgtgtccaacgtttaaccgtccgtcttatttaaaaaaattatgaaaaaaattagaaagacaagtcacataaagtattatcatgttttatcatctaacaataatgaaaatactaattataaaaaaatttcatataagatgaacagttaaacgttagacacggaaattcaggtttatcattttttaggacagagggagtacgaccggaccaatgagcaaatatgttgttttttcactcttgttctatctgatgctacgaggaaattgtgcccagcgttccctgcactgctgtcgtctgacagcattggatatgacaaaggaatggatggcagctactccctccgtttcatatgctttaactgaaatggtcgatttttttttaagtttgacaaaaatataaacattttaaacacaaaacaatcatattatcaatatatattaaatgtttgttttagttaaactaatttgatgttatagatgttagatatttctataaacttgatcaaactttaaaaagtttaactaggaaaaaatcaaagcaacttataatatgaaatggaggaagttgtaatttggtgaaatcatggattttcactccacaaaactgtgtgtacaagttctacgagattttgaaaatactaccacaagcagggaagtaccttgtactaccatgcaaaatttcaagagcaaaggattaaaaagtggttgggcccacgtgtcatatcttctctcatcctctattgccctcttctcccgagctcgaatggcagatgtggcagtggcaatgaggaggctgctgttgtggggaagaaaaagagagatgagggaggggaccgaattaaatttgaaactatactgtttattcaattttttgctagaaatattcgggatgcaaaatcttttacaaaaatataccatcggtttcgcacaacaattgcgcgaaaatgacatgaaaataacgtcgcgaccggtatcgcacaatgaaaatgcgagaccgcacggtctcgctcaagcaaacagcgataccgtgccttgccgatttaattagcggttaattatgataattaatcactaattattattagttaattgttaattaattacttaatcactaatcaaatggatcccattggacaatatcgctgatggcttctgcgagaccgttcggtctcgctcttccatcccacgagacggtctcgcgctgttgccgcacgagaccgtgcggtctcacgctttcgccgcgcgataccgtccgcgacgtcatccccacgtcatttttgcgcaactgaagtgcgacaccgatggcatatttctacacaagtttttgcatcccgaatattcctgaaaaaaagtgaatgaacagtatattttcaaatttagggaccatgacggagctaggctggtggctactggccatggctctcttctttggtggcggtggctgcggctacttccggtagggtgtggcgggtctcggcgatggtggcgatggtgacggcggcaaggtcacgaggcagctgtggaatttaatgttcaaaatttgatactgttggcatattttatggatcatgtgtggccatgtttgtgaaaaagaccagcataacatctaattaaacaacccacatggcacacattgatatattttgaacacacgaagtgaaattcacgatcagggttcacaatattgatattggatcaaaactgctccccagcggtatcttcggattttatgggaaaccatctattaaaccgataaaatcctaacaaatcttgtaaaaaaataaaaatcaacttgaccgaaaaattgagtggtttatgtagtccatgtttggtttcaatcggttctgtaaacaccgtttgtgacttgctttgcaattttacaaaataagtaaataaataatactccttattctttgtgtcgtctgttacatagattgaaaataagtctctttcgcatccctgaacttcgtgctggaccgtgctggcccagcttgccgaggtagtagcccaggcacagcacagctatcgggccgggccagcatgggtacaacccgactcccgagtcgaaccgtgttgtgcctgggacgggccaaatcaccgggccttgggtcaggccgtcggacctcgggccatatggccatttatacttgaaggttctgttctttgttatttttatttatagtttgcatacacttgtggtaccgcatcctttaggctacggtcgtgcactcaacccagtccaggtcagtcttctctctattcttcaatctgcatccttattttgcatttggtagcagttagtctattagaaaagacgagcagtcctttaaaatcatttaactccagtctagtaagtccactccaacctcaggtgctgtcctctctttcgctgttcatgcccagctaatctggaaatgctccaaacttctgattccccaactctaggtcaggtcttcagttcttcaccttgcactgtgtaatattgagtcgattaggattttgctaatctggattttagtttgttttagtctaatggattactggacgaagataagcagagcattgcaatcgttttgtcaagttcggtacaatgaattcaccctataaatagtaggagccagagctagtatattagtaattagcaaaataatttgttgtattgtgcttggttcgaatgtctttgttatgggctctaggtttctcacaccaattgaatgaattagatctaaaaattagggatgttgttagaggagggcacaactggttgtgcatgcaattttatggttgaaaaggcacaattggttggataggagtacactgatgctaagaataacctatggttgaaaactatggtattgaatgctaaaggataatgcgttgtggagttaaaatttccactaaattctgtatttttaattacatagaattataatagatcatctgcgtaccggtgagccagggcggccgcccggcgatggatccactagtgagtagacatggatagttttagcctttatgtttaagccctactaggcttgaagagatcctggcccaccactgatcatagatcttcgcccatatctgcttcaaacgagtacggatccttagtgtagaagatgtgccggtcaaccttatcctccgttgatctcttcccatatgccttcagtagctggacgtgctggatcttttcccactcatagctgccatcttgcaaggatatgagtttaagcaatcttagactgcagtaacgtccagcttatttagctctgtctctcgtaggtactctgggagggcatcagcatccaaatccttccaaatgacgctcctaagtgattgcaaatccttcactaccttcagccctgggcatctgataacgacgatatgtcgcagtcttggactgttggagatcctctgcagcttcgggttgtcagctgacgtgagctccacaagtgacgggaagttctctacggagatcaggtgcggcgcatttctgagattcagcacccttagtgcggttgcatggtgcacaagtccaagcggaagataacgtagtttacaaccggtgatggtaacaacgtctaaggcgggcatccctggtgtttgctgatcccagttctacactctccatcccaacatcccctttaaacccagtgtttctagctttggaaatgcaacaccagcatcaccgcgagaaagaccatggagctgcagcttcntagtgatccttgttccagttgtgactttctggtcatcagcactagaggaggagaggaagaggagatcatggccaatgctcacgatggatggagcatgatcaatccaaatataatcaagaaaagggagctggcccaagccgacaggcagctgcttgcagcatacgtagtccttcagctccaaacgccttaagcttggaaagtccgacattgttctcatccatcggggtagtcgatatccaaagtaaccattgaccgtaagacattctacgcaaggcggaggacagagattactcaacacaacctcggctcgttcctgctcctcgattacattgctggttccttcgatcatcccgttgtcggtgagcctactggcaaatgtcaagtctaagattttcaagtgctttttactgttgagcattgctgtagcagccatagagcctgaagatgcaagctctagacctcttaaatcaagccattttaggttcgacaaagaccgtagttcttccaagctgctccaggcatgtcccctgtcatccaaataagttgggaaccccaacatgttcaccaagttttctagctttcccatacctggaggaattgaggttaacctcgtgcccctgaagtcgagaaacctcatattctgtagcttcaagatgctgtcaggaagctgatgaaaattccgacaccccataaggtcaatgaactgtagaaattttagatttcctatgcctcgagggattgcagatatgcctgtatttgcaagccccaagtatcttagatgcttgagatggcatatatagtccggcaggtcaacaagatctacaccttgtaaatgtagtactcttaggcaagagatattgttcctgaaatacgtcaactcagttatacatctcccaaagagcaacaatgtcctcaatgacacttgcttttgtatagcgacccgctctattgcagttttggatacagacaagtgacgcagctttgaagcacctgcaataccatg

SEQ ID NO: 43686 - DNA, 24585 bp, Oryza sativa
gaatagtaatgtgcatctcactaattagtacttcctccgtcccaataagaacaccggataggacatttcctagtactacgaatctagacaggctatatgtccagattcatagtactaggaaatatccagattcgtaatcctagaaattgtcctattcggtgttcttatattttgggacggagtagtacagagatacacatttctattctatattcaattattcccagtactaatactccctccgtcccacaatataagggaattttagtttttacttgtaacatttgaccactcgtcttattcaaatttttttttgcaaatataaaaaacgaaaagttatgcttaaagtactgtagataataaagtaagtcacaaataaaataattaataatttcaaaaaaaattgaataagacgagtggtcaaacgttgcaaggaaaaactcaaaatcccttatattatgggatggagggagtaataattagtactccctccatctagttttgatagtcatatttccaaatctgaaaaatttatttttaataggcatatttcaatccaacaacctatcatcttaatgattttctcagatttaatgcgtgactcttcattcttccacacaagattggctgcatgggcatcgagaaatgtaaatattaatgaatcgcttgttaacgagaaataacatgtttaaatggatgataagtagaattacttatccttggtcagtatgccaaaataaaatatgactattaaaattagatggagggagtaattagtaatgtgcatctcagtactaattagtaattaactagctgggtagcccgcgcaattgcgcggctagcacccaaacaaaatcatatattttttaaatatgattttacttaaaatttatttaatagctatctcattgtattaagactttgaaagaccaaaacttatcatcctcgtgtttctaattatatagttttgaaaagtcacaccagttgctacctcttatgctatctctttctttatttgcttgctcgatctaccactatttctatccattcttcttggaacatttaaaaattggattttgtagtttttagagtttattgtcacgttgagtttcatttttataatttctagatgtcccgtcaaacgttgccattacactcctgtacggcccgtccactgtctcttctctttattgtcattgagattttaaaaattgaacataattatcgtttgggttcatttttactttttagaagtcccgccaaaccgtcagtagctttgccattgtactcctctatggctcgtccgctatctcctttctttattgtcattgagattttaaaatcgaacctgattatcattgttttttttttactttttagaaattccgaacctttaaaaaatgaacttgttgttttattttttataatttttagaagtcccatcaaacgaggccactatgcccctttacagcccgtccgccgcatactctttattgtcattgtgattctaaaaattgaacataactatcattggaattcattttttattttctagaagtcccatcaaccgtcggcggctctgcaactatactcttatacaccccgcccgctgcttctcctttttattgtcattgagattttaaaaatcgaaatgattataaatgttttttttactttctagaagtcctggccaccaccttacttgtttgcttcacggtctgcctgacgtccctccttttaatcgtcattaggattttatttgatgttttattaacaatttttatatgtcgtatcaaccaccaccactctacttctttataggcatgttacttaatttatttcgtcatgtgttttagatggtcttttattttaatagtctttatttttatcacaaattttagttatttaaaaattgtattcctaattgaaattttatttttctttttctaattccagaatttatttcataaaaaattagctaatactgtattgtgttcttttaatgtttttatttttttattttcaattttcgttgttttataattgtattcctacttgaactctcttttaatttttctaattttggttattattttattttttattctaaattttaattaatctcgtattgggttcttatatggattcttcttttaatattgcttattttcaattcctaattccagctaattttaaattgtattcctacttgaactcttcttttattttcttttgctaattttggatttatttttatttttattccgaattttaattaatctcgtattggattcttatatggattcttcttttaatattccttatttttaatttcgaatttcagctgtttttaaattgtattcctacttggattctccttttcttttctaattttgaattttattttatttttatttcgaattttgattaatctcgtattgggttcttatatgaaaaattctttcaatattgcttatttttaattaagaatttcagatttttttatattgtattcctacatggactcacattttctttttctaattttagattttattttatttttatttcgaattttaattaatctcgtattgggttcttatatagaaatttctttcaatattgcttatttttaattcctaatttcagctcttttttcgattgtatttctacttggactctctttttcttttttttcttttcctccgattaatgtggaaatttctagcctccacagcgaacgtggtgccttcttttcgagctgtctgatagtagatagatagatagatagataatagatagatagatactatgtgatagtcttacctgcttctttagcagtgaccaagaatcacctagatccagcttctcaacccggtggaggtgctgggctctcatcccacgagcaactccgtcgttcctcgtcgtcaccaacactcggcttccaggagcacaagcaccgagcggtgctcggagcagatcgctccacaccctatcgctccacacgtcatccatcaccagcaggaacctcttctgcctcacggcatgcttcaacgtgtcctcgagcagggccttgtccccggcgcagccatggtagcttcccccaaacgcggcgatcacgccgtgcaggaggtgaacctcgttgacctcctgattcacgctcagccataccttcttgtcgaagtggctctccaacacggcgtcgttgaagaccatcctggcaagcgtggtcttgcctatcccccagcgccggtgatagcgacggcgatgacatcgcctgacgatcttgcgcgcgtgcgaccatccgccagcttgttgccaatcagcagatcaacgaggttccttgtgtgaagatctatcttgtcgccgacaacatcggatcgaatgatggatggtcccgtcttgcggttgcggctgctttctgacgagcaagaacacatgggtctatcggttagacgaagggccgaggaggagtggattacttgggagacaaatccaaagcgggagctcctcttcgcgatctcctccaccctccggttgagctcctggatcttcctcccgatcttgcgcgtagcggcagggctgcggcggcagagggcgctccagcacgccgacggcgccggagcagctcttggcggtgagccggggtcttctccgccctccatggcgcggaagaggtcaaggatgtcgtcggcgtcgtacatggcgtccttgagctccctcacccaccgctccacgcccgggtcgtggatgcgcctccggtcggcgtcggccaggatgctgctcaggtcggcgagcgtcgtctcgagcttggcgatcgcgccgggcacgcccaggagcgtctccacctcctccttcgccatccccaccaggacgttcgccagcttggccgcgaatgcttccagcgccgccgccatgagcagagaagatcagacccccaatgacaatgttgtgtatcgctgcaatgataggggcgtgcattttttttttattctccgcagcatgattttgactttgacttttttttcaagtcgtcacatcaatatacgaatatatatatttaaaatctaataacaaaataaattgcagattccattagaaaactgcgagacgaatttattaagcctaattaatccgttattgctaaatgtttactataacatcacattaccaaatcatggtacaattagatttaaaagatttgtctcacaattattttttacctatatttaatactctattcatacgtttgatagggtaaaaattttttgttttgagaactaaaaagggcagcgatcagttgactttcctgtactctaaaaaaatatataataacggtggtaagtaataaatctgttcactccatcaccaactcattatcttttttacaatggaaaaaggacgaatggggtctcagaacccacattaaaatcacaactttttttaagagaaaaatgataatgtgaggaaaaatggttcacaagttagtaataaatttatataaacaaatatcaagagatgatgtataaaaataataatattaacaatggattaatgatagttttcattaattaagtgcaatgcgcgggcaatatgcccatcattaaaaataagccggttgagccatccgagaatggataataacattcgatcccgctaatctaatctaatgcagtataagtaaatatataatttcttaagtagattttcattatgggtcatcttttattacccatgtttcgctttaacatactttaaccaatgtatttactttggacgaggtaatcttgactttgttttattttggattatccttttttttaagcatatgaacgatgttgagtacatcggctcctatttatcaataaacttcctcagttgtatggtgtagaccgtttaaattttaaaatatactgttcattcaattttttctcaaaaatattcggtatgtaaaaaattttacagaaatataccgtcggtctcgcacaaacattacgtgaagatgacgtgggaatgacgtggcagacggtatcacgcaggaaaagcgcgagactgcgcggtctcgcggaatgaaagagcgagaccgttcggtctcactgaagcaatgcgcgataccatgccatgccgatttcattagcgattaattatccttattagcgtttaattaattattaattattaattcgttaattatgataattaatcactaattattattagttaattgagtaattaatcactaattaaaagaagctgtcagacagtgtcgctcgttgcttcagcgagtgtcgacgggtgatacccgtagaacggatatagagggtattggggtacgttggtacaaggatctacgtaatacgacatcgagcaaacaaaagacgaggattatactggttcaggccccttaataggtaatagccctaattcagttgatatgggattatatgatggaaaaccacaggttacaaagggaacgatggaactcgatgaaaccggcgagatcgtaatcgagttggttcgactagatctcccggcgacttggctcctgcaggctccgacttcgtaggctgtgggggtggtgttggctgtgagattcgatgccttaggtcttcccagggggtcccttttatatcgcagatcaggtggtctccagtagaactcggagacatcggaccctacacgatacattaacgaccctgtcttgtccgagtaggactcaaacactgtggagaatttccttagtgcatgcagataatgtccgtgtatgcgcgggtatgccatgtcgatatgtggcgcatatcgaagggtaaggggtatacctaatccgtaaccctgacagtagcccctgatttctgcttaaatgaactcgtgcgaccaatagcgacttctgatgtcgagactgatgtcgttctcggtgtgggaaccgtagagacaggacatgatcgagaacaccgtgtgaagcccaacggtcacgagtgaatttaaactgaagtctgaaaaactgccgcacgtaacggacccagaaatttccggcggccatctctctcctttccttggaattcgcaccgtcggtagtgcgtctatttaaaggaattttggggatccatcttgaagtccgcccaccatgcagaaaacattccgcctgtaagcgctcttcgccttcctcgctgccacaagaaaccctagttttagcaacatatgctctttctccggcgatcttcgatcagcgatggacctcggcaaatcatcttccaccagtgcgtcgctgaagaagcttcaggaagacggcgcccttcctggtcgtggaagcatggagagggaagcaagaggtattaatccccagcccgtcttaggtcgcatggttgcgatcgaagtctatattctctgcggttttctccccccgccttccgaatttcttctcctggttttgaacttctatggtctttctcttcttcatttgaatctcaattctatcgcctttcttaacatctttgctcatctttgtgaggcctacattggggtagagccttttcttgatctttttcgcttctactacgagttgcgttggatggagtccaacagggtatctggttgcgttgggttccgacttcgggatggcctgaagtcgcgttatatccccttccagtgcccttcttctcgcagcaaatggtggaatatgtggttctatcttgagatcaaagattcagaccttgtcttcgttgttcccgatgaacaaccggacaagatttcgtcttggactgcaaagccccctttgaccccctatcttcagtcgtttatcgacatcatcgacgatctccgattacggggcttgtcggggtatgaagtcgttgcagacttcgttggtaggcggatccagccgctccaggctcgggcccatccagcctttaaatattccggaccagaggacgcgacccgggtttctcctcggggtatctttctcgcatttatcctgacatgcttatgttcgcgttccccttgatttatcgaaacttggttctcgtttcataggtctgaacagcgaaaccgtggagcgccgcgtcggccaggtgatgatcagtggtccgacaacggcgagtaacatcctcgtgcccctttgtgaaaagggggcggctgaacgtgatgacgctatcaacgtaagtatactcgataggcatcccgcattttcctttcgagatcaccttatgacttgattaagcgtaggctcttcctctgactgacatcatcgggccgctcgcggaccatcaggtggcagcgtctctaaaagagaaggtcgccaaggaggcgtctgatgctgttgcggccactactagtggtgacaatgttccgacaaaggggaggaagttctcctctgtaagcggacatcgtcgcaagacatcgaccccctcggtaagttatcctgtcgccagatcgtgccgccagaaggattttgccttacttcgcattggttgtctttcaggcctcggacgcgtctcccccgcctccacgacgacaatgtcttgtgacggttggcgagaagtaagtagatggatttttaggtttctgtgattccattcaagctttgtctgatccgtggtcgttccatagggaggcgcgggcaaaggctgcgcaaaacaagtctggagggacttccagcgcgtcgcctgccgcgccctcaacggatgtcgtactcgtagccgagagtcgggaggcaacgcctagcggcccagtcagcgatcccgcggcaggtcgtggtccacccgctgccgtcctcacctgggaggagctccaagtcgaaatggggcgcctcctcgaagctggtgctcgcggcattggccgcgagattgcagaggcgaggtcggaagtagtgttggcgaatgcgcgtgctgaccggctggtgcgcgagttggcggaagctcgtgaagacctcacgaagatgagggaattggtggccggcaacgagcgacaacgacaggggctcgaggactgtatgtcggaactcgggaacaacctgtcggaaatccgaggctcgttgcgggtcacctacactggcctgcaccagcttgccggggagtgtggcatcaagtctaccatcccggtgaatcctgacgaattctcgctgacatcctcccttgcggaactggcgacggcgatgggggagatcccctccaagcatgcggccaggatcgcggaggagacgtcgaacgggatctacaccggggcgtgtcatgtcctcgcgtgtgtaaagctgtcgcgtcctgaactcgatctgcgtgagatcttggatcagggggcggctagcaacacgcgtaagaaggtgatggaagaagtcggtgatctgggggagtctgttctccccctatttgaagagtaggacttcttgtacttccaagacacgctgtgtaaaacttgaattctgaccgccttcgtgcgagcaattatcattctagtttactcttgtatgttgacctcgggaacttttgtcctttgtagagatgtcgatgtcgaggatgtccagcagcgtgggcagcctaaattgtcagcgatccctccggatcttgcgtctgtgggacacgcgttgctggacaacgtgggtgaaattttgcccgcgaggacagggacaacgacgacttccttaggtttgtggtctcttcatcacttttcgctcctccgatttaatcagtcgtgttctcgagagagagaagcagtctgacgtagtcgtttccgtgttggacagacctcgaggacgcacttgctggccaagatcgtcgtatccaatattggaagacgaaatttgaagtggcggaactcgagagagccatgttggaagtaaaaaaggagcaggccgtggaaacgctccgaggtcgtgaggtgtggtttaactcgtatttgaagagctgctgcacatccatggccagagtttgcagagaacttcgagtggtctgcggagaacctgaggagtcggcggctggatacatctcgtggctgaacgggtgaaggcgtcggcaagcggattgacgaagctctgaaacaggagtgccgtcggtcgagccgatatgccggagggcatgtgttggcttgcatacgagatcattgtccgcaaatgcacctcgagtttcttcatgaagggttcactcgttctcggaggactcctgcggagatagaccacctggcgaagtcgatggcaccgttagcggagaaggttttcaagtctatggactggcgttggccttcttggtagtattcgtacctctggatatagtgtgtaagagtgtttcctcagttcacgactttggtcagtcgtttgagtcgtacactctccctagcccccagccttgtcgtcggaggattcttctcgggggacaaggctcttggacctttgacctgccttggttgagaaagcactgatcctagcccccagccgtgaagttggaaagttaattttccgattacacggcttggttaatacgcacggcgagaactcttacacgaccaggtcttacatggtctttcgtctctacaggatccgacaaggccttatcggctctgggcgtccccagccgaagatcccttaggttcctcggaggccttgtcaggacggcgtaaagggacatgaggataggtttcaacgctaggtgtcatctaggtaagggatcatcaggcaggaacactgtgattgtaatatgtgcctaaaaataggctttattgatactgtaaggtgtcttacaggtatggattatattgactcatacatagaatttacgtagttggtcaatgttctaagagtttgccaactcgcggccatcgccgtctgctatcttgaatgcacctggtcacaagacttgtgtgatcgtgtaaggtccttcccatttgggtgagagcttgtttcgccctgcttggctttgaacccatcggaggacgtagtcgccgatcgaaagtatgcgtgctcggatgtgcttctcgtgataatggcggagggcctgttggtaactggctgctcggactgcaactcgttcgcgatattcctcgagtagattcacatcgtcgtttccctgttcctcctgatcctcgtcggaatacttctgtactcgtgtactttgatatcgtagctcgctggggagcatggcctcagagccgtacacgaggaagaagggtgtttccttgttagacgtggtcggtgtggtgcgtacggcccatagtactaatgggagttcttcgacccatttcttgtcgtgtgacatgagcctgtcgtagacacgggtcttgatcccttgtagcactatgccgtttgccctctcgacttgtccgttgctttgaggatgagagaccgaagcgaagcatatcttgactcccagcccgatgcagtaatcttggaaatcggcgctgatgaactgggagccgttgtcggtgatgatgcgatgtggtagtccgtatctgcaaaatatccctttgataaatttgatggcgttgtcggccttgatttcccccgtgggtatcgcctcgatccattttgtgaatttgtcgatcgccacgaataggaacctgtagccgccctgtcctcgtgggaatggcccgagtatatctagcccccaacacgagaacagccaagtaagaaggatagtctggagcgcttgtgtgggtagctttgtgtgtttactgtgaaattaataggcttcacaccgctggactatgtcgcatgcatctttgagggcggttggctagaaaaacccttgttgaaaagcattcccgaccaacgtccgaccggcggcatgtgacccacagatgccttcatgtatatcgaggaggaggtgtctaccgtcgtcggacgaaacgcatttgagaagtaccccgtttggcgctttcttgtatagatcgttgccgattatgcaatagatttttgttttacgggttattttctcagcctctgcgtcatcctcgggcaactcatcgctgttgatgaatttgatcagtggggtgcgccaatcgtctgtggtttcaatatcggcaacgacgcgttctgcctctgtggcctccgagctgatgtcgggggcgtctaggttaacgtcgccgctgacctcttttactgatggttttgtcaggacgtccagaaaagtgccgggttcgagcggttctcgtctggacgcgcgccgtgctagatcgtttggctcgatgttgtccttgcggtatacgtgtcggacttcgatcccatcgaaccttttctccagcttcctgacttctgcgagatacttggataactcagggttagagcatttataatctttgtgcacctggtttgcgactagttcggagtcccctttcacgatcagtcgtttgactccaagtgcggctgcagctcttatcccggcgagtagtccttcgtacttggctgtgttgttggttgccctgaagttgaggtggattgcgtgcttgaattgatctccggaaggagatgtcaagatgaatcctgcccctgctccttggctgttgagtgcaccatcgaacgccattatccacgtttcattgtcgatttggttgtctgatttgttatcaggcatagtccagtcagctacgaagtcggcgagcacctgggacttgatggctgttcgtggcacaaagtggacatcaaactggcttagctcgactacccatttcgcaatgcggccgacaacgtctttgtttctcacgacttcgccgagagggaaggaggagacaactgtgactctgtgggcctgaaagtagtggcgtagctttcttgacgtcatgattactgtataaagcagcttttggatctgaggatatcttgactttgcgtcgtggagagcttgcgtcgtggagagcttcgctgacgtagtagactggtcatcgtactttctctctctcgacgacaatgacggtgctaacggaatatggcgtggcggcaatgtagaggaataattcttcattaggttggggagcaacaagtacaggggggtttgataggtagcacttgagtgcaataaatgcctcttcggcttccagtgtccatacaaatttgtcttgcttctccagcagagcgaagaagggttgtcctcgttctcccatcctagcgacgaacctgcttagtgctgccatgcatccggttagcttttgtactttcttgagtcttgtgggcgacttcatgttctcgattgccttgatcttctcgggatttgcttttattcctctgccagagacgaggaaaccgagcaacttgcccgacggtactccgaacgtgcacttcactagattgagcatgaggcggtatcattagaggttgtcgaacgtttcccgtagatcgtcaatcaatgagtcgcttgtcttggtcttgacaacgatgtcgtcgacgtattcctcgacgttgttgccgagctggttgctaagcgcgccctggaccgtgcgctggaaagtattccctacggttatcagtccgaaaggcatcttaacataacaaaataccccgaacggcgtgatgaatgctgtcttctcttcgtcctctttcgccatgctgatttggtggtagccagagtaagcgtcgaggaagctcaatagctcacagccggctgttgagtccaccggttgatctattcgatgaagagggaagtgatccttgggacacgccttgttgaggtcggtgaaatcgacgcacatcctccattttccgttggcctcccgcaccatgactggattggctagccactctagatggagcacctctctgataaagccagctttgagaagtttgtcgagctcttctcatatggcttgttttcggtctggtgcaaatcgccgcagtctttgctttactggcttcgcatcgggtcgcaccatgagtttgtgctcaatcacctccctagggacccctggcatgtcggacggctgccaagcgaacacgtcagcattgtcgcggaggaaggtgatgagcgcgagttcctatttctcgcttagtgatgccccgatcttaacggtcttgttggggttgccactagtgagtggaacgatcttgatcgcgctgtctggtttcggcatcttgtttgtcttgctcactttcttgggaggctcagttgtggcgggtgggctgggcgtttgctcgaccatgtcgaggctcgacttgtcgcattgtaccgctagcttagcgttcccttgaatagtgattgttcctttcggtcccggcatcttgagcacttgatatgcatagtgagatgcggccatgaacttcgcaagtgcagttctcccgatgatggcgttatacgctgtatcaaattcagcgacatcaaaggtgatctgctctgttcggaagttgtttgcttgaccgaaagtcacaggcaacgtgattttgcccaatggtttggacgaggactggggagtaattccatgaaagggttgatcggtaggtgtcaactcgcttcgtgggattcccatcgcgtccaaggtgctggcgaaaagaaggttgattgagctgccaccgtcgatgagaactcgcgcgaccttgatgtttcgaatggtgggctcgaccacgatcggattgcgtcctgggatgacggcagtcttgggatggtcttcttccgagaattctatcttctgttcagaccacttcatcttgggtgcagccccctgccatgtcgagcagacttcacgttccactttcttgtattctcgcttggaggagtacgctgtggagcctccgaaaatgtgtgagacgtggaggtcggagtctggatatgctgagtctgattcctgagcagccgcctccacatccttttcgaccacgcgtactcgcttgcatttttccaacgccatatgtttcttgagcgacttcttcaaaacgaggcagtcttccaaagagtgtctatccgtcttgtgtattgggcaccatgctttctttgcgtcgctaccctgtgggtctaggcatttggatgggttcgcgtattctgctgcgagaacttctgcttgagcttttcttttcccactcttgcgactttaactctagtcgtgatgcgtcttgtcgccaactcctgggtggtatagcgatctcggactccagacttaaaggcgcgaattacagaagcgtcggtgatctcagggattgtattcctgcactcgttaaagcgccgaacaaattcccgtagggattcacccgagttatgtgtcaacgcatgtaggtcatcttcaatcgcgtggcgcttgtaagttccttggaaattggcgatgaactgctgccacaggtctgcccacaaagaaatcgagtagggcgggaagtgcatcagccatgagcgtgtagagccttttaatgcagatggcaaataatttgccaacgcgttgtcgtccgctccggcagcatagagtactgtggagtagacttgaaggaattcttctgggtcagtactcccatcgtacttctctattgctccgggtcggaatatctcaggccatcggacatcacacagggaacgaccgaaagctctacatccagcgctgggggcggtgggttgtcggcgatcgtgtgtccttcgtggatgtctgtctgacgatgaggatgaataagaagatgacgatgacgatgaatcgcttggttccggtgtgggattacggggtcgtcggctgggttctcgagaatcctgtcgtcgccctccgttgttgtcccggcgccgatctccgtcgtcctcgtcgttatggcggcgtcctcgaccagtatcgccctgcgtacgcctctcgcgatcatcatgatcgtggcgattgtggcgattagcgcggtctcggtcttcgctcgagcggccctctcgttcttcgcgatgtcgggaagagacgcgatgttgggagcgattcccgtcgtctcgcatgcgccgtgcctctcggcggccgttgagatggtcacggagatcgccggtgccacgaggtggaggggtagcttgatggggtgactcccgctgttcgggattttcgccatcgacaccgccggttggtggttgttcccggtgcgtagcagcagcggcttctttgaacgcgtggctgaggttggttactgattcccgtagccgttcctgccaccacgcgagatcattgttcagaacgggatcgtaaggtctctctctcagtattgtgttaagggtcctgatgtgctgggccggtgtagtcacttgattttctgcctccgcattagcgtgtgctgacgtgctggtcccgtcgatagctaatacctcgcgtggcgtactcgttggagatgagctgtagtcctcgagtagatgcaggactgatggttcgtgggaatcgatgtcgattacgccgacgaatcgatctgagaccagcgttcgttgttccttgtcttcatctctaagggatatgcctgactgttggtccttaggaggtgacgtcttcgtggcgctgagaaagaccttgcagcttgagaggtcgtgattctttgtcttgtgaataggacagtaaacatcacgcgttggagaaatacgctgaattccacgctcgttgcaagcgcgaatttcggcgcggacgttgagaaaaacccagcaggcttgcaaagtgtgtttcctggttttgtggataggacaccaggaccttgtcgcttcagaagttgttctcgtcggctcgtggttcttgtcggaacaacaaggttcggccgcattagaatccttctcgagcttagatgttgtcgacgttctgttctccgcttcggcgggaggatccttcgacacggagtcgtcttgggttgcaaccactgcgttctcgtttccggtcattgacggaccggctgagatcggtatcgtggtgtaaaccgggaagacgatttcaccgacttgagtccacaccaacattgttgaagcaggaaacccgtggttgaggttggtgttgacgctgttgtcaacgaagctggatgacatagtagtagaaccttgagcaccaagtccccctacctggcgcgccactgtcgacgggtgatacccgtagaccggatatagagggtattggggtacgttggtacaaggatctacgtaatacgacatcgagcaaacaaaagatgaggattatactggttcaggccccttgataggtaatagccctaatccagttgatatgggattatatgatggaaaaccacaggttacaaagggaacgatggaactcgaagaaaccggcgagatcgtaatcgagttagttcgactagatctcccggcgacttggctcctgcaggctccgacttcgtaggctgtgggggtggtgttggctgtgagattcgatgccttaggtcctcccagggagtcccttttatatcgcagatcaggtggtctccaagtagaactcggagacatcggaccctacacgatacattgacgaccctgtcttgtccgagtaggactcaaatactatggagaatttccttagtgtatgcagataatgtccgtgtatgcgcgggtatgccatgtcgatatgtggcgcatatcgaagggtaagaggtatacctaatccgtaaccctaacagcgagaccgttcggtctcgctcttccattccgcgagaccgtgcggtctcgtggcgcgagaccgcgcagtctcgcgcgataccattcgcgatgtcattcccacgtcatcttcgcgcaacggttgtgcgagaccgatggtatatttctgtaaaaaattttgcatcccgaatatttctgagaaaaaaatgaatgaacagtatattttaaaatttaattcttctttgatatatgacaaattagatgcaaatgaataaaaaaattaagttgtccaaaatgatacataaaactacatggaccaaagtaaaaacattacttgaagggtaatcgatagcgaaacatcggtaaaaataagtatcttaaattcaaatgtagtctgttaaaaaagtgaagcgaataatcggaaaaagaggtatacccacccccacggcccaccccgccaagctcatcgtgtggcggagcggggagaggacttgttcaccggtgttgtgagaagaggggatctttgacgcgtggggtggaaaaatgctttgcaaatggcatccaacaaattagactcgggaagaccaacgatgaagaaaatagttttgtcacttgcatgtgagctcgctagtttaaagtgcaaagatgcaaactttggtaacaaaacatggtctaaagtgaaaatattttctattgcctagtgcaatatgcaacttgctcatttcgtcctataaaaaccaacctagcactggatttggcatattctataactatgaattttgactgattcagcttggcggacattgggtaggcaagtcacaacgttacattgggtagatttggaccatccaaaacaaatccaacggagatttatgtattattaaaaaaatttcttttcacgaactaaacacaccctaagagcagctccagtgtgagacaaaaatcaacgcacgggcagagaaaccgaaccaaatactccctccgtctcataatataaattttgactttttgcttgcactatttgaccactcgtcttattcaaaaaatttgtgcaaatataaaaaacgaaaagttatgcttaaagtaatttggataataaagtaagtcacaaataaaataaataataatttcaattttttttgaataagatgaatagtcaaacagttaaagtaaaaagtcaaaatcccttatattatgggacggagggagtagtacactataggagtcggccggaaatgctgttgggtgatcgatcgccctggggatggggcagcgatcgatcccctccctcctccctccctccacccctccacctgatttccttttttggcatcgcattactttcctatttcagtaaatttatatacctaaagttaatacgcctcaagtttacacatctaaagtttagagaccaaaagtttataagtcaaaagtttatatatccgattcaaatttgaatttgaattcaaatttttttatatataatatttctatacatctaaagtttatacatctaaagtttatacacctaaagtttatagacctaaagtttataactcaaaagtttatatacgcgtttcaaatttgaatttgaattatatctgattcaaatttgaatttgaattcaaatatttttaaagtttatacacctaaagtttatagatccaaagtttataagtcaaaagtttacatacctgattcaaatttgaatttgaattatatctgattcaaatttgaatttgaattcaaatattttctatatatagtatttctatacatctaaagtttatacacctaaagtttatagacccaaagtttataagtcaaaagtttacatacccgattcaaatttgaatttgaattcaaattttttatatatagtcataaatttttctaacttttgtttttcaaaaaaaaattgtgtggtgtactgtagtaaaaagaaaagaaggggaggaggaagggggagaagagagaggagtacagggggaggaggggcaaaccgatcactgggcgacggcaatcgatcgcccattagagcaggtacaatagcatgctataagccagctgtaaacatattttaaagagaaaaaggaagagaaagaatagcagcggactacagatctgtagccagctgcagcacggactccaagacgtaatgtatatatgacagataggaccatgtattaatattatagtaagcactattgtatgagttggctattacattagctatagatgatttggagttagtagtgagatatgctattaaacttgctcttataccctccggagtcggctgctatgtgtcagaccgaaaatcgacgccccaaaatgagtcgaactcagctgattaaacaagtgtttatcacggggagaatagaatggagaaaggaacggttggctgatagatcggcaaatgcagcagtatgggtcccacaaatcgacgccaacactggaaaaagtgtgacaagtctgtgtattcagaaaagtttggatttgatagaaaagttgaaagattgaagaataatttggaactaaacacgatggaaattggtttgggtggactcgtgatcatggacgtggagcagtcgcagaggtttggagttttgactatgtgagtatctgtcggcgcaagcaacttcaactctccgtctcttcctttttttttcccagcacagtgtgtcggcggcgatcatggcggcgatgctggacgccttcgcgtcgagcctcgcacgcattctggcggagacggcgaaggaggaggtcgaggcgctgctgggcgtgcccggcgagatctccaggctcgaggcgacgctcggcgacctgcgcgccgtcctctccgacgcggagagggcgcgcgaccgcgacgcggccgtggaccggtgggtgcgggagctcagggacgccatgtacgacgccgacgacatcctcgacgagtgccaggccgccgcggggggcgaggccgcgacgcccgttgccatggcgggctgctgctgctgcttccgcggcgtccgcgtccctgccctctcctgcttccgcgaccccgtccgggcacgcgagatcgggaagagggtcagggcgctcaaccggaggctggacggcatcgagaggaggagctcccgcttcggcttcgtctcccagactaggatcatctcctcgtctccctccccttgctgctctcggcgcgcagattcaggcgacggccgccgcaccgcgctgggcctcatccgatccgacgtcgtcggggagaagatcgcggaagacacgaggatgctcgccgacatccttgtcagtaagacgacggacctggacgacgccggcggcggctgcaatctcatccccaccattgccgtcaccggcgccggcggcataggcaagaccaccctcgccaggatggtcttcggcgacgccacggtccaagagagcttcgacgccaggatctggctgttcgtcggccgggacgccgacgaggtcacgatgctgcgcagcgccatcgcccatgccgccggggcggccagctgcgagggcctcgccgtcgccggggacaaggacctgctggagcgcgccctgcagcgcgcggtgacgcacaggaaggtcctgctggtgatggatgacgtgtggagcgacgcggcgtggaacgagctgctcagggtcccgcttagccatggcgccccggggagccggatcctggtgaccacgagaaacgatggcgttgctcacaggatgaaggtgaggtacctccaccgtgttgacaagctgcggcgacaggatgcttggtccttgctcaagaagcaggtcagtatcacaaacaaatctgatcaattgtgccaattgcaagtttgggactgaaattcggatttcacacgatgagcttcgatgtttaagctattgtagatcttgaagaatccttaaataaatggtttacaactatctactttctaactgcaattatgagagttttttttaagtaaatcacatgataaaaaagcatggttgttattaggtaaaaatgaatgttgcaggtttttttttttgttgttgtttactgtatttgagaatagcttatattcaatggatgttattaggtatacacttcatttttaagtaagatagctttttactattccaacagatagttttgaacaagagtgatgaagctgaattggatgagttggaggatattgggatgcaaattgtggacaggtgtgatggtttaccgctcgcgattaagatgattgggggcctcttacttagtaagagcagaacaagaggtgcctggatggaggtttctagacattctgcatggtgtaaacatgaagtgaatgatgaaattaacaaagtggtctgcttgagctatggagagttgccttctcatttgaagcaatgctttgtgtactgctcacttttcccacgaggtgaggtgatcgaatcaagaaccattgtccgaatgtggatcgctgaagggttcgtgcaagatagcacgggttcaggattgccagaggctgtagcagctcagtactacaaagagttagtcttaaggaaccttttggacccaagtgatgggtactatgatcaactaggatgcaccatgcatgatgttgtccggtcttttgcccaacatgtagcgaaggacgagggattgtccattaacgagatgcagaaacagaccataggtgatgcacttggtactctgaagtttcgtcggctctgtatttcaaacaagcaagtcgagtgggatgctttacagaggcaagtatcactaaggacgttgatactattcaggagcatcgttactaagcacaagaatttcttgaataatctttcttgccttcgggtgctacatcttgaggatgcaaatctgatagtactaccagactccatctgtcaccttaagcatttgagatacctaggtctcaaaggcacatacatatctgcactccctaacctcatagggaatttgaggtttctacagcacattgatctctgtggttgcataaatgtgtctgaacttcctgaaagcattgttcgactgcggaagctaagatcactggacatcagacacacaatggtatcttcagttcctaggggtttcggaaagctagaaaatttggttgagatgttggggttcccaaccgatttggatgacagtacacatgattggtgtagcttggaagagctaggatctttgccaaatctcagtgcactacatttggaggttctggaaaaggcaacacttggccaaatggcagcaagatcaaagctcagcagcaagcagaatctcacacaactggagctgagatgcactagcaggatcagcgcaaacggcaccgtgcaaggtggtatcagcgaggaggattgcgagagaatcgagaacgtttttgagcatctccgccctccaccttcaattgaccgtcttacgattgcaggttactttggacatcggctaccgcagtggatggccacggcgaccgcctttcggagcttgaggcggctggtgctagaagactacgcgtgctgcgaccggctgcccggtggcttgggccaactcccttaccttgactacctctggattgagcatgcaccatccattgagcatgtcagtcatgatttcatcctccctccggtaggcattgctgtcgatggcaacgcaccatcgacgacgacaacaacaactaagactgaaggtgcaggcattgcgtttcccaagctgaagcggctgggtttccaggggatgttgagatgggcatcgtgggactgggacgagcatgtccaagcaatgcctgctctggagtcgctcacagtggagaacagcaaactgaatcgtctccctccggggcttgtgtaccacaccagagcactgaaagctttggtgctgacgaacgccgtgagccttgaatccgtagagaacttgcattcgctggttgaactttacctggctgacaacccaaagctagagatggttgtaaactgctcgagcttgacgaagattgagatcctcagatgcccagagctgaaggcgtttgacaggttgcctgcagtccggagcatcgtttgggaggacttggatgctgacacgctcccggggtacttacaggaggcaaaggtaaagaggttacacataaactgcaacttgagcttgctcaacctgatatccttgcaggatgccagctctgaagagtggaggagcgtccggcatgtgcaacaattgaaggttttcgggttcaaaccacagagcgaaacgtctgaatgttacttcctttataccaaagagccatatcacgtcgaaacaaacatctccaaagcctgaacttctgctagatgtatttgtcatttgtcttgaaaaagaatgttgtattactatctgtttcctctactttgttattctcatttctgatttgcacgttctgtttactgcaatcaggctgattctgaagcttcagcagtcagcttatcgaatttcaccagctccatctgaaatgctttacatgcagaaaacagagagcttccaatggaaaatgcatgcgcaactgcaattttgcttttttttaaaaaaaagatcgttcagtgaacaatttgcacatacctaacccccaggataaaaattaaaagaaaagtttattcatgcatccatttcctttcaagaaaggagatgagacaactttcactttttaaggtgtgacattttgaagcttcctactgaacaagctattttatattcgttcaggggaaaagtggaatggaaacaacccattccatgaattcgcggtcagacgtacgaaaatataaaccataacacaatggtatcacacatgggaggcctccaatttaagggacaatacatataggaaaacaccgacaaaaacggataatctcaacaatcccctttgatgatttgatttatagattgtatgaactgttggttgattacatttatgttagctgagaggagataaaaactactaattagatgaaacgaaacagttcctctgcagcaaccatattactcttgttagataagagtctatcacactgtgtaggactggtgaatggtatcaatgtccaggcccttcagcttcacaactgactccacatgccccttcagcgtatgaagctccctgagcctgcaagtgtagcatcaacagcaagaacaagcacatagttagttagctttacatcgttttcacgccacgtgttccagggggatgcaaattggcattgtgcagctagaaagggagatgcttcttgatcttggaaggaacatggcaaaagcaactgagaattgatgcaatataaaggacatggtgcttctatatgattcttaaggtgacagatcatggaaaagaattatacaagtgtctactgcagatttaggtcctaccttgcaatctcggccctccgtttcgcctcttccgccatctgattcagctcactgtagccggtcttctctgggaagggcttcgcatccggtggctgcaggccatggagtgtcctatgtgcatgtgcccacttgagttccctctcttccttgccaaaatccttcttccttgtaaacgcaatctgtcgaaatcgatgggccattagtcacaaatgcatggaaattcagtcgaaataggtaaggagccaagacaactatgcagggtgcattagcattactctctgctcaatgacaagatcccatgctttcccactcagagcatatcggatgaggaacttgatgatatcgagcgggaagtagaaaacgagattgtagagccacacgataccggcccagccccatccaatgcctttgattgaagtgaatgcccagttagcataaacagctatcaatgtagctatctgcatttgaaggggaagaaagttagattaacacaattctacccagaagagaatttatcagtttgcggtaatagggagagagcataccagctgtgcaacgaagaaagcaaagacaagtagaaagccagggcgttcgataaatgaccagctgcgagaccttgtgacaaagataagagcttggctgatggtgctaacttgaagatatacagcagatgcaagcttttggtagtcatcttgagctgtcttctcaaggctgggctgcagg

SEQ ID NO: 43687 - DNA, 1175 bp, Oryza sativa
caagtatccacccagcacaactccagttgtgaaaatttcagccaacttccagctgtcaggtagtggagaaggctttactagatccttagatatagtcattatggtacctgtttgtgccagaaaatggttgaagtgaacatcatgaaaatagtttctacttactactgaagttttaggagagatagcagggatggagggaacaagaatgtgacataccatcattcagaattgcaatgatcagaaccataaatggcgggaaatcaaactcccatataagggcaagcagcataaacccaaactgtcaaaagagcagtcaatatacattaagtgctagctaaaacataaagttgatacacattgtttggcatagtaagatgaaaacatcatattggggatcatcaaagttaatgtgtacaaaaggttatacactggaatcatttagtgcttagttctgttaaatttatctgaatggttagttctgattgacctgtagttaaactaaaatacctacgagaacaatcaactatttatttaccaaatgagaggaaatccataatttctagttctccagtaaagaaaacataccacaatacgtattgtaatcgagacagcatatatctgcaaacatggaaatgaattagcaaaataacccaaggaaaaaggcagaatattaaaagacactatgtttgtttccatctgacttacagtgtagttcttcattcgctggaaaatcgcccgactggtaagaacagcactaatgatcacactcaagccaggttctgtgagtacaatatcagatgcactccttgctgcatcagtcgcatcagcaactgctataccaatatcagctttctttagggctggagcatcgtttacaccatcaccagtcattccacagatgtgcttccgtgcttgcagacgttttacaatctcatacttgtgctctgagaaaagagagaacttcacagttatatttttctttgtgactttcaaccatttggtttttattctgcaattgattgcatacaaacctgggaatacaccagcaaaaccatcagctttctcgattagatcgtcaactggtaaagcagcaacagactcatccttgttctgtcccaacaaagcagatgaagggtacatgtttgtacccattcctagacgacgccctgtttctt

SEQ ID NO: 43688 - DNA, 1201 bp, Oryza sativa
ggaagtgacttccgtataacaatatgatgctcctagaacaagtatactataatattctcttcacaagtgatgtgtgtctactgtttcttcctctctgcatttggaggtttgtatgacaaacatgcataggaagataatgtaaatccttatagatgtaggtgttgtaataaatccttgtagatgtccatccacataattacttgcttcattcatgcttgctccataatttcttttcatgtatatattatactaataagtcaacaagttaaagatccgataacgtaagagtcatgaagaggccatcatagatgtcagtctaacatataagtaggtgttattactcaagtacctgcgatagcctttactaaatactaccaatattattatcagtggtagaagtgatttaagtcttgagttatgaattctactgccagtaggttaggtggaagtataaatagatgtgatttttttatggtggtctttattggtggtattctactagcaatattgtcaccaatagaagtaaccttgaccattgatttatgagttccactaccagcaaaagaaatattctactgcaaatagttgaggtagtaatagaaatagatctgatccttagattagaaaatatgagggctctagattaattctactaacaaaaaccattgtaaagcacctttagcttacatgatacatgcgtgcatgctagttttatcttcagagtttcatcaggtgtattgtcagtatctctaaaagtttcattgatcattcgtggcatatcataagtataaccatgtcaaatgaatgtttcaccaagttgtcatgaatgctttatcaggcctctgcaaagttcagcaagttttataaattttctgcaacaaatcaatgaaattcgaatcatgatgatttcccctaagctatatattgaaaacacctcgatgcataaaaaaactacagcccattcaacaaaacaaaaccccaaacaaccagactttattgtatcaatgatgcacttgttggcattggcatgcagcagctctcatggctgcctactgctccgccaccataccagcgacatcttcagcctgctactattaccaatcgttggtgcatgatgtttctgattatctcattctgtacaatgatcttttcttcaaattttttttacaatgatcacattctccttgcctagcacgctcgc

SEQ ID NO: 43689 - DNA, 701 bp, Oryza sativa
agaatgggtaacattaaccatctctgtcctacagagcattacttcaatctcacttcgtgggtacgttttactctgtttctttcatatccctgaaaatgtggatgcacagagataacttattctaaggatgtacaattctgaagttggtctctactttgttcataaaaaagtttgttttcagatataatggatttctgagagtaaaaaaaacacggtatttctcttacttatcatttcgatctctcaatctctttctcctgatgcttaacatcctcgcgctctaagagatagctgagaaatggacatctcatgaccaaacaagatgggctctccaatgctagcgtatatattaatcggatggctttcacagaagcaaaaacattttatttcctttcatcttttgtctttctatcttttgctggttcttcatctattctatacatctagataattatgcaccgaatatttgaagatcgatgcagcaatgaagatcaggttggtgtgtgtcaatctgtcattgatcatctgacacacaaaacctacgtagggctgaaggaccttgcaaacctatgtaagcggaaaatgatctttagctgcagggaagtgtatccgtgccgttcttcttcaagatgcgaggagtcacataacttcaatcctcataggtagaagagccgcaacactccattctccccatgtttgtt

SEQ ID NO: 43690 - DNA, 713 bp, Oryza sativa
cccgcttggcagcgtagccggcgctctcttcgcgcagcgtggcgagtgtcctctcgatgtcgagggcctcccaccctgcaccgccgccgacctaccgtgcgatccctcgacggcgccgagggcggcgttcctaggccgggaggtcatctcgatgggatcgatgcgcctaggcgcctagctgagagactacgggaggaaaagggcattctctaccgttggataatgccccttatatagggaggcggcggcgcgaggagagccaagcctaagtggggaggcgcgccggcgccaccgtggcagcgcggaaaccctagcggctagcggctcaggttaatggggcggcgcaagcgccacagctgtggctgtgtggcaaactggcaaccctaacaagcagctgatttggaaagaaacaccgaaacaggaagccattcaaaagcgtacaggataacccaggctggcgaggcgcgggaagaaggataaggcgcgcgaggaagagggaatatagacgttggcgacgggaaactgtttaaacacgggtgtacgttcacccgtttcttgcatgtcaattaaatggttagaaaaaattttaaaaaatttgacatgataggttaatatgtaatatatcacttcacaaacatgcaagttcaaattcaactgctacaagttgtaacaaaaataacaaatttgattgcgaatatacgggctgcaggaat

SEQ ID NO: 43691 - DNA, 919 bp, Oryza sativa; identical to SEQ ID NO: 39640

SEQ ID NO: 43692 - DNA, 10279 bp, Oryza sativa; identical to SEQ ID NO: 39641

SEQ ID NO: 43693 - DNA, 8030 bp, Oryza sativa; identical to SEQ ID NO: 39642

SEQ ID NO: 43694 - DNA, 3087 bp, Oryza sativa; identical to SEQ ID NO: 39643

SEQ ID NO: 43695 - DNA, 2524 bp, Oryza sativa; identical to SEQ ID NO: 39644

SEQ ID NO: 43696 - DNA, 1607 bp, Oryza sativa
caggctagcttgagttgcagcatgggggcgagccagtgtgcctggggtgaacacgcaaagtacgtgagagctggcgtgtgtcgctagctgtgttagcggtgtgcgcacacctggagctctcccgttctctcttccgtgcttcgtcgatgtatgaagtatgaacgggagacgcatcggattggattgacggatgggggatatgtgcacgtgtcacgtcgttatcgatcgatcggatcgcggacgcaacgcgaaaggagaaaacggtggccgtctctaccattttgccacatgcgtgaaactaacagtagtgatgcggggaccgcaccagagttatcggccggctagcttgcgcgacgcgacgtcgcgaggatgtggtcgatgcggaaactacaggaaccgtcgcgtcgcgtgtgcgcgcttgatgcggaaagcaccggagaaaaccgtgctttgctttcttggatcgcgatacttaaccagcgtgtgctgccgcaccgtgacaactttggctacaaagcctaccggaggcaacgcgcgctctgcctaacgaacccacggatcatcatgactcatgaggtgtagccgtgtaggtgtttgtgccacgacgccgcgggttctggcgttagtcgcgcgagggatatgccaggcgcaaaaagaaatgctcggcttcacgttttttctacatttcgccccttggcgttgggagaaagatgggaaccacggcacgatgcgttgcagccttgcaggctttgcagcgcgtggtccaagttaagtgcgagttgtttcggggaggcaaagcaactgggctgtcaattgagttttggcggcgggtgaataagattttctcaaatggccaccactgccaaaggaaaaagtacaccgaaggtacctcactagtcatccggatacaaaatcgtccaataaccgcaaaactagatatatatatattccccttaactatacaaaaccgatcaaaataggtccctcggcggtttttgaccccggttttgttctacgtggcagctcagtcagcgtgggacccacatatcagtatgacactctctcttcctccccttcactcgcgccgagcaacgcgaggcgacggtggtcgcgactccggcggtgaagggcggtggctggcccggagctcggcggggcgaggcggaagaggaggagggcggcgccgtgacgacggccggcgacggctgcggcggtggcggccgttgtggccggctccacggcggccaaagatgggaccggggaggcgacagcgaggagccgagcgccgccactgcgcttcttccttctcagcggccgaacgcgtcgcctcgtcgccacgtcgggaacctggaagcggcggtgcgttggacgagtattcctcgtcaatccggaggcggagcgcgtgcaggggcagcgcggagaggcggagcaggagcggatggaggcgggacgggtgggagagcgaggcagtgagcgacccgtcgggggtgacggccaccgcgccacgaccgcctcctcccaaccgaggcggcgtcttcgccgacctccgcgccaccgcctactcctcccaaccgaggccgtcgcggcctccccctcctcctcctcct

SEQ ID NO: 43697 - DNA, 4642 bp, Oryza sativa; identical to SEQ ID NO: 39645

SEQ ID NO: 43698 - DNA, 2156 bp, Oryza sativa; identical to SEQ ID NO: 39646

SEQ ID NO: 43699 - DNA, 4430 bp, Oryza sativa; identical to SEQ ID NO: 39647

SEQ ID NO: 43700 - DNA, 15164 bp, Oryza sativa; identical to SEQ ID NO: 39648

SEQ ID NO: 43701 - DNA, 2746 bp, Oryza sativa; identical to SEQ ID NO: 39649

SEQ ID NO: 43702 - DNA, 7527 bp, Oryza sativa; identical to SEQ ID NO: 39650
  unsure (1)..(7527): unsure at all n locations

SEQ ID NO: 43703 - DNA, 6958 bp, Oryza sativa; identical to SEQ ID NO: 39651

SEQ ID NO: 43704 - DNA, 1951 bp, Oryza sativa
tcacgaccgccccttcctcgtctactccggtctcctccccaggctatctcgaatccacgcagcggtggcggttgaggagccccaggcaacacgggcaatgagctcaccgacggccgcacggggcggatcgagccgatgacgcccctccccgccccgctccggccaccaccgccccttcatctccccctccggcttcctcacttagctacccccaatcacgcagcagtggcagtggatgagtcccccggtgatgcggccggcggggcagatcgaggacgaccgcccctccctccccacccctagccaccatcgctcgatcaaccagggccggatctagcggcgttggcgcccttactgctctcccctctccagcgcggatcgaagcaggccggatctagcggcgttggcgcccttactgctctcccctctccagcgcggatcgaagcaggtgggaggcatgggctagcgagggcaccttcgtcgaggtcgggctcttcgatgcttcaccacctatgcacccctctatagcgagcttcactgacacatatcgagctcttttctttagtcggacaccgttatcccttctctctctcgctctcgccacgcgtggatgaccactttttctaaccgaactgctgcaaggctctcatgatcaactttggtcacgtgaagccggtgaaggaacggtctccactcccctctcttctccacacaagcgacttatgtacgtagaccaacattgccacacgtcatgtgtgtgcactgtgaatgacctaattactactgcctccgtcccaaaataagtgtagttttgcactattcacgtttaatgtttgactgttcgtcttatttgaaaaaaatttatgattagtatctgtattgctattagatgataaaacatgaatagtactctatgtgtgactaaatatcttcaaatttttcaaataagacggatggtcaaacgttgggcacggatatccacggctgcacttattttgggacggaggtagtaatacaattcgattgtttgtgtttgtcgcgaacgtgcagtggtgtcggagccttggagcgcccactgggaaattaatgggaaccttaacgatgcttcgaaaaccagcaacacatctgtcgtccaaagatgccacactcaccacattttacgccagctttgacctgacatgataaagtgtcgaactgtcgatccacgcatacgtcagaacctacgacggcgctgttccggattgcacgaaattccaacttgtcatgtaaacagtaaactaacctacctatagagtcgtagccattgtaccctactactcctactgtactgacaggcgttgaagtaaacggctgcatgcagctcgctgccaaaaactgcagctctctatacgtagaatccagtagagagtgctgttggatcacacctcgccatcccggttcaacgcccagcggagcaagtctacgccccgatacggaacgtgacgaactgcatgcatcgggaaaaaggccacacgagttattgcaggccggcggcggcggggtcttcgtcttcgcggacggatcgtggattggatccacgccgcgctgaccagaatcaatcactcgttgccaagcgcacgagacgtatcgtacggtcgatggcagcaggtagtagtagtagcagcagcatgtccttggtctagatggcagaagtatctatctctcgctggatcggtgccgtgcggggccgtgcgtggggttagtaatttgcccgcgtgcgcagcaacttttgaacgtcgagctgatgacgaacaggagagctcagcgctgacttgagaaccggttcgtcgtgtggggtctcaggctgtgatcaatggatcctgtcatgtgcagtgaacttcggatgcagaggacagctactgtgggccagttgattgggagatggatgaccggggggggggggggggggggg

SEQ ID NO: 43705 - DNA, 5840 bp, Oryza sativa; identical to SEQ ID NO: 39652

SEQ ID NO: 43706 - DNA, 7090 bp, Oryza sativa; identical to SEQ ID NO: 39653

SEQ ID NO: 43707 - DNA, 5731 bp, Oryza sativa; identical to SEQ ID NO: 39654

SEQ ID NO: 43708 - DNA, 2572 bp, Oryza sativa; identical to SEQ ID NO: 39655
  unsure (1)..(2572): unsure at all n locations

SEQ ID NO: 43709 - DNA, 15405 bp, Oryza sativa; identical to SEQ ID NO: 39656

SEQ ID NO: 43710 - DNA, 11815 bp, Oryza sativa; identical to SEQ ID NO: 39657

SEQ ID NO: 43711 - DNA, 7662 bp, Oryza sativa
gagagtcatccgtgacgggtttttgtgttggcccgattgagatgtgtgtcatccgtgacgcccggatgtccggttgagatattttctcacatcactgacctttgcttagtgaaggggccctgcccgaaagagatgagctttaagcccgttagagataactgatcccgttctagtgtgtacaccaagtttgtatatgtacgtattaaaaaccaaaaaaaaaaaagaaaagtgtaccgtctgctgcctccctctccgtgcgcgccacgtgttcaatggtgcacgtggaggagggggaatgcgcgtgactagccacgcattagcatttgcgtgctgcctcagctgtgtcgatctatcgtttaataacgcttctgcattttttgctggtggcctatgaaaattaaaattttcatatacgggatctagtgaaaataaggtaatttttacggctgtcctgttatacacatttgtaaaaatcaatttttatagacaatgctgaatttatagggtctcttatcctatatatctataaagttcatcccccgctgagtgtagttaataatatttatctcttctctcataaagccacattaccttaattgtgttgttagcctttggatgattcatcaataatgtaaattacatctcttcacgtcatctcaattatttttagcctttggatgattcatcaagggtgtaaaatacatttcttcacatcatcttatttgtttttagcctctggatgattcatcaaggttataaattgcatctcttcccccaaaaagtacaccatacaacccaatcatttctaacatttagataatttataaagtataaaaataaataaatacatgaaaaaaaaatcgaatagtagataagaaagaaaaatttagaactcatatctactatattatcacacaatttttccgcagcaacgtgtggggtatccatctagttatttttaaaggaggattcttttgaatccacctaaaaaataaacccatgtgttgggaaaatcgcttcttatagtgcagctaatcatctccattaaatattcatttgttatatatgctacaatttatttagatgacctggaaaatatggtatttcgcttactcatgttctacgtacgcacatgcctgatgcatattttacccttgatgtattgcgcattatatactggtcttttattcaaagccgtcatcattagttctaaactgaatgattaacatgactattattctactaattaatttcacgacatattttattggtctttttaaagatttgaacaaaaataataacctattgtttaaaaattatattttcgctggaaccctgaacctctgaagtcaacacaacaatatggttaatttctagcaaaacgtctctcgaaatgaatctaatacccatttccaaaccaaaccgagttagtcaattaaaatgacctgataccattcacagttgatataaaagacttcaagtttccttttaaaaagcaacaatttaagagttatatcactgttagtacgtaacatttttttaaaatagaattagcacgggattgtgctttttattaaatataatggaagaaaaaaaaacccaaaagcaagaaaagagaaaaaacatcatatacaacccccgcgggggactcgatgggtgagcgggacccgcacaaccagatagagttaggctgtgttcggaagtgcctgttaccaacacacacagtgcgtatagaaaacggagtggtacattagcacatgattaattactagtaattattagctaatttttttaaaaaaaatggatcaatataacttttttaagcgactttcgtttataaacttttttaaaaaaaacacaccgtttagcagtttgaaaagcatgcgcgcggaatactagagaggggttgggaacctagggctccaaacacagccttaatactcattagaaaggacacatcacactgaatgataatgtacaaatcacagaattaaatcctaggctattgcattggcaaatagcacaggacccatccatgagagatgtattggagtctagaatatcctcgttcctcactggttgcatgccggatttaacatcctgtcaaaaagaagtggttaaaaacggtgagaattaggactaagcacatcccttctttctataaagttaaggccaaaagtttaaacctcgtgcttccacgtcatcatcaaattgtgaaccgttggataaatatattagattgcttctcagacattagatataatgcagcatagagcccaacccatcagtcaccaccccggtgagtctcttagcttcttcagtgccaaatgtaacccacatgggcatatctccacacacatctatatgcatccagcctgtcaatccatataaaagagctttatggctgaacattccttcacttgacatgtgctatctaaattatgtacaaatttttgatagggctgctaaaaagaatttcttcaagaaacctatttgtttattttgtttctttttgagattatacctcttatctaacaaattgatgttaacaaagtcctgcagcaacgcgctgggcatcctctagtttgtagaacactggataccgctgcactaacaaggtagaaagccccacatcgtacccatgcatctgaagtcagcgtaggaggaggaggcagcgtggtactcagagaagcaggagggactcaggaattcaggaggacggggagaggtggctgtgggcttctggtgtcgaggtctcaaggaggacacaacgtaccgagcccaagccccgctcgagagcctgtgtcgaggtctcaacggagaaaacaaagaatgaggttggaggagagggggaggggggggagatgggaagtggagaaattatggtttacttcatatacctctatttaaaaaggccaaataggcttcaaggttctacctcatatcttcggagcccaccgggtcatccgcgagctggaatttccactcaaccccaacaagaaaattgtcacccctaataagtatcatagatattatcactgttggagccgtcgggaggagtgtcttagagaagacggtgcttccgacaccagtcttggtgttaaacaacttaagtaaccaatcttattttagaaaacagataaaacttatattatcatcgatgtctcaattagaaggactttaattctcgatccatcctacaaataagcaaagattttaaaactcaattatctggccatctacagaaatacggaggattttgggcttcccaaacaaactgcaactaataaagccaggtccggtcccacgtcccagacacctgaggcgggaaacaaaaacctacccaaaagatttcccccgctccactgacgggtgggcccatcggacgggacccagcgtcataacaaccgggtacacggcagtggcagtttcccctggccccactccacgccacagaacccacatcccaccatgacgcgcaattacctcattatcctctagattttgtggcaactagactctagcgaggatggcatcccttgtaattcttccgaaccttgagtcctctctctaaatctctccgatataaatatgagccggcatcccacagaccccttcccttctaccacaaattttttttccaccttccctctctctcttctctgctgtctctccccccctccatctgctttgctggcccctggcctgtgaagttacgattttgcccctggtgggccccacctttgtacatctccttcccttttttttctaccctttttgcagaacacatcgcccttctctttttccttttctcccatcgaaaccttttttttttttctgaattcctctctttctttgacggctctgactcgtgctgacgtggcacgtggcgaacgaccctcagccgtcgatatgtcgctcagcgagaagctggaggcggcacgtgtcgcggtcggcaagcgcaaggagcgggagctcctggctcaggctccggctaataaagctctagccgagccgggtactaataagccggctccggggccggtccccaacaacaagctcctagccggtcacctggcgcacgagttcctgacccgcggcacgctccagggccgccgggtcgagccgacgaagccgagccaagccgccgccttgcatcccggcgagcccgtgcccgagccggagcccgacgccgccaagcggaggaggtacgccgaggtgtcgtggctcctcatggcgagcggggcccgcgtccccggcgtcgtcaacccgacgcagctcggccgctggctccagataaaggagtgacgtgccggcgaccagacatcacaaccccaggtggttttcccccttttcaccggggagaaccgacacatcatcaaaccggtttcttcgttttctcctcctctttgcctgctcctcctgtttagattttagatctaggagagaaaaagaaaaaaaaaacgttggtgtactagcagctttattcgatgaaattattgttgttattcaaaaccaatgaccagaatggtccagctttctatagaaagcgcgatttcttgttagtactactactagttcgctacctgtatatcatgtgcgtgcaatgtttggtggttgtcatttgtcaagtactagtagaacggcgagcgtgtgcacgcacccgggacggtgaatcgcaatttttttatataactgttgattcgcgttgatgggtggatttcgcgtgctaccgagcgccgccgccctcgcctatcggtttcctcggcctgtgttccatggatgagacggcggctattcgcatgaagagacgcgtagaggcggtggcgcgcgagacgtgggggatgtgcccaacgagcatggcgccgtgcaagcggttagtggtggcctggtgggagttgctcctcccccatccatcatcgttccatgtgccctggtggcctgatgctgtttttagatctaaagtttgacgcaaacttcagtcctttttcatcacatcaacttgtcatacatacacaactttttagtcacatcattttcaattttaactaaaatctaaactttacgctgaactgaacacatcctaaaaacgcatgtgtttccagaccacaaccagacgaattattggagaattgttcggtgtcctccatggctgacggtgtacacggttgaagcatgctttggacgacgcgattgcagaggaggtgattcacgaaaaggacgcacgcacgcactacgtattattctgatctgaagctctctgcgagtaatttatttctgatcttcctctgattatttattcgggcaatcaggcaatggaaagggcgtaggggcagctcctcccgtattgttttccagagcaagattagttggtgtttgctgtttccatttgattgattggctagcattgttccaagtggttcgattcctgcacctgcctggtccattcctgccagttttaattgcatttaaataaatcggggatcattgttggttgggtaattgtctgaactgttcgttcatctcgtctctcggttttggtcaatggcctgcggagggcaatgtcaaatgtccaagcaaccgggggaattggatgggggtaagcaacgcgcaagatagcgtagccgtgttaagggaagacgagaaaggagatgcgtgtgatttacttggaaagcaaagcattcctcggctttgtttacaacatcgaagcatttctgagatcattttcaccaaatttacattgcgaaagtttagacgaaaatgcctacacgaaaaaaatctgggtttaatttttactttgtatagcttgtaaaataaaatatgtttgattcgacgctcccacagggtctgcatccgacgctccaaccttagggccctttgattcggagaaaagtcagccttaggttctgagtatttcatttggaggaaaaacttgatttaggggaaaaacaatcatattaaaacaaatgattgaatgatatactatcatagattttgaagaaaatttaaccaaagcttcaacatcttaaaaaattttcctttaaggccctgtttagatcccataaaaaacctttacaccctgtcacatcgaacgtttgaacaccacgtgaagtattaaatataggctaaaaataactaattgcacatattgtgatttatgtgcgagacgaatcttttaagcctaattgctccatgatttgacaatatggtgctacagtaaacacttactaatgatggattaattaggcttaataaattcgtctcgcggtttactgacggattatgcaattagtttttttattagtgcccgaacacccccatgcgacatcatatataatatccgatgtgacacgtcaaaactttacacccttgaatctaaacaccccctaaatctatatttttcattcgattcatatgatccaatcaaacaatcatttatgtgtcttatacttctctattttgcacttgctttactaccagaatcatatgtttcttttttttattactccgttttccctttgtatgtttcaagcgacccttaactcgtgaaaactgaaaacactacttatcaagtctagggcctcgttcagatccaaaaattttagccaaaaacatcacatcagatatttggacacatgcatagggcattaaatatgggaaaaaaaatcaattacacagtttgcatgtaaattgcgagacgaatattttgagcataattacgccatgatttaacaatgtgatgctacagtaaacatttgctaatgacagattaattagacttaataaattcgtctcgcagtttacatgcggaatatgtaatttattttattattagcctacatttaatactttaaatatgtatttaatatgtgtttgtatagctaaaaaattttacgcccaaacaacttaacaccctagacagatcagctttggtgtcttggtggttgttgtcacttgagagcggttcaattctgccaatacgacaggcgatgaaaaccaggcaagtgattgatacggccggtccgcttccatcggtcggtcgtccgcccatgacctgatcccgtctctcgggctctcggcacgcagccacgcacgcacgcacgcacgcatgccgggcacatctcggacttcgcgaacacgtggccgcacgagcacgtcgccgactgacactaaagaaggccaccccaagaggccgacgcgcacctcgcgggccaagctttagcctccggcccgtgcttctccaactcgctctcctccgcggcccggcccggcctgcctcaccacccccgctttagccggctgctaggtctaaggtcttcagtcttcaccctaaagccgcgagcccgcgacgtgcgcggcgccggttgggggcgcgcgcctgcgcgcctctctcccgcagtcccgcccgcccgcgcgcgcgcgcggcgctcgaaacaggcaatcgctttccccatccaaaaccagtccaccctcgcgccgcgggggaaaaccccgaaaaattttcttcttcccgccgatggcacgccggttcagacccgcgcccgcacgcggcggcatccaaacattttttttccagccgccgccaccccttccctccaattttcgagcgtggccacgcgtatttcagtggctccggagctagcttaattagcagtgcccaca

SEQ ID NO: 43712 - DNA, 8452 bp, Oryza sativa; identical to SEQ ID NO: 39658

SEQ ID NO: 43713 - DNA, 2139 bp, Oryza sativa; identical to SEQ ID NO: 39659

SEQ ID NO: 43714 - DNA, 4948 bp, Oryza sativa
actcctaggcggttaggtgtcgttcctgagccaccaatctacttgtggttggccgggagaagtttgtgaaggttggatctcacctccgaaagggaagagatacctttagtggaaggaggattgcttagtgcaccctctttaggaaaggggtagctaagacccggctcttagagagctcctcaacggagagtagaatcccctcaaggattcgaactttgagaagaacttcttgagcttcatctttggtgactttacttcctccctctccactagctttgcttgtttgagccgctataggtctagtggctgtttgtgctagcatattcttgttgtaggctcatccaacatggtcctcgccatctcaatgagagtcctattcttcctctcggctactccatttgttgagatgaatatggagccgagaactcgtgcttgatgccttcttcatcaaggaaactctcgatgcacgtgttcttgaactccttgccattgtcgtttcgaatgttcttgatcttgaggtcgaactcgttttgtgctcttcttgcaaacttcttgaagatagtttgtgtctcactcttgtcatgcaaaaagaacacccacgtgaagcgtgaaaagtcatcaacaataacaagaccatatttgttacctccaatgcttagataagcaattggtccgaagaggtccatgtggagaagctccaatggtcttgtagttgtcatcacattcttgtcgggcgatgtgctctaatttgtttgccggcttgacatgcactacacaccctatctttctcaaattgaacatttgttagtccaaggatgtgatcgtgctttagaagcttgtgaagattcctcataccaacatgggctagccttcgatgccaaagccactccgtgttggacttagccactaagcatgtctcatgtttggctttacttgaggaaaaatccacaaggtaaagctttcccttgagaacacccttaaagactaccgaggaatcattccttctatagacggtcacatccacatcggtaaaaagataattgtaacccatagaacataattgagaaacggacaaaagattgtagtttagagattttaccaagagagcgttggcaatggaaagatcattagagattgcaatcttacccaatcccataacatttccctttccatcgtccctaaagactatgttatcttgtgaagtgccatttggatcaagagttgaaaatattgattcttctccggtcatgtgattggtgcatccactatcaatcacccaacttcttccaccggagacatattcctacaagagatcaatttctagttttaggtacccatacttgcttgagtcctctcatgttagtaacaagtgccttaggcacccaaagtactctcttgatagaaatattcttgccccttagactaacatacttagcaacaacacgaccactagcattcttcctaagaacataagatgcatcaaaagaacaatgtgaagcataatcattaggaaggatacttttggccttaacaaaattgctaagaccttggggcctcttgatcatcacactcttgtccacctttccttttggtggaggaacatacctaagaccctcatggttgaagttgtccctttgatagcctaggtactcctttagggtcttactacccatatgccacttaagtaggccattgtgaaggagtcccataagcttctcattttgcttttgcaaagcactcaaagaaatagagttagtagcataagcttcaatatcaatatctttgcatctcacacatggttcattgcttgggacaattttggaacaagatggctcgctagggagagagacactattctttaaggtttcgaacttctcttcaagagtgaggtatgctttgtccaagccatccactctctcttgaagttgagtgttcgccacctcaagattagcatgagactctttggtttgcttgtaaagccgtaccaatgcctcatttttttctctctctccttagcaagctcactcttgagttcatgggaccgctctttctcacgaatgagcaaagcctcttgcctctcaagagttgcatattggtcttcaattctcccaagcaactcactcaagtgtggtagggattccttagttatggacttgaacaattcatcatccataacctcatcctcctcatcactaacaagatcaacattaaatgacttgagaggagaaggtaccttaggctcctttgccatgaggtaaacgggagcatcctcatcacttgagtagtcgaagagtctcggtggtgatgaaggcttgacggcgaacgtggcgactccttcttcatcacttgagcttgactcggagtcagagccgtagatcatcccaaagtgagctgggccataatgtaccctcttgctatgcttgtgcttctccttcttctcatccttcttctcactcttcttcttatcttccttgatgtgggaaccatccttgaggtgagggcaatccgcaatgaagtgcccgagctctttgcacacgtagcacactcttgcggagtgtcttccacttgacttgttggagtagtgcttggaagatcctcccttgaagaagccgcttcgcctcatgaacttgccgaacttcttgatggctctcttcatcatcggtctccaccttgctcttacacttgcggttctcttcttcttcttccattgccttcaaagccaagtcatccttcttgatgcttgcagttgagctttggttgatgtattggatgacatccttggactcttgcacgagcatgtcatgggcaaggatgcgtccgagcaaatcatgaggtgtgagagtcttgtagtccggacgctcacgaatgatggtcaccaaggtagagtttcttggagtgattgctcgaaccatcttcttgaccacaacctcatcggtcatgtccttggagccaagtccttgatctcattgacgatcttgctcaaccggtcgtacatgtcgcttgggctctcaccatccaacatcacaaatctctcaaattgcccctttaggatctccaccttggactcacgaacactatccgtgccttcatgcaagttccgaagcgtgtcccaaatcactttgtcactctcaatgccatccacacggttgaactcacttccactcaatgcgctaagtattgcattagcggcttgagcgttcttgtgctcgttctcgtcgtcctccttggtgggatcttcgggattctgcaaaacatagcatttttcgactattctccaaatagatgagttaatagacttcaaatgcatcttcatcttatgcttccaagcggcatagtccgtaccattgaagtacggagctttgccactataggtactcacataagatgtagatgtagggggatagtcataagggatcttagctcccttatcactatcgatcccctcccccgcttggcccgacatgatctctctaagcggttaagcctaattaggagattaggctctgataccaattgaaagtgtcaattaggcctagaggggggtgaataggctaattcaaaaattcaattaaaagcggaagcagtaattttcggatatttccgaaattttcggatatatccgaaaattttcggagtcagcacaaatagcaaagtaaatcctagatctagttgcctacaacaagaatatgctagcacaaacaacaactagacctatagcggctcaaacaagcaaagctagtggagagagaggaagtaagtcaccaaagatgaagctcacgaagttgttcccgaagttcgaatccttgaggggattctactctccgttgaggagctcactaagagccgggtcttagctaaccctttcctcaagaggttgcactaagcactcctccttccactaagggtatctcttccctttcggaggtgagatccgaccttcacaaacttctcccagccaaccacaagtagatcggtggctcgggagtgacacctagccgcctaggagtccttaacctccaagagtaacaaatgtagcaaagaactcccggagatgatgcaagtgctcacaaatcttcacgaagtcaacaacaagcactcacacaaactcgaatccacaactctcacacacacacaccaaatccaaatcgaacacgggtgagaggggaaacaagaaagcaaggctcaaaagtgctagagagagagcaagccaagggcacaaatgattggaatggaaccagcagccctcacaagtgagggggggggctatttatagccacagcccaaattctgcccgttatgcacaataattgagattttcggatattccgaaagattttcggacttgtccgaaaattccagctcagcaccaacagcaaagtcaacgaaagatttttcggacattccgaaaattttttggataagtccaaaaatttccaccaccaaaacatggttctggatgttttcggaaaagtccgaaaatcactttcggacaagtccgaaaatacacagaagcgatttctgcctttgctgaagtttttcggaaactctgaaaatcaatttcggaaaagtacgaaaataaacagaaccacatttgccttcacagtcattttcggaaagtccgaaaatgtctttcggacatatccgaaaatttccagaagcaaaaattggttctgtgcattttcggaaagtccgaaaatgactttcggaaaactccaaaaatttccagaacatatcaaactgaggggaaacacttttaaaaaaagattttgagcactttgatcactcctcatatgtcaatgcatcatccctcttaatagtgcggcattcctattgactcaaatgaaaagaaaagttacaatataccatttgctcatctgccgcatcgcatcacatcaacgtatttggcgggatatgcattatggtaactcattgaggacataacaaactt

SEQ ID NO: 43715 - DNA, 2606 bp, Oryza sativa
ccaagagtggaagtttgagcagggttggcatgattggcccatgttgaaagcggctttgttaggggaatttgaggtgcatttgaagtatgttaagatggatgagttattgttgttgactcagacgggttttgtctctgattatcggtcgaagttcaatcagttggtatatcagattcgtctgtatgatcctctgttgtctcccaattttcttattcgtcagtttctgttgggtttaaaggatgaattgcgagttcctgtgcaagctcaacaacccacttcagtcacacaagctttcttagtggctctagcttatgagagtgctttgcctagttctgggagtaagaaatctgtttctaagaagaactttcaggtgggacgaggtggagagaaacagaagttggctcctggtgaattgtggaaggctcagcagttgaaagagtaccggagagcacaaggattatgttttaagtgtggtgataaatatattccaggtcatgtgtgctcaaaacaggaaactcctcagttgaaagctatggagttacaagaggaggcaattgttctgactgatgaacttttggatgctgttactgggttggagttgtctgaagacagtgccaatttgtcgcttcatgctttggccggcacttctcacaccaacattgtccaactcagggctctgtctagcaatcaggtgcttattgttttggttgattctggagttctcatagtttcattaattctgctctgtgtcatcgtttacaccttctgtctgagccaattccacccacttctgtcagagtggctaatggagaagttctggtttgtgatgcaaagatttctcaatttgattggtgggtgcaaggccatcagttttcttttccagtcagggttttacctatggggggctatgatcttgtattgggaatggattggctaactcaatacagccctatgacatgtgattgggctgctaagtggctgcagttttcgtatcagggttctctcatcaagctgcagggaattcagtcttcttctgacttaaccactcctcaagaagctactcctgaacaggttgtgaaatggacaaagggcaatgatgtgtgggccattgcagtgttggaacaatctggtggggtgactatacctgtgtctgaatttcctgagattcagtctttgctatctgaatttgagtctgtttttcagaatgtttctgatttacctccccatagagctttggatcatgctattcctttgctccctaatgccattcctgttaattctcgtccctatagctattctcctgctcagaaagatgaaattgagcgtcaagtgtctgaatgctgtcagctagactgattaccactagttgcagtccttttgcttctcctgtgcttttggtcaaaaagaaagacaattcctggaggttttgtgttgattaccggcgtttgaatgctctcactgtgaagaataagtttcccctccctattggggatgagctgtagatgagttggctggcactaaatatttttctaagttggatcttcgcagtgggtatcatcaaattcgcatgctggagtttgatgagtataagacagcttttaagacacaccatggccattttcaatttagagttatgccctttggactcacaaatgcacctgccacttttcagtgtttaatgaactccatctttgctccattcttgaggaagtttgtgttgcttttcatggatgacattttgatttacagtaaatcttgggaagaccatttacagcatttgaaatgtgtcttgcagttgctgtagcaacatcaattttgtgccaaattatctaagtgtacttttgctgctagtcagttagagtatttgggacatattatatcagctcagggagtggccactgaccctgataaaactcaagtaatgcggcaatggccaattccaacaaactgactgagttaaggggttttttgggtttaacaggctattatcgcaagtttgtgcagaattatgggattttggctaaacctttaactatgttacttcagaaaaatgctaagtttgtgtggactgatcaagctcatcaggcatttttggccttaaaacaggatatggttacagctcctgttttgatatcacctgatttttctaagtcattcaccattgaaactgatgcatgttccactggcattggagctgtgctttctcaggaggggcaccctgtggctttctacagtaaggctttgggagtaaacaatcagaagttatccatctatgagaaggagttcttggctataatgatggctgttgacaaatggagagcatatctgttaaggggaccatttgttattaaaactgatcatcaatccttgtgccatttggatgatcaagttttgggttttgaattacagaggaaggctatgaccaagttaattggtctttagtataggtttcagtataaaaagggagtggacaataagtcagttgatgctttgtctcgggtgggacatttcttttctctccaggctatttctgttgtgcagcctgtgtggatacaagaagtgttgaattcttatgttgtggattctcaggctcaattactgctgat

SEQ ID NO: 43716 - DNA, 1583 bp, Oryza sativa
tttttctcctacagaaatgactttagttgaagtcataattgaggtatgcaaggaagaaaaggattagaaactgtagcgaatgcacgaaacttgacatcaggaaatgcagatatatgtggtttgtgtctttgtgatactgctgtgttagtgtggtattaacaccatgacactcaaacgatgatatgtgttatgcaaacaacaagtacacttggctttgcaaaataatcatatcctgccatgatgagctagatttaccttttcatttttgtggatcatccaagcacaattgattgagcaattagattgtttaacatactaggatgtacttctaccctccaaacttgtgaacttgtgtataccaagtgtttagtacctgaacagcctctttttgtgcttcaattcatcaagttctgatcattcgaaagcatctgcatcattattctatcatgagggcccatcgttaaatggcagatggtattatggtcttggacacattaatggcaaagaagtagaaaggtttttggagataaacagtcttaagaaacatttgacgccttaaagggaaggttgtacaaatagcatgaattaccacctttcaatcagcagctgaagataaaatctaaatcttcctagttcctacatactttagacattctttagattttggcattttgtttcttgattgcttgggtaattttaaggaaccatttagtgagtttgtatcaatttgcttcatgttcttttttctgaatcatcggttgatttatttatctttgtatattccttgagctggaaatgttctaacacttgctgatgaaggtgctcaaagaaagaattgaacgtgtcaaagctaagaagaatggggcttttacatctaagagcgaattcactgaagagatgttagagatacgcaaagcttttgtcatcatccatggggagatgattcttctgcaaacctatagctccctaaattttgccggtgagctcatcaaaccaagttggctagtttgaagtatgttatcagtagtatacttctcatgcaatgccttgatattgtgtgcattcaggacttgtgaagatactgaaaaaatatgacaagagaacaggtggtttgctcagcctacctttcactcaacgtgctcgacaccaaccatttttcacaacggaacctttaacaaggcttgttcgagaatgtgaggctaatcttgagctcctgtttcctatcgaagcagaagtacttgagtctgctagctcctctgctaagttgcaacctcagaatgatgatgcggctagccatgacccagcgtcatctgtcgatgttgaaacctcggacgtgtaccgaagcacactcgcggcaatgaaggcgattcagggcctccgcaaagccagctctacttacaatcccttgtcgctcgccaggttcttccatggagaggacggtgaagcctgctctggagccatcacctctgaaagtgattcctattctgattcccagattgaagatgctgaagatgatgataaagaggtgcaatcaagggagcagaatacggctcaaaatgctgcagaaggccagccacgtgatg

SEQ ID NO: 43717 - DNA, 13288 bp, Oryza sativa
caaatgtgagttattagctgacttgggtgaactttatgcaaacccccagtcgcattttgacatattctttgtacaaagaaagccacaaagctcccaattctgcagtgtacatccataaacgctgtattgtctgaacaaattacagcgtcatgaaacagtgactctttgttcctaaacactgaactgtggataaagtgtaacaaaggcgtcaagtaaaagcatttgttagaattcctccgtttcaaataaatcatcgtttgttggtttgtcctaaattaaacatgttgaccgttagtttgtaaaaatatgtatatagtttaacatatggatcatatactatgaaaccatttttagtaagaacttgaaaagtttataatgttgacacctataagtgcacacaacgcataggctgcttaaagttcattttcagaaaaaggatgatactaatgtaccgtgaatgcacagaaattgccatcagtaaatgcagatatggtattactcactttcaattcactttaagctcacaacattttacagttagcgaaaagagcgagtcagagaggccgtaagacaggtgctgacatgaatagctcccttcaatgggaagtaatacacacatttttacagcgttatctatgatcaaacggaaaacacgatttccccgattgccacccgccaaaggccatcacaatgtcattgttttcttacatcagagattgcaggaaccttggctgggtagttagacaaatccacatcaagcaagtctgtcaggtcgtaaagccctacattatcaactctgtccttgattggggtgctcattgtttcttcctgatctgcctggtttgacgatacgcttgatgtcaccgcactgttcgcaggcatcacagagatgccagacaattctacatcccgcccggatggcacggtactcactgaaggatacttcctttgagtgctgtctccctcattgtgattgtacagcacatattcgttataggtaggtgcaaactgcatgagaatggagcagattatacaaagacattggcatattatggtgatgtgtgtggaaaaacaaagcccccagatgcaaggggtatatgcaatatcctggttacctgatgaacagtatcatggtagaaatcattgaacttcagagcatgcagaaggcttcccttgaaatcaccagaaggtcgaccattgggaccagcatactcgttgtaaggaaatgcaaataggtggccaatagctgctatgagcatttcaacacacaatacgaagttctggagatcagcagctttttcagcatttttgataaaccgagattttgcagcaaggaaaaccaggacaccctgcaaaggagaactttaaaatatagcatgacccaagacataacaattccttggctaggaaacatctttactgtaaacagtctgataagacatattggaacttgagatagcaatcgtacttggatgtgaaaaaattttgactgttgtatatttacctgccaatatgtgagaaacactactgatttgatcatgatgaattttgggacaggattatatggccgaagcagatctctgcatgccgcatagaacaccgcaagagcatatagtgccattgagtatgagactgtatatatgatagtaatgtatagataggattgcttgacactaaagtttccatctgcgtattttcctttcgcataaagtatgaaggtaataaccaccaaaataggcttaagaatcacaaactgcaaacagccttgtttgcatctccgaataaaacgcctgtccaataacataattttaatcagcacttgcatagatatgacatactctctgaatgttactgtgcaactgcatgttgaagcattagattgttacaataagcacttaatatgtgcaaaagatatgtacgcacccatctagaggaatagctggaaaacagcaagtcatcagaaaccacgatggcttcagggttcgcccattcaaacttaccaccacagcaccaggacctccaacccatgccaagcaaagtgaaaagaaattgtagatgacccaagcatcataactgaaaaacaatcagagagattttaacattagtcggatatgcatttattggttcagatcctaaaacacaagtgcagtaaaaaaaattcaaaacgtggaaaaaaaaagtatcgacgatcgcataaaacattgataggaggctatgtgccttacgcccttaacaagcacagacaagaaaacagcaatagaatcatatccttggtcatggcatcaaattattcatagaatttataaaccagcagttctgtaagaatgaaggccatgtccattacaataacttattagcatttccattacaataacttattagcatactgtgtcagattatgatgattttgtagttatatagaagtggtgatcattcaatgcgctttctcccccttgttttcttcatgtgtgttgttggtcttagtaagacactcaagattaacagtgacaatagtcttcatatatcaagtgtatttaacatctgaaatcatggttcatgggctgatggattaaaacgacatctagaaatatgaatgcatgtgatgtggcgcaaatggcataatagatcttctctacactagtgattgctgaggcttatcaacacagtagctaaacgtaaacacaacacatatgaagacatgggcagtgtaccaatgttgtcatgatgatattgctagtatatacttcctccgtttcgcaatgtaagtcattctaacattttccacattcatattgatgttaatgaatctagatagatatatatgtctcattaacatcaatatgaatgtgggaaatgctagaatgacttacattgtgaaacggagggagtataaatcaggtgatagcaaaagaagtgcatcagagctagaatgtgacatggtgcaccagcaatatcaacaatgctggcacagatgtcaaatcatactaacgtgtggcaacaaaagaaaagttgtgcccattggcaattagagaatgccaaaagaaagtttttatggcagttcttatatttgctgcttgtctagtgtctacaacataactttaagatcattggagatacaagattacatgttcagctcccaacaagtgagcagaaaacaggaaccacaatccaaaagaacagttagttcacattaaggggcaagattataagattgacttacatctctcgaatagaattaaaatatattgaattatctggtaagataagggaaaggaacgacatcacggcatagacctgcaacaaataaacatcatcagagttaatatgctgaagtgctgcaaacaaaatcaattcaatataagggctaaatgtaaatgtacaccagatgaaacatgataatacaaatgattgcaaccattaaaagatcatcaggatcagctagctcgagcaaattcatcaatcagcacagcgattgcagccacggagttgccgtgctatcaaattttcttcaacacaacatctggacaccgatcaaacctaacaggaccaacaaatctactcgtagatccacgcacacaaaaagaaaaagaaaaaaaatcatgtgcaagttaattgcagcctcctgcaggtgcttaggctccatgaatcagaggcgggaactcggaacgacgcgtaatcgaagccatccaaacgggctcgcattccaggccagctcgcgaccgcgaaaccaccccccccccccccccacgaattcaccccccacaaaaaaaaacgctaaaaaccgcgaaggcatcgacagatctggcgcgagggggggagctacggggacgagctgcgttgcattaccgggaccatgaagatgaggcggacgatgaatcgctggtagatgggctccgcgtagtggaggaggtggcggtagatgtgcacgagcgcgatgacggtggccgccgcggcgcacaccagcgccgccgccgtgtaccccgccgccgcccagtccatcgcggacgggacgagccaccagcccgctccctcccagcccccacccacggcagcgagtaggtccggccgccgccgcctccgccgccggagcgctcggattggctccggtttggtgcgcctttggttgcgagtggttggggaaggaggaggaggaggaggaggagaaaggggttaactgtgcgaggaggaggtgtttaatttgcatctgcttctgattacgttggttggatttgattaattttcgtttgatttttcattagtttaatttaatggctcgatttgaattttttttttctatggggatttgaaggggaccggtcttcgagaaggaaagattcagatttctttccttcgtcttctctcgaagcgtgtgcgagtctgctgtctctgaatttgttttcaaaccataatcgaagtttccaacattacggagagctttgatgcatgaaaccgcgtgatctttattaaaaaaaaacgtacgaaattttcagggattttggtttatccatgtaattatttgtgtgagaatcaattatacggggatttatcttgtactccttccggttttattttaattaacgttttgaacaatgacacagtctacaaaatatatcttatatttttgaccttatttttctattataatatataataaatatatatatatctatttttattatagtgcttttaaagaaaaatctgtatatattgttttagttcttttaaacttaatatttttttaaagttattgatggttaaaattataaaagtttgatatcaactttatctaaagcatcaattaatatggaatcagggagagaactgtaatgtacgtttgtccatttacatttgtcgtgacattgttttgacgcggattctgggtaagttgacttgcaattaacagctgagataacgtaggaaatccaccacttgtactaatgtgcaagttaagtatgattagttaattagcttggccaaaatgggcacctgctgcagccgacagttacgtcaacgtctgaatattacagcctgaaatccgatgcagcaactgctattagcatcttgtatatctggctattaataccagcaaaaaaaatggtatcataattataattataattgttgttatattaatcatcatcgtatcttttgtgtcataactaacagtttgggcgactttattaatataagcggtagcttgacataacaaacagtatctctgctggctctgcttgatagtctgatacagctaagcccgagcttgctacccactggcttgattgcctgaacaataatctgcctgatttgaatattattccttttttttaaaaaaaaactacagagacacgatccaaatggtccagaacttcagattatgcaatgacagtcaggtaggtacttgttggttgaatgccagctagtctgcagcgccgattgctgattccgtcttatattattatattatcatgatgcttaaccaatgactgctccagggaccagctttggatttggttttggttaagaagaatgatcccaaatgtaatcaaactagtgcataattcttctgtaacattggaaagattcagaaaatgtaggattagcaagataacaacaaaggcaggaagtggattgaaggggaaatactaaacaatttatcttcagatataaacatctgtgaagttgtgagctggacagtcgccaatgagctgaaaatctgattagctcattgaggatcaattaaatatcgtaggatataaagttaacaaatagtttagacaaagttgaataaaataacggtgaggtgcaaagtttgttgagaaatcgtaaaaagataaattttcacgggtggagcagaagtattgggccattggaggaatcaggcccgctacgtatattggcctttttctgaagcccaatttccttttctgcttgtggagttctaggattccggagttctataccgaatacggtccatttcggtccgtccttatgtgtaggcgggcagcctagtacaaattttaggcccgtacacgtagaatggtctatatttagacctatctgaacaaaaccttagggatgttagcaaactatgacctcccaaccaaaccgattctcttgttttcaaataaccttaatttaatttacagtgaggaaatcagtaaaaatatgttcgcaatcatttaaaatttacaatattctaatgtgtttggtgctagaatatatttaagaattaaaggtagcgatgatggtagagttcttacaagggctcctttggattgaataaatttcataagaattttaaaggattttattacttagaaattttattatcaagtcatttgaaacaaaagaataagatagtacaaaatctaatggattggatacctaaacatcatttcataagaaaatgcttgttcggctatgctacatcatagccaagccaggttgcaatgcagcgacgataaattgcagccaaacaatactaaaattccaatgtacttgaaatcctttgtttggatttcatgcttctccttgaagtccattgcacactgtttttcctctctcaactatttatttcttccacaaataaatttttgtgtgttatttcctgtgagctatccaaaattaccatctctaattcttacatttcaaacctcccgtaaactttttgtagcgtatgacaatgttattcatgtgtgcggttttttatagcatgttcaagaaaaaaaaccttaaatgatcgaactaacacaccaacaattatagatatagctcattttttttatcactaataagatattaaaccactcaaaagcagactgtagacataccatatacttgcagaccatgaataatttgcagacttaatattatccaagaagataggagtatgacactaagcctgagatatttcaaaagagagccctggaccctggtatgatagcagcagaagagtacaaggcagagacagataggctctctgtgctagtggttcttgtgaacgagaggcctcctcgtcgacccgcaaaaacccttctcccccaaacccttccccgtccccctatccaatgctacccccaccccgccatataaaccctcgccttcctaccacctcaagaccagccgctcgtttcatttcttatcacttcccccctctctctctctctcccccctcctcctttctcccacctctcctctccaatggcttccctcctcacgctcccctccctctccctctccaaccctagcgcctccgccgccgccgcgggagccggagcggcgccgtctctgcgcctccgcgccgccttccgctgctgggcgctgcggcgcgcgggcggcggccggtgggcggccgcgggggccatcgcgtcgcccaactcggtgctcagcgagcacgcgttcaagcggctgcagctcagcgacgaggaggaggaggaggaggagggggcctacgggagtgacgaggagggggtcgaggcggtgggtggcggggagggggacgaggacgagctcgccattgccaggctcggcctgcccgagcagctcgtatccacgctcgagaagcgcgggattacccacctgttccccatccaggtgatgccaatttgcgctccgtttcgagttttggatagcttaactgtgcttgatgtcaaattgcaggtttcggtattaggcggagacagcgagggaattggtgttagtgtaggatttgttggggggatgagttcgtggtgaataagcctgtattgagcaattcatgatggggcttgttttgatttaaaaaaaaaacagtggcgggataagtgcggcatgactcgtttagtggggaaagtgagagtagtctacgctaagttgctcctaggatatatcacttgagaattgaactgcgaaactatggagcaagtgatagctggttccataattatttttgcgctccataatatcaagattaaatttcacataactacatagtttgtggttcaagtcgcagaaaaccacaaatattttaacacttggcacttaactgcatatattttggtattgaagtttcataaaactacactatcagagaatgcatccacgccatctcgccgatggattcattcgttagttttgtgaaacttcagtactaaaacatatgtagttaagtgccaggtgtcaaagggtgtgtggtttgttgcaacttggactacaaaacatgtagttttgtggaatttactctaatatcaaactagagtgctgattgctgttccgttgatgcgtagaacttcatagatttgctgcatatcaaattcgtcctattcctacagatactgctaactatcattaaattacatatttgttatttgttgaatcaggacagttgtacgtttatccttgcttctaaaagaataaaacaatatccagttttacgtttatccttgcttctaaaagaataaaacgatatccatgtcataccaaatggcatggtgcatattatgaaatgtcgatacaaatagccaaataagtttatttccctttgaatttcagctttcacatgctcaccttgatggtgcttatttgcttgacccttttctgatttattttcgctgttccagagggctgtattgattccagctcttgacggccgtgacctgattgctagagcaaagacaggaaccgggaagacgctagccttcggcattcccatgatcaagcaattaatggaggaggatgatggacggagtgtgaggtatccattcatcttcctatgcagcttcacattgtattgcatgacaatcagttgatacttaacaagtgcattaacccttttttttcccttttggtaggcgaggtcgtattcctcgtgttttggttctagcacctactagggagttagccaagcaagttgagaaggaaataaaagaatcagcacccaagctcagtacagtctgtgtttatggaggtgtctcatataatgtccagcagaacgcactctcccgtggtgttgatgttgttgtaggaacacctggtcgcattattgatttgataaatggcggaagtcttcagttgggagaagttaagtacttggtccttgatgaggctgaccaaatgcttgcagttgggtttgaggaggatgtggaaacgatattacaacagctaccagctgagaggcaaagcatgctcttctctgccaccatgcctggttgggtgaagaaattatctaggcgatacttgaacaatcctttgacaattgacttggtatgaacttcgtatttccttccatttccatttttattggtgtgaaacatgtcactcttgttatttttatttggttatgccctcaaacaaaaacattccaggaatcagtttcatctagtataagagcattcttacatttaatcacagatatcattttgattttccaagatcagatgtgtcagttgttatgatcatgttatatgctgtaaaaatagtaaatacaaattctgtccagcacacatgtaagaggattaagagatattagcactggtcttgagtatgctaattgcacttacacttgaatacctgttgtttcttgcaagatataattgtgcacatgttctgtgaaggtttacttttattttttttgtctggattagtcatcttttattgtcatgtgtatactcaggtcggcgatcaagatgaaaaacttgctgaaggaatcaaactttatgctatcccgctcacatctacatcgaagcgcactgttcttagtgatctcattacggtatgttattgcagttcatggattttttagctgccttttcccctcctctcttttcggctcagcctcctgagattcagaaactaataagatcatgaaaccagttacagtttatacagctatgttggtgtatcatcatgccagtagatgcccgataagttttttttttttacttcaatccaattaagatttcagaacataattcattcatacatcttccatgtctatcgaactttttactgactttataactagtctgttttgctgagcgttggccactcaattatctaaaaatatcttgttatcaggtgtatgcaaagggtgggaaaaccattgtgttcaccaagacgaaaagggatgcagacgaggtatcattagcactgacaaacagtattgcttcggaggcactgcatggtgatatttcacagcatcagcgtgagaggacactaaatggttttcgtcaagggaaatttactgttctcgtagcaaccgatgttgctgcccgtggtcttgatataccgaatgttgatttggtgggttcacatatcctcttcacttcatttgattcttagatattgtaattctgtaaatcacccttcctcacagatcttaactctttcctttccataaagcgattatcagtgaagcttctgagttttaaactccattattatttacagtgctaaaattagatcatcaaactgtccatttttccccccgaacttaggtttttgtattgaaatatcatctagctttgatgtgttttatagcatctcaatctgatatcttgggttaatcttacgactagttaacaaattaactgcattcgagcattatgctatctgggatgaactgtaggtgtgtatggatcaattaacgagaggatttcattttaatgcagattatccattatgaattgcccaatgatccagagacttttgttcatcgttctggacgcactggccgagctgggaaagcaggaactgcaatcttgatgttcacaaacagccagagaaggacagttagatcacttgagcgtgatgttggatgcagatttgacttcataagtcctccagcaattgaggatgtgctggagtcctctgctgaacatgtcatagctactttaagaggtgtgcacacggagtcgattcagtacttcattccagcagctgaaagactgcaagaagaattaggacctaatgctcttgcttctgcattggcacatctgagtggattttctcagccaccctcttcacgttctcttatcagtcatgagcaggtaagaattaataagtgacccgaggaaattacatgtatccatcattaactgatattttactatttctaccattgtatcgaacacttcctttttccctaccttagttatagctacccatcaacttcatccagctgtcctgatttatgccttctacatttgaggatttatatccacctaatgttatatgaatacaatgggctactagtactgattactgaaattgcatcttttataaatttataatgggcaatcaaataattgtatagaaaagctccacttttttttttgagttgctcaaagttttgttgtgcgtttaccgtttatattttctttttaaagctagaagcactcatatgatttcttaccctctattaaaacacagggatgggtgactttgcaactaactagagatccaggatatggaagggggttcttttctcctagatctgttactggctttctgtctgatgtttcttcagctgctgctgatgaagttggcaaaattttccttacagcagatgagaaggtgagctcttgcttgagcatgtcgatcattaatttctgtgcatgagtgcattgggtctatgagcaattgagcatgcagttttgaagctgttggctgatactagttttgcagcatatatatcttctttaattaatgtgcattacgtgcaatagtatgcattgcagaaatcgatgacacatatcactactttttcatgcatatcttcaaaactcctgcatttatgtgtatgactttcactgtgatgctcatgcattggcgcattgttggttgtgtcaggttcaaggtgcagttttcgatttacctgaggagattgcgagggatttgcttagtatggaactgcccccaggaaacaccataaccaaagtgacaaaggtaacctttgcagcttggtatttttcaattattgctattggaatttatagtgcaattgctatacgtaatctgtgtgatgatacacaagtatttgtctggcgtggtggcatttccatttatttccaaccaaggcatttaaattgactttaaatggcaagtaaaatagggaatattctaccattattcttgcactacacacagtatagaatgcaatagcaatccctggtcttgttttggatgcggaattggttctttgtgagctaatgtgatgactgttttccttttgttctctgcttgcagctacctgcattacaggatgatggtcctgctactgatagttatggccgattctcaaactcggaccggggtttcaggaacagacggtccaggggtggtggctcaagaggcgggcggggtggttgggactctgatggtgaagacagatttcgccgtggtggcaggagcttcagatctgacaatgatagttggtcagatgatgactttggtggcgggagaagatcgaaccgttcgtcatcctttggtggccgcgggtcatcttacggcagtcgtagctcgtcatcctttggtggccgctcatcatcttttgggtctagggacaggtgagtttcacaacatcgcagaaataacataatgtctattcttttttcatccatgctgtatctttcttctaggagatgccaccagagaaaatgaaatacattatgagttagacaaaatttgcttacctggtaactttagaatgtttagtcttttccttagccactcatgtttgttagtactagctactcttatgaagttaagtcttgtcatatgaccaactcatgtgttgtaattaaagctttgctgtgaaattaatgacgggtttcctagctagctcttgctacagcataatcttgcctccctgaatcatggccagtgattacttgtaccttctcagtaccagaacaattacttaaacatgctactagttaactcatgctgctttcttaagctaatgagctgttcctcatttacagcagcaggagcttcagtggtgcttgcttcaactgtggcgaaagcgggcaccgagcatcagactgcccaaacaagtagatggtagaaacaacactcttccctgccgctcgggagttgctccttctgggcttgatcatgttccaacaagcggctggactattcaacacatgccaaggaacaccaaagcccagtcccccttcatctgatccatacatgcccaacactattgcctgacgaagattttgcactggttagtacagctctgtgtcgtcattccgtcgtgaagattttggcacgctgaccaccaaaggagagccttctgttcatttat

SEQ ID NO: 43718 - DNA, 24880 bp, Oryza sativa
tttcttacatttgagcaaacgcgatctgtgtgtgtcgacgtgtcatgtgtgtgctgcttacgtatacatagacccagtcgcagtttggcaccaaaggcaggggggcgtggtgttcttccggtgtcagaattcagaagtggtaggtcgatttggtggctgacgatatgacgatatcgattaaacggcacagcgaaatgcgtgaaatgggagacatatctatcaggtcaaagttcgaggctgtgcccatgtaaaaggacggagttggtttgttgatcctaacacgataaaaacatgtgcctgacaacgaaagaagaccattaattaactatggatttgcttagtttaggccgtaatctttttgctggagactgtgtagaccgtaatttaatttccccacgggttgtgctcgtgccggtggatgatctctgaaccaaaccattgggctgcccagtactgctgcctagtaggagtagctgcattgcacgcatgtttcccattactgaatctgtacgtacattttgcacacggaggaacaggactcgtcctgtcgccaagcattggccggaatgacggcttcatgccgtggctcgtgagtcgtgaccattgcattgcatgacaaaacaccacacacgctgttcgtgccgtccctgccctgctgtaccttaccaccagtacaacactccccaccccccaacacacacacacacattatttctccgtagaggtagtaagttttgcaccgttcatatccaacgtttgaccgttcgtcttattctattaaaaaaacttatgattactatttttattgttattagatgataaaaatgtatgactttttttttattttttttataaattttttaaataagacggacggtcaaatattggacacggatactcacagttacacttattttaggacagaggtagtacatccggtttataatagccgattaacttttgaatacatgtttaaccatttatcatactgaaaaattatgtaactaccttttattttcatgtgatttggtttagcattgttttaaacatgatttatattttttttgcatatttatataaaaactttgaaataaataaattgtcaaatgtatagcgttatctattaaaaaaacccggaggaagtatcttggtaacagcttaagatagctgatatcatcatgccattacctaattcctttttttttatatcttagagaacttgccaagtggtgaaatgaaatgaagttccactagaaattaaccatctgcctagctatttaacaaactcacgttaccatcactactacctgttttacagtttttattttctgcagtaacgccagaagagagttacacgctaatgtgaaaggtaaactaaagatttaatatatatgatgtggttatctgggtcgatgacgatcatgcacatgccatgagcagattaggcagagggatggcgtgtagagaactgaagtgaacaaattgaataaattatgaggatacagtcttcttggacaagcacgcaccgttttcagaataacaaatccttgagcagtaactgttcttgatggagatgcatgatgtgtttttcaaaccccaacactcactctgttacaggtaagcaaagagtgagaagaaagctattgctaatactatagtagtgattactgctgcccagtatcttattactatcaggttcccacagccatactactactcgagaagagttgcagaactaaaattggttgacttggatctgcagctgcctttgtttgcaagacaagtggaatcagatcgaatttttggggacgagacctacttgacgttacacacgtactcctactgaataccagatcattcatagtaccaataatttactacaaccattagtaccagtagagtgtactggcctgcaaatcggttgctagctgcatggtagtactcgactagattaagagtagctttgcactgctacgtagaagtagtatctttgatggctgtcaagtacatggagcgagtatttacctcaaatctgagctaactatggttattatctcatatcaccatccgtgtcctacagtaattaactagaacatcaaatgctggcagacatgatatcagaaattcagaactctgaatttatctgaagcccagtaggagcactgcaccatccttacatctgcgaaccattagagtgattaatagttctagtatcacgatttgccacttgatacgcgattaattctttcccgttctgagttctgacaagctacatcaggagtactagtactacagtactccgtatcttgttttctttttgtgaggaattacgtgcaagttccaacagatcaggctggacagaaaggattaatcaattaagttgtcatcagtcatgtctttatcatgggcgattagatgctttccctgcggctgcgatgctggctgcggccacaaggatgccatttacgattcgcagcatggtccacgcgtggtgtcatcgctcaacttttccaacggttactactactcgatctcctactttactcctatataactgaccattttactttttactgtatcttactccatttgttccataatataaggcacaactattttttaaagttgttttataattcagtataagagcacccgcaatggtaaagtaaggtgctatctataaaacatgtacacctcaacaatagactagattaatagtaaaccacttcaatggtatgtctacatgggtatctatagctctctaatccattgcctcgtttttctctatagactatctccatgttagtagatagctttgctctctctcttcatttaatctcttccaagtaggaaaatatgctgacatggatctcttgtagagagcttatagataaccattgtgggtgccctaagacaggcatgcatgcatgttattaagtagtacatttttttcactcaaatattattatttaaatcctccaccatcaagatatctaattttattgggtgcatatattctatttattaggtaatccaaactacgaggtaataataattatttattggtctttgggttaagggtggttgttccttatatttccatagtagtagtaatacattttcattttaattttgaatccatatatatttgagtcatcatgcatggtatcatcactgagtgataatagtacgagattattagtagcaagtaatcattagagcagtccattcaggatgaagtatctttacgtatttgacgaggaattgattgctggtatcatgcagacacgaattagcttggacgccatttgcaagcgatagatcagggcaggctcgccgctagctctctcctcactctagctacagtgtacacgcaagctcatcattagttcagacaactaaaatttgaagcatctgcactgcaaatatgacaagacgccatcatctgtgcatgccaaccctgtacgattgatacacacacgcacgggggttagttaattaatgatagatattctatgagattaactaagcaattgaatacttaattaagtaaagccggcgctcatgcagatgcagtgtacgctgtgaccagccgagattagagattactgtactagtagctagttagcgtgaactaccatcacctactcccttctactccatcgcatagtaatagtaataaactaatgatagtatatgccagccagctccctgatttaataaccaactcgctcttaatttcttctacctcgggtaattaacataagtaatcatctttcttgcttgtgatgtggacgtcacaaaaagatctatccatatgttcatcgtagttaagcagtagtggagtgctaccatggaatgctagctagtaattgattctttaccaacaatcgacttttttatattaccctcaacatacgtctatttactgtgattaatctgctagctaataatccttcactgacttacgtactgtaagccaactggtcaatgtatatatcgtctcttcagaaagttcagagcacgcatcgaattaacggcacacacccatctgttgatggatcgagcttaattaattaatttataaatgaaaatgatgacacagactgctcatcttttaactccaagttgatatttaaatactcatatatcaaattcctgaacccaggaataccatgcagaaacaactgacctgcagtttcattttcagctggttgctgcaacgaccagccagaaatataacgaacttccgaggtgacatgtctgagagaaacgcccacttgtgagtagctttcctcaagaattcatcttgtatccacctgtggcacgcaagaaccttcgtataatcacgatcagatcgacagctactgaaggattcaaggatacactgtttcatgctttggtcttcacttgtgatacagccagattccgtttcacctttttatattgcagttttcagccacatgaaatctctccttattgaaattaaaactagaatatatgttctagaaatcagtacacatttcctaaaaaaatgatggccaagacttggctgcgttcttaatgagcttagagactaggttactcaatcgtttacagagagcacgtttttcgaactaatacacgatatattttgtgtaaaaaatatataaaaaattattaaaatgaaacaaaaatattttttaatatataatagttaatacttacatgattaatggttatactccttccggactgataatacttgtcgttttaaataagtgtgaggtcaatctttaaaatctttaattatggatcatttttaaaatatttatctttcaaatatggtgactacatgtatagattagtcttaaaaagtactttaataaaatcatatatttgttaacacttttatacatattataatgaaaataatggtcaaagttgtttttttgagatcgtgctcttgtccaaaataacaaatattatcaacccagagaaagaactcgttacccatgccagaataagttgagtcagaaacgaacgaagcatttgacagaaccatagtgaagttccgctaacctgaacattagacagtcttggaaaacaaagacatactgaggccctcacataccaatggtgtttcatttgatccatcaaaagttcatgtaagaagcattccatttccatcacaaaccacacaaactattgaattaaatttatgtggacttttcatttgcctttgaggcatgctatggctgtgtttagatccaaagtttagatccaaactttagtccttttccatcatatcaacctgtcatacacacgtaacttttcagtcacatcatctctaatttcaagtaaaatctaaactttgtactgaactaaacacagccctatatccatgatgctgcagtgcgaagaatccaaaaggacattttgggtggagaggagcagaagagtacagaagggacattcatgtcattcaggtcaacgactctctgctcccatccatccaacggaagcccacctccgtacggtttacataaacaaacgcatcaaagacctaattacacactgggttggtcatgtaattctcccccacaatatactaacctagtactccttttgtaacttgcaaaattttgattgtattagagttgcgacaaaaaatgtcaatatttttcctatctaataaaattacccttgattaactaaaaaaagaaaaatacccttaagcgtgcatccttttcattgacagcaccggcatgtatggtttatgatatgcagttacttgtacatcacaaaccggcactattccctccatacgcaacaaggatttccccccccccctagcagtagaaaactcaagctacaaactaccaggtatttcataaagtgcataattgtccatgtaaaccttgcttagctgaacaaatccaatccaaagcaagcaaaaccattaatcaaatcaatcaattaaaaaaatcaattaatcaattaattataattaatccgcccataaatcagaatgcaagcagagagagagagagaggaagtccaatgaagaaagaataaaagccacccacctcttcccctccactccatccatctccccttctctcctcctccctctcctcctccgcacccatcgccgacgacggcgaggcctcgccgccgcaacctcctcctcctcctcctatcaattctccattcctcgccgcagccacaacgtaagctcgctcgctcgctcgctcgcgcgcgcgccttgggaaagaagaagagagcagagcaggccaagaacctgtggctgggccatgtccggcgtgcgggtggcggcgaaggcgcctgcggcggcggcggcgtggccgtacgtggagtacatggcgcggtgggagcggcaggtggagcggaggcagctgttcctgcggagctaccacttctcgcgcgacgtcgagctctcgccgcgggcgcgggcgcggcgcgtcgtctgggtcgggctccgcaggctccgccgcgccgcggccacggggctccggcggctgcgcgcgcgcctccgcctctgcttcgcctgggtctcccgccgccggaacatccaccgccgcggcgcccgcttcggccgctacggccgcctctccggcggcgccgcccacgccccggcgcccgccgcgtcgtcgtccgtgtgcttctggtaggagctcgaagctgcaaagcatcgatcaagcaagaaaggcaaagctaggttgggttaattggcgtctcaaacaagaaggcaatctaagctcattgctgcttggataaaaaagtaaaaattagccggtaaaatgttagtaacttgtagtgtaattccatggagtcagttctttattactgcttcactagagaggataaactgggtgtttattacctaaggggattgtttatgttcagtgttttttcgttcttttctttcttttacttttaatggtgaatctacactctactactctgccggtctgccccaatggatgaacgagctgtgtattttgctcaactttttttttctgcatttctacctgctcctctgttcttcaggtcgcttgatttgacctctatgttcgcttctttctttcttaaaaattgacatgtaaataaaatcagggttgtgtacatatactatgcatgcacgtgcatatgcagtttcagacaaaatcagttttttttttcttcagaaaaatgtgaaatctttgaggccactgtggcaatctagtatcaatcatgcaaacaagatgagaagagaattggagcaggataatggaaagatgcctggccggtgaatcttctgagttgcagggaccaagaaagaaagaaaagaagcccaaagtctgaggtctaattctaaaaaaatattcagagtttgtttggaagtaggtgaggtgagccacggttcgtgtttcagctttatttcaagtgcgtgtcgcggtcaaaaggcagcagtgcaaggagaagaacaactgaagaagaagagataagcaaatggttgctacttgctacatgcaatgcaaggaagacgatgccaaattgaaaatggcatctttgattcctgcctccttttcaatgaattccgtgagagattgggaactcctcttctctctgatgtgcacaagatttgatcttggattggctgaattcactgtcatttacttcaaacaggcagtgaacagccggcatcacttcttaggaatgcagaaaaacactgtaacaaatatgtttttttggaggcaatctttgtgttgcaatctgtcaaatatttttacactcgtccagtcactccatgccggcacatatgccatcacaataaaggattttgttcagtacaaatcctgaaagactttggctggcaccaccgtgtcaatacgccttaactgaaacactgtactggcaggaagtaattcatcactggttaaaactgaccgatcaattgatgcactgtagcatgcactccaccaaaatcaatggagtactagctttaatttagccgtgtatgttactacaccttctccacgagtccaggccgggtcagtggactcagtcattatcactaagaaatccatcattattatcctggcccatatgccacgctacaaatctaaatgcctgattaatcaagtcagttagctattatcttaaagcctctgtctcaaaatatatataaggatactatcttaaatttatgaaaagaataataatatttacgaacagaatatattgatagtatcatatgagcattgttttgaaatatattttcatagtttattttttgatgcggtagtttattttttgaatatattttattttcatcctactcttttcgataaaaacttgattagctaaaagattctaacttaggacaaatctgaatccttatatttggggacggattgagagaggaggtagtagtaggactcctccatcttacgacgagtagggtacttgtactatctacatgagatgatggtcccagatgcatgtgctagctagctattgtctgcgtgatcttttcttgactcctctctctgcattctgtttaacgtagttcatgaacaatatgatggtttgattctggaatgtggtgccattgtcttttcaaaagcatgattgagcaattcgacatggacgttttcttctttttctgatcagaaggatcggatggattgtgatgtttcagactttcagtgtgtgagaggaaattcaggtaatcatacattcatactgtacttcagtactggtagcaacagctttggaaacgaacagctacctcgttgccattgcagtcaggtttggggaacctaacagagacaaaatttgaatccaaaagctgggaaataaacagcccagtttgaattcatgatgaggacaatagctcactttgtgagtgcagattgacaaagtccactactgtgtacttttaaggttagctgctatctgctttagaagttgtaaagatgtcagtgctgctaatcttctcagggagctgccatggtaggatgtacacctgaaatatgaaaaaaaggaagagctaacagtggtagtcagggtttataatactacgctattacctcacgattaccgtggtaaccatctcagtttttcgtggtaaccatctcagtttttaaaaccttagggtttttctcggtaaccctacgcttttgctcgactacaaccggggttcccctaccatttttgtagtagacagaaaaaatgtacgagctgtccgttcatctcttcctccctaactttgtttctcatcttttgggtttccaattagtggcggatttaggccatttctgtgggatcggctgaccccacggctttttgaaaaacaccatataaatctcgatttcatgtataaattcaaaaaaattagagaaataacccacttaaatataaatcattagtaattgaccccccaggtataaaattctggctctgccactgcttgcaatggagcaaattttgccaaatcatttctccattctcgtttcatttactaatcctacctaatgaataatgatacatgaatgtaatgcacccgttcgtgcagacacagtaccaccatgacctgtcttaagtactcctatatgtaagttaaattgaagataaacatgtatagtttgggcgcttcacatggctctcatttatgatgcagcagcgacagcagcaataacagagatagagatgaatgcccttcaacatgatatactgctagcgctccttcatccacgggtttcatggaccaggagattgattactattcgcaatttttgcctctttttttttttctaatccaaattctaaatccgctaggcttcgtctggaacgtgcgaaatttttaacgatttttgtgagagataagctgatatgtgccgcaaatcctacgaagttatttcctgccagattttggcattccagaacattccagcatggcagtatgaactagcactagcaggatgcagtcttaaaaaaaatactactatataaaatacagtattagttaataataattgttccatggtaaacaaactgcgctaaaatattagtagacaaatattgcaattgataatgaaggaaattgattgctgcaaggaaaacaaagaggtgcatctgtactatttagcaatttagaatatatatattaaaaaaaagaagggatttcactgtcatatagaagtactctgcgatttgatgatgctcaatggaagtccaaaacagaataatgttaactttaagaaatagaaaactggtatatttttccttgttatctttggtattttctgatacaactgaacatatataatcaagaaaaacaaggatattgaggctcattaaatataacactgatagatccttgcagtatcaacatggttcttgaaagtatcaaaaaagattctgtggaactgcgtatagaggggggaaaaaggagaaataaaccatcccaaatcctcagcaattcaaaataacttttattttctgagacacgtgcaatactagagaccaagaattcttcttgcttccaattcggtatagagtattagaggacataaaaaaacattttgtctgcagatgaatatgtaagcaaatagatataaacctcaatgaaaagtgtgcaaaattatcacaagttgaaggtttctctcttttttttaagaaaaaaaagagatgatcttgaggaatgaagattgcttaacgcaaaaaagataataatcaaatactgcttaatgggatcagatagtcataaaattgctccagctgtgtactagaggatcctcctcaatactcaatgagaaaaacccaaaagttaagtgaaaggaggccattagagaaggagccggcacggcctgtcacgaatagaattgttgcggtccgattctaaatgggccaagtaacgcaggatggctgtgctagtgggcctgaccacatgacgttgcttcgatgacgggcctcaccagtcaccgaattgggcctctcccagccgggcctagcccatcaagaaaccataatttggatggactaatcgattagcatttcgcaacaaacaatcatattacgcgtacaaataccgcattcccgccaaaaaaaaaaaaaaaaccatttggttcgcctgagtccgagtcggtctcgaactctcgatcgattgcattgtctgtactgcgatttgatcgcgcgtacgtgcgccacgtccacgataaataccctcgatcggctaccatctgctagctctagctctcctcgatcaattcagattctcccctgatcgaggtgaagctagggcaacgcgagagctagcgccgccgacatggccgacgacgacgagatcgctcttgagccaggctacgtcttccacccttccgacgacggcctcatcaccctcttcctccgccccagcatcgccaagatccccttcgaggaccgcctcatcaaccacgccgacgtctactccgccaatccggccgagctcgtcggcgagcacagaccggcgccgggcacccatgggagcagcagcgtctggtacttcttctgctccccgcgcttcaccagcaagcgcaagacctccgggaggcggcagcgcgcggtcggcggcggcggcggcggcgagagcgtgtggaagtcggagggcggcaagaaggccgtgatcggcgccgatggccgccgcgtcgggtacctccagaagttctcctatggcgtctacgagtcgtcgtcgtcggggtcggcgcgcacgttcacgaggctagggtggtgcatgacggagtacggcctcgacgacgacgccatcgacggagcagacaagcaggtgctctgcaaggtctaccgctcgccgcgcgcggtctgcgcggaggcgcgcacggcggcggcggcgaagtcggccgattcgccatgctccggctcgaagaggaaggcggacgacggcgcggatcacccggaggcgccgcccagcgcgcggccgcggcaagaggaggccgggagcgagcagccggcgatcctgccggagttggacctggatgcgttgctgtcggcgccgatggacgacagtttgggagtggaattcgacacggccacgacggagcagtacatgaggtatctgatgaacgacgagccattgccgtgggctccgacgatggaggttgccggcggcggagacgaattcatcgagacgacgaacggaccttgcatgggcgaagaggagatcatccagcggctggcttccggagaaaccctcgacgacattcttggctcgaaccctaattaaatgaaacaagtttttgattgaggtgtagtgagcggctgtagcactaagtagtgcagtgtttttcgtcagagaacaggtttagttagacatgtactatgtactacgtatcaatcaattagttaggtgtttgtttgatcaactgagatgcatgaagatatgcattgctcgattgatcatctcgatcgatcgatctgtaataactaatgagaagagttgaatcgattctttctgtaaagtctgatgtaataatgcccttctgtgaagtgaactaacgaaattcatcttcatcagagagattcagagtgattctctttttgtatcttttgcgagtattcatcagagtgatttgttctggcgtttgggcaaaatctggtttgatatcgctgtgtcgatggctgtatcattgtgcgctaaatctaaatgggccaaattgggaagttggctcgtggtggtaggcccaaccacgcggcatcccctccattatgggccctacccgcggcatctcctcgtggacataggcctggcccatcacgtactcgggggctgtgtataaattattttttaacgcggggtcttgttgtaagtttgccaaatcagcttaaaatgcaaagggtggataggataaggcaaagccattgggctcgtcggagagacaagtagagagcagcgtagtcgccgcacttagccatgctcgcctcgccggcgctcgccggcgcgcgcgccttcgcggcgaccgtgtccgggagcctcggcatccccattccggccatctccgcgccctcgccctcgcaggcgcggcggcgggcctctctcgtcgtcgttgcaaaggtcaaggtgtccactccccaggccgaccgcatcgcccgccatgtccgcctccgcaagaaggtagtaatagcgcctgcacgaggggaattagccaacgttgtttccaatctcttgcaatgcgatgattgcgcgctcctttttgcggttagttggtaggtgtgaggcttgtggggtgagagcaatgtcatgccgttgacgtatttgatgaaatgcctttgtggcggcggtacactaaggagagtaggattcgctagtgtcatcctcagtgacgtccagttcaaacgagtaatatcttgtttatgtatgtcttgattagtcctacttgttagaatgtcagttggccgtgaggtcgcaaacaaacagtttgtggctttgtgcatactatggtgggtgactcagtttgtaggctttgccagaatcagaatgcatgtttctgtgaataaaagcatgcctttgtgtaaaccttacataatttatttcaggttagtggcaccacggagaggccaagactcagtgttttccgctcaaacaaacatttatatgctcaagtgattgacgatacaaagtcatgcactctggtttcagcttccacaatgcacaagtctctttcaaaggacttggaatactcggcagggccaacagttgtaagttgattttgacttacccatgtctaatttctttgcttctttttctctctgaaaataataaattgagcagtgcagtaccacaataataccgtaggtgatgctattaacattttgtaggtgcacttatgtgaaaagatgattgtgcatccatatttgtctgatcagacaatcatgctcaattcaatctcacttgttcaaatccttaacctagtgtcgtctcttggagacattgattgcgaaatcaataggttctagaaaaacttaccattgaaatatctgacgatcctttgctgatgtagctctgaagaaaacccagaggaatgcacaaaaaatgaaagctgtttgaagttgtcgcggttgttttttatggttttatgcatgtggcatttccattttagtacatggttctgagctctacttacaaattaaatgttccacaggtcagatagtataggattaacagtgttgaacacgtatcttaaagtttagtgtgaaaaaaaatatatcgaatatatttctgcagttgtttcttgccgaaagtcacagctctgtttctgatgaaagttctctgttgttctggttggtttccaggaagtggcacaaaagattggtgaagtgattgccaagtcttgcttggagaaaggaattaccaaagttgtttttgaccggggtggtttcctctaccatggtcgcattaaagctctggctgatgctgctagagagaatgggcttgatttctgaaacctccaaatgtttgttcatatctccagaatcacttgttactttctttttcgcccacctgtcgaacagagtttttctttgtagtaatttgatttgctctgcaggcttggctactctttaattgtatatcaccccactatcagctcaccagttattgagtttgtctgcttcatgaagtttcttttaacgggcatattttcagtttaatagatcaatctgttgccatcctatcctacatgtgttgttttgaactctgttcgtgcaaaatggagcactcctacaacctgctactagagttctggcctgcaaaagcccaggcctgaaatggctaatgtgggcttcctggccaacattttgtgccaggcctcgtactcttgtcgaagctgtcaggtgctctggagtctggagcgcgttattcagattacaaaaataaaaaacgtgctaattgcactgatgcatactactgtccttttccttttcatttattttccatcatctctgatcgaattatctatcagtaggtaacatttattttctaaacatctcttccatgagtctttcagagtaatggctgattagtgattactgaagcgaaaatgaacgccatttactaagcttacatttctctcactttcgaaagaaacaaatttcaatgtgccaaaaatcgaaggtgtgtcttgcccttgctattagatcaacaggaaaagctgggagcatttgggaattgcataatctcagtattagttgtgatttgctttggaaagcttaagcgattcaaatgtttgcaaacaaaatttacacttttgacaatcttctctttttcatcggctataatgaagctccaaggtgttcaaccaaagattagcgttattttatttacataacgttccacgtgattatttataaaatgttctgcaaaataaggcaatcagatggaaagggagagcttacacatcaagtccattatgtgattttctgttaatttaattgctcgcggtgtcttattcagtttgcattttttatggtcatttggttctctcttggattggaacacagcaactttcattaactagatctcaatcgtcaacatgttttcaagctacagtagttgttagctagaatctatcacagatatactccagcaatcatgtctatagtcatgcggcgagttaggtattcaaatgcagtggatgcagatttttcttcttcttttgttgttcagtgaccaagagcaagagctatctataaataaaataaatatgttaaatctcgaaaagggacacgacaaaccgctcaggtactcttggagatatatatattacacgacaaacgtcattacgtgcgcatgatgcatagcactttgcattgcttgtgaattgtgaagtcttagaaatgacgttatttcctttttttttctaaatctaaaaaaaaaggttatgttgtttctcgagaaaaatgttatgttattacattgcctgtttttcccaatacatggaaaaaatttagtaaattcaagtactagtgttgcaaaatccaatattttgggtggatttagtaatttgtggagggcgaggtgtatggttctttcatgaggcattctctcatttatccgacttacaattcggagactccggagactgacaatccggactctggagagttcaataaccagagtcatggtctaatttatctgttaaggcccctttgaaatgaatgataaagtttttgaaggatttaatttttttaaaggattttttaatagagtcctttgattcatagggagagggtagaatttttttgttatatagaactgcattgcaatggccaataccataggaaaataaccaagatgttggaacactttcagttttttttattgtgatgcaatcaaatgactactcttcccaatttatgtgttttgaatttatgtgggattaaaaatatacactattccctttttttttccgtgggaggacatcgattcatgctttttttttgtcatgcgtgtttcaaagggctcctaaatatctgctaaaggatggagattgatgaccgttcaagaaaaaaaatcgatgctgacagttcatcgataattcagatagtaaaagatttgtgctgtgaatggtaaaaattgaaaagaaaaaatagcagtagagagagacgggtctcgagtggcgataagcatgcatctgatccgatttccgagtagtccaacaaaagattattttttagatgatagatttttcattaaccctatatccacaaagaatataaacggccaaaatccaacgagagatgtccaaacaagaagtacattgcacgagtcgaagtctccaagagatcattgcagatgcgtgctggtaaaccacgcaacgtacgtacgctcgacacttgcaaactgctgccgcgccacggcacgacactcgtaggttcgttcttgcatatatgtgccaaacttttctacaagcttgacacgatccttaccttgaattgatccaatatatgctttgacttatcattgcaaagattctttcttcttcttcttcttcttcttcttcttcttcttcttcttcttcttcttcttcttcttcttcttccttttctttttttttaaaaaaaagaagaaattgcagttcactgaatggctttcaactagaaacgcacacagtggatattgctgcgatgctgcatctgccggtatctagaacgaacttatagaatccaataaagatttgcacaaccttgcacaagtgacgtgcacaagattgaggagacattgcttcttttttatctttattttgagcaactctgaagaaacctttcagtactacagctctgaagaaacccgttttttctctttaattagagcatatctgaagaaacccctttgtagtacagctctgaagacaaccattttctctctttaattatagcatctctgaagaaatgtaatagcatctgttagagcaagcctgaagaaacttcacacgtcattcgcttgtgacctagataaacaataatgctgcaagtgtacaactatggagttatattgtaagctacttcctccgttttatattataggactttttagcattacttatattaataaattatttatatgaacgtgagtaatgctagaaagtcttataacatggaagtaatagtagtgtactgctcgcctcacatcgatatgatcttgcagcgtcactccacacctgtagctttcacaagttggattacttctcaaatcttaactgatggtagtgctttaaattattgggcaattctggctacttaatttttatctccgattttttaatatataacacaacacaattgattttttattagtatttgtcttttcaaaaaatatgtgtttaaataaacaatcacaccaggcataatggtactcttttcactccacttaagtaagtaattggataaatattattggttaaattttgagaaaaaaaatcaattgtgtcatataatatttaaaaaatagatgaagtaattattaagtacattattattaattattaactactgctgattaataactatattattacaggtgttattgatccgagcttttttttggacaaatatatttgcagatggaaggtgcgaagcatgccgaaagcagcgatgggatttacgacctgagaagtgagaactttcagccggccacagccggctttagactttttttttttatctgtggaattcgttcagagaacaacaaagctttactttgaccctttaaacttatatcacctaccaatggagctagcgtaagtatctagttctcctttgggaaagtcggcaaggaaggaaggattaattaggcaagatgggtaagtgccaacattaagaagttaactctgcacttgcagcggttgttgttacagttacctatcgatgttactgcctagcaacctcttttttttttttttgccgactgatgctgtacgactgtacgtacctccccatgtctatacggtttagtttaatcttaacgaaacattatgctctggacagatagtacattaatacagtaattaattcgccataaagtacgttgatgtgattagatgtacttgcagcagcattactagattaattgtattcgttacgtctaaaaaaaatctgcctacctagctgcctctttggcgatcggaatttcagaacaaactggaggaagttttttttcttttcgtgttaaaaggaaaaagaaagaaaagaagtagaagtatgattaaaaattaattagaagaaatgtgaccactgcatcttaagcacgtagtagtgcatcttgaattttattttgttttgaaccatatgactgtggattattatgagtatatgcagttccacgtactccgttaacgtggctaattttggctccgccatccaaaccgaccgaccgatcgagtccgacggcaccaccacctgtgcagcatcgaacactttgtaaggacgatcatatcattgcaacacgtacttccgtgtcccttgtgtagtccatgctgacgtttctggcaccaaaatcacccaaaaaacacttaattaatttagtttgaaaaacattaataactaattttgtacgacgacgtggccattctcctgcgaaagtaatcgcgtagtgttcatggagacgaaagcggcaggactcctcgcaagaaagaaagaaagaaaacggcaagacgaaattgtacaaaacaacacgatgcattctagctcgatatgatcgatctgcgccgtcctgtatatgcattctagcatggcagaacgcatggaatgtttcagatattcaaaacacacacagccgtcacgtcatggacgctagctgccggcgacgatcaccaccgttgtccacgtactacttccatctaattaacgtgcatcttctaggctctgctcatgcgcctatatatataaaaaacgcacacgaattcgatcgcgttgcatatttgcatgaacaagtcacaagtgtagtagaagtgcagggcgcaagctgtgcaacacacatggcggcgatgacggtgaggccacggccggccgccgccgcgatcatcatcgccgccgtcttcggcgccgccgcggcggcggcgggcggcggcatggtgggcgtggacgggacgcagttcgtggtggagggcggcaggacgatctacttcagcgggttcaacgcgtactggctgatgatgatggcgtccgacccggcgcgccgcgccgccgtcgtcgccgcgttcgcccaggcgtcatcgcgcggcctcaacctcgcccggacctgggccttcagcgacggcggcgaccagccgctgcagtcgtcgccgggcgtctacgacgaggccatgttccaggtcaccaccattcgtcgtatatcaatgaccatttgtcacgtggaatggtgaacaaaaactcacagtttttgtttgattttctctggttttcttttttgcttgcaggggctggactttgtgatcgccgaggcgagacgacatggcatataccttctcctctgcctcaccaacaacttcgacgatttcggcggcaagcgtcagtacgtccggtgggcggccgacgccggccacaacctcaccgccggcgacgacttcttcaccagctccgtcgtcaaatcctactacaagaaccacgtcaaggtacgtcacaatcgatatatacatacatcgatatactagatgttaaagagctggagctcgatctctcgtgcaggcggtgctgacgagggtgaacacggtgacgggggtggcgtacaaggatgatccgacgatcttcgcgtgggagctcatgaacgagccgcggtgcgacgccgacccgacgggcggcatggtgcaggcgtgggtggaggagatggcgccgtacgtgaagcgcgtcgacggcggccgccacctggtgacggccgggctggaggggttctacggcgacggcgagcacgagagcaagaagctcaacccgtggggcatctactacggacaccaactacgtggccacgcaccgcgccgccggcgtggacttcgccaccatccacctctacccggacgtctggctatggggctccaccgccgacgagcaggccgccttcttccgcaactggacgcgctcccacgtccacgacacggcggcgttcctcggcaagccgctgctcgtcaccgagtacggcaagttcctctggaagggcggcggcgccaacaagacgcagaggaactacttcctcgacgtggtgctcgacgccatctacgcctcggcgtcgcgcggcggcccgctcgtcggcggcgcgttctggcagctgctcctcgacgacgacgtcgtcgccggcatggacgacctcagggacgggtacgagatcatactcgccgaggacagccgcgccgcgagcatcatcggcgagcactccgagcagctggccagcctcaacggccaggacgcggaggcgcttcgccgccgccgccggcggccggcgagctcgcaccggaagacgcgtcttggcagcggcggcgacagcgacgcactccgactcccccgaacgctcttgattcgcttcatctctttgtctagatcgatctcttcatttattcaagacaattttgttcttttctagtttgtatatagcttgcatccttctccttaggtatagttgttcgttggcacatcttgcaactgtaacctgtcgaaatcatcaggaacgcttcaggatggctgttctgacgatgtatgttttgtaccatagtttcctgtataaggtgttttgcaacggttactacgatggagtaccatatttgtttatactaccattcttaattattgacagtagaattttctttactgtttgtaattgttaaattatagtgttgatagtggaatacagtagagaccaccgcaagatggaatgctagctttctgaaaagaaattttgtactacagaactgcaggtccctgcttccaatactgttggccagttgaagtcgacatttcaacctaacacaacgcttattaatcagcgtatccctgactgttttggaggttaacagtggaacatcacttggaaaaaggcccactcagatttatgagttacagtagaaaaaacaaattttatttgccagacatccttttccatctttaaacttgaaaaaacgggaggactacacattgagtgctgcaacaatgacttaacatgtggatgctttcctgcataactgctgagggaaaagaaaagcatcaaagcatcctattggaatcaaattatttacagcattttaaagctaattacgtgcctgtctacttgttgagcgctctgcaagtcttcagccgtacgtggtcaattaacaaggtaagattttctgctctacggggggctgcaacgatggggtgattttccttaatcttcttcattttttaacttccggtgacacaagcacaagagacatgccgtgggaagggaagcaagtagcaaactgatccaaaggccatacatttatacccaaattattcaatgcaggagcaacggatcaaggaatcccaaatcactcagattgcaacgccgcctcaccaagtcggcggcgacccagatggatcccggcgaagccacgacgcggcggttggcggagacgatgaggcgcccatgccgagccgagcgcgagcggtggacgcggtcggcctgcattttgcttgggcagtggcggtgggccggtgacccattaacaggtcatgtcgggcctagtatgtatgggccaaagcttccgcccattaacgtgttggaccgttgacggttggtgttagaggggtgcatccggatgaaagggttagaatcttctccccacgcgcaaagtgagtcattaattaattaaattttaaaatatattaatatgaacttttaaagaaacttttgtatagaaaaatttcgcaaaaagtgtaaggaatctgaagatgggaacttgtagttcagaacgcagtcgaaaaaagattcaataagatttaatctatccatgtttatcggtccatggtgcaagtttagagtttggggcaatttgcttatttgacgctgttcggaagcataacttctaatttgtcctcactttttcaaatttgcttatttgacccatttctcaaaatgaaagatcaagactaaacctgttatgtgaaaacaagataacggtgctaagaaccaaattgtcatatttttttctcttgttcatttgaccataatatataaaagctttttttattcgaatctttgacataatctattatattattaaaggaatagaaaaaggagcctccatattcgctctcatggtctagaaattctcacattaatcggagaaaaataaaaggcagagtccatatagaaatacaatttagaaataactgaaattcggaattaaaaaataagaatattagaagaggatactagagtccatatagagtccatatagaaatacaatttaaaaatagttgaaattcgaaattaaaaaataaggaatattagaatagtagactagagtccatatagaaatacaattaggaaataactgaaattcagaattaaaaaataaggaatattagaagtagcgtatagagttcatatagaagtacaattaggaaataactgaaattcaaaattaaaaataaggaatattagaagtagagtgtagagtccatatagaaatacaattagaaaattactgaattcggaattaaaaataacaaatattagaagtagagtatagagtccacatagaaatacaattaggaaataatagaaattcagaattaaaaataggaatattatgagtagagtatagagtccatataggaattgaaaactaactaaaatttggaataaacataacaaaattaaaagtaaagtttagagtccgtataaaaataaaatttacaaataactaaaattagaaattaagaaaaacatgggaagaagagtttaaagtcaatataggaatacaatttagaagtaactaaaattcgaaaattaaaaattaaagaatattgaaagatgagtttagagtccacatagaaatacaattagaaataataaaaattcagaaataaaaataaataatattgaaagaagagcatagagtctatatagaaatacaatttacagaaaatttggaattaaaaaaagaaatattaaaagacgagtctagagtccatatagaaatatatataatttacaaataactaaaatttgatataaaaaataattaataactaacacgtatataaaatacaatatgaatattacacattagtagttttgtaaagttattgcaaaatttaaaattatgttatcattttaatatatttgaataatataatgagaaaacatatatgctattatatgagaaaatataatgatgctagccacgcaatctgcgcgggccaccatgctagttgtaataaatttagcatagctccgagatttgagacaagtttaatcgatttggcttcaaattgatatatttgacaaatcaaattaacaaaatatgatataattatctttttcccatcccaaattgcatataattaataaaatatagataaagcaaaacacacatagagctgagagccatgcgccactgtcgcccctacttctcacgtgtcgctgccgctgctggcgtgactattgatcccttcgtgcgctgtagtctccgctgctacctccttgcccctgccccccctcgggtgccactacccctggcccctactcccaccatgcaccgttgtcgtcgcaccctctgcgagcccacaccgctgctctcttcatgtgtcgttgtcgcagctctcatcgcacgccgccgctttcaccgccccgctacctccgcacgtcaccacccccactccctcctcgtgtcgtcacctctccctccatctcggctactgtccgccacgctagtctttggagatgaatggatgagaagaaatttagggatatgatgttgtgtacttaggggtattttgtcaatttggcgtataaatagtttttttaaatgaaatcttaacagtgtttgcaaataaggtcaaacgacaacttcaattttaaaaaatatggtcaagtgagtaaacttaaaaaaatagagacaacgaggtttaaataagcaattgtctgttaaagtttccctgtctttcccattgatgaagatgacagcggcaaccaagctgcagtttgccggcttgcagcctctcggatggctgatggacggttgagatgaaggcattgtaggcaagggccaatcctgtccaacccggctccgacacgtgccgttgccagtttgccacacctcgtcgaggcgaatcccccgcctttgtgattcgaaccgctttttgggatcattcgaatccaatccaatcaatc

SEQ ID NO: 43719 - DNA, 12670 bp, Oryza sativa
tcatggctagacgtacggggtgttgtggtgtattttggatagccgaacagcacgaattctcaataggctagattacggttggattcctgaatagccgacctgcaatttgggtggattaggtttggttcctggatagcctacctgggatgggttaagcttaattctgtggaagtagaattttggttgattatcaggggcttagagttgaattcagtgaggaattttcgttttcttagatttaggcgtattatgatttagggaggtttcgtgaggaatgggatttttattttgctggttactgtttgatttcggtaggaatttgaagttgaggtgattgtggttgcaaaagagagagaatctggatgtgtgccatctttctattatttaggtcgttgattgcttaagtttcaatctaatgctaaatttattgtattaccattctataacttttgtctaacacccctggtttaaaattttcatgtggaacctgctatggattggttgggatattttcatgagatctcttcatcaaagcatgatctgtgctgttattacaatataaatggtgcacgttgctcttgtttacacttatctgtgatttgttaatcttctgttaaacaatttgctccctatgtttgtcctgccctgaaatctggacttgtttagcacaaatggtgcattttctgagacatgtgaatggctttatctctaggtctatggtttaatttggcgtaggttgatttttgattctatacttttgtttccctatcatttgacgctttacacacaaaaaaaaaaacttcaccgttattgactgactggcattgaatatgaagcatctagctgtaatagtttctcagccattagtatggttacgagttgttatgccatactgattgtatttatcctttttttcctggagtgggcaagggaagctgtttttgtttttattcatcctcagtaaaaattttcatctagatcagattatgtttcctttgtttgcaagtgatgtttaaaagagaaaaaaaaataacatgtgggggctaaatcagtgaacaatataaaatttttcatgaaatgctggtgaaaagcagataaggtgtggcttgagcatagtaagttttgacctatagtgaggctgtacaaatcttctgatgtcaatcatcttgataatgataaatgcatgagttcttgcgctttagttcaaagacctccaccctggcgcgctgccgtggcgcctggcgatggcatggtggccgtggacggcacgcagttcgtggtggactgcggcaggacgatcttcttcagcgggttcaacgcgtactggctgatgatgatggcggccgacccggcgctgcgcggcgcagtggcgacggcgttccagcaggcatcggcgcacgggctcaacctggcaagaacgtgggccttcagcgacggcggcgaccagccgctgcagtcgtcgccgggcgtctacaacgagaccatgttccaggtcatcctcgcttgcttaccatcgtcgtcgtccaaaccaacgcaaaaactcactggttgtcttctctgtaacgtttttctgggcaggggctggactttgtgatcgccgaagcaaggcggcacggtatataccttctcctctgcctgaccaacaactttgacaattttggaggcaagcggcagtacgtgcggtgggcgggggacgccggccacaacctcacctccgacgacgacttcttcaccagcaccatcgtcaagtcctacttcaagaaccacgtcaaggtcagtatatatgcaaagcatatgcatcgataatcgatgtgttacatttcaatctcactcattcattcatgctgccgttgcatcggcgtcgatcgatgcagacggtgctgacgagggtgaacaccctgacgggcgtggcgtacaaggacgaccccaccatcttcgcctgggagctcatgaacgagccgcgatgctacgccgacccaaccggcgccatggtgcaggcgtgggtggaggagatggcgccgtacgtgaagagcgtcgacggccggcacctggtgacacccgggctggaggggttctacggcgccggcgagcacgagagcaaggagctcaacccgtggggcatctactacggcaccaactacgtcgccacgcaccgcaccgccgccgtcgacttcgccaccatccacctctacccggacgtctggctatggggctccaccgccgacgagcaggccactttcttccggaactggacgcgctcccacattgacgccacggcggcgtacctcggcatgccgcttctcgtcaccgagtacggcaagttcctctggaaggagggcggcgccaacaagacgcagaggaactacttcctcgacttggtgctcgacgccatctacgcctcggcatcgcgcggtggcccgctcgtcggcggcgcgttctggcagctgctcctcgacgacgacgtcgtcgctggcatggacagcctcagggacgggtacgagatcatactcgccgaggacagccgcgccgcgagcatcatcggcgagcactcggagcagctggctgccctcaatggccaggacgcggatgtgctttgccgccgggcaagctctcaccggaggacgcgtctaggcaactcggttaactgcggcggcggcgacacccttgaactgctcctccggatggtcttggcttgtttcggctctttgtccagatcgatctatacatttattgtacagaatttcattcttttgtgatttgttccatgcatccatcttcatgggtatagctgttcgttggcacatgttgcaactgtaactaggacaaattttcaggatttgttcaagatgattgtcctaatgttttgtaccgtagttttcttgtagactatatagaatgctttctgtgaaaaaaaaatactatacttcaaaacaatcccatcttccaatactactccctctgtttcaggttataagacgttttgactttagtcaaagttaaattgctttaagtttaactatatatgtagaaaaaaatagtaatatttttaacccaagacaaatttattatgaaaatatatattcaattatatatttggtgaaactaatttaatattataaatattactatatttgtctataaacgtagtcaaacttaaaacaatttgactttgaccaaaatcaaaatgtcttataacctaaaacggagggagtatttgccaatggaaatcgtcatttgaacctaacacaatattaatcagtacactttcttactattttggaggttaacagtggagtgtcgctgacaaaagtcccgtggaaatgtttgagttacaacagggaaaacatttttgtttgccatatgcatccttctccatctgtttttctttctttttctttttttttaaaaaaaagagcactacacattgagcgctgcaacaatgggccggcgccaagcgcattacttcacccctaatgggccgtcatgaacacctgatgggtttaatgtcatgaaacctgaactcacgctctctcgctgcattttttttttgcagcaattcaagccacaatgatctggaagaacgttggccttccaaatttctttacattgtctctaggaaaggacttgcaggtgcattcagttagtttcagtttcaacaaccctgcagttttatacttatgctgttttcatttaattcgactagtttcaacaacctctagaatttcaaatttagatagtaataatgcatgcatgtgattagataaaaagttagcgctgacatttcccggttgctttgtttgctaggattgtgttgcatctcatgattctcatctcgatttcgcggtaattttcaaacaagtgtacaagcttctcagggtacttcgcatccaagctagcactattgacctgcatctccttcagaatttgcacgatttgcatgtttagtggatttgcaagattgaaaatcagttagccaagtttgggactaaattataagagcctaagaggtcatcagtgaccgatttaatttgtcagccacaccatcagttctaaattatttttgtggcgtccacaaatttggcctgcatacttttttaaaaaaatctgaattaatcaaccctgttatgccaaaaacggttgctgatgataacatttgatttgtgcgtacgtatctgctgacgataaattacgacagaagcaactgaaactacgatatgatggtctgagaaacatcatatgccttaacggacgatcacattacagttgaattttctagttactactaactaattgcttctctaatcgagtctccgccgtgcaactcgatcacatgacacatgcatggtccatacgcagtcaaaaaaaacaaaaacaaaaaacaaaaagaactttgctttcgtctaatatatttgaggcgcgcaagctttgcgtgatcacgaaaagaagtcacagaaaaacgcaggcggtgaatactcgatcgaattgagttccccaaatcgatctcatctcatcaacaaatgctctcaaaattcgtccaatgcataagcatggaagtgaatgagtgatccaatatttcacaaaaacccagctctcaaaagcccactgcaaccgcttaattacttggctataaataaggtggtgaagtggccatgaatggatcacaaagcttcacccactccaaacctctaacacctgcagtggcctgctgcctatatttgtccaattcgacaccgatcgatcagcttaagaggctgagcttaattaataatcactagtggtcacacgtgtaagcactactagttagcatcagtttgcataatcccctcgcatatttgcagctagctagttatacatatatatggcaggaatctagcttggctgtgcttgttcttgatccatccatcgccaattcgccatgcatgcgttcttgccctgagtcgatcttgtgaattggtggtggtcggagagatagattggttggttgcgagggcgaggcggcggcggcggcggcgaaggggatgaaggcgacgtcggagggggcgtggcagggggacaacccgctgcggttctcgctgccgctgctgatcgtgcagatctgcctcgtcgtcgtcttcacccgcggcctcgcctacgccctccgccctctccgccagcctcgcgtcatcgccgagatcatcgtaagttgttctcatcatgccttcatcagttaaatttcgcaatcctttcttgtcctggtattatgcaaccatactatatacaaccttaattactccctccacattttaattttaatgtatgacgccgttgactttttgacgaacgtttgacctttcatcttattcaaaaaatttatataattataatttattttattgtgacttgatttatcatcaaatgttctttaaatatgacataagtatttttatatttacataaaatttttaaataagacgagtgatcaaacgttgattaaaaagtaaacgacgtagtacggagtactttgtcgttgcatgaactgtatggtttatcattttgttcttgaatcctgacacgctgttgatcaacgacaccacctcatcctggcaaagtttcctccattcgcacatccttcttcccatcccaaacagtaattacgaaaaacggagcggtccattagcacgtgattaattaagtattagctattttttttaaaaaaatagattaatttaattttttaaagcaactttcgtacagaaactttttttaaaaaaacgcaccgtttagccgtttgaaaagtatacgcacggaaaacgaggaagaatgtttgggaaaaggggatagcaaacagagccatatggtcactcattcttacctagagtgatataaaccgcagttacttgaggataattctagtaccaataatcacaagatcaccataccaaagaccaaccgatatttttttaaaaaaaaaatgcgtgcttttatactagcacaaccaaaaaaaaaagttaagctttggacctcaggaaaattaatccggctttgtaggtaagggaaccagaggtggtagttgcagaagattgctggctatttttgggtcacctgctagttttatctttcctacttttagagcaacctgtacttagtaagcactaagatgatgttcttgacaagatcagtagcttctgctgccattgacaaatgcaccatgcatacaatgaagaacacaatgcaagaagctgaaccttacagataaaaacgtaagaaaactgtttctgatcgagttcttcctcatcacacgtgtgtaactcgtaccagtccacgatacgtaccacgtgcaatcgtaggaacaacacatactaaccagagttttctttcttcgattttgaaaatataaatcaagcattgcccttctatagaaaatacaggagttgacttcgtgaggatggctctgactctgataagctaccggctagctagtacagttaaactagtaggactagtatgaaccatttcgagccagctgactgtttggattattctgtggcaattactgatgcagctattttctatgcaaatattccctccatactcgtaaaggagatcgctttggacaacgacatggtctccaaaatacaactttgactttttgtttatataaaaaatatttattgaaaaatgatatatgtatacttttatgaaagtatttttcaagacaaatctattcatataatttttacatgttcaaacttaacaacttgagagttatttatgaattatattcccaaggtttgacttaaacattgtcctaaacgacttcatttacaaatacggagggagtatttttcttgtgtagctttctctggactaacatatattttagcaaacagatacagtttccaagaagaagaaagtagagctctaaaaaaaactggagaagtatggttcctttacactttaaaaaacataattttcttagattctgaagaaacatctggattaatattaggccaacagttgcatcaccattgaccaccaaagcacagcagcaatacgctgccaaacaaccaattactacagatcatcagttgattcctgaagaatattaaatataaaatataagtagtatatgtgctgtatcaatttcaggcccatagcatcaatcatactatactctttgggttctttcccttacagttttgtatttaattcttcatttatttatttctttattacccgtttgagcaaaatgggtatgttgcatccgtccaaaataagttcatttttcatccaacccacaacacgtgccaattcaaaacttatcaattctcaatgcaactagttccaattttatctgctctcagtataattattttttactttttacaaattctggtacaatgattacttaaaaatagatttattttattttaggacaagtagtaagagtaggtaaaaataaacttattatgagacggagggaggaagcatctttgtgtgatgatgaactgactgcaatggcggcgtgatacagggcggcatcctcctgggcccgtcggcgcttgggcggaacaagcgattcctcgacaatgtcttccccaaggacagcctcaccgtgctcgacacgctcgccaacgtcggcttgctcttcttcctcttcctcgtcggcctcgagctcgacccggcctcgctccgccgcaccggccgcaccgccctcgccgtcgccgccgccgggatctcgctcccgtttgctctcggcgtcggcgcctcgctcgtgctccgcgccgccatcgcccccgacgccccccgtggcccgctcatcgtgttcatgggcgtcgcgctgtcgatcaccgcgttccccgtcctcgcgcgcatcctcgccgagctcaagctcctcaccaccgacatcggacgcatggccatgtcggccgcggctgtcaacgacatcaccgcgtgggtgctgcttgccctcgccatcgcgctctcgggatccgggtcgccgctcgtgtccatctacgtcctgctctgcggcgtcgcgttcgtcggcttcgccacggtcgccgtgcggcccgtgctcgtcttcatggcacggcggtcgccggagggcgagccggtgaaagaatcgttcgtctgcgccattctagtcatcgttctcgccgccggcttcgccacggacgccatcggcatccacgcgctgttcggcgcgttcgtcatcggcgtgctcgtccccaaggaaggcgcctgcgccggcgcgctgacggagaaggtcgaggacctggtgtcgtcgctgttccttcccctctacttcgtgtcgagcggtctgaagacggacgtcaccaccatctccggcgccaagtcgtgggggctcctcgtgctcgtcatgacgacggcctgcgccggcaagatcggcggcacggtggcggcgtcgctgctgatgcgtgtgccgctgcgtgaggcgctcgcgctggggatgctgatgaacaccaaggggctcgtggagctcatcgtgctcaacatcggacgcgaccggaaggtgctcaacgaggaggccttcgccatcctcgtgctcatggcgctcgtcaccaccttcatgaccacgccggccgtcaccgccgtgtacaagccggcgcggcggcaggcgtcgtacaagcaccgcacggtggagcgcgccgacgccgacagcgagctgcgcgtgctcgcgtgcttccacgccagccgcggcatcccgacgctgatcaacctcgtggaggcgtcgcgcggcacgaggaggagcaagctcaccatgtacgccatgcacctcgtcgagctgtcggagcgctcgtcggccatctccatggtgcagcgcgcgcgccgcaacgggctcccgttcgcgagccggcgcggccacgaaggcggcggcggcggcggggaggtggtggtggcgttcgaggcgttccagcggctcaccgccgtgacggtgaagccgatgacggccatctccgacctcgacaccatccacgacgacatcgtcgcgtcggcgctggacaagcgatccgccatcatcctgctcccgttccacaagatgctctgccatgacggcacgctcgagcccgtggaccgggcgttccaccaggtgaacgtccgggtgctccgcgacgcgccatgctccgtcgccgtcctcgtcgaccgcgcgctcggtggcgcggcgcaggtctcggcgccggacgtctcctactcggtcctcctcctcttcttcggcggcgccgacgaccgcgaggcgctcgcgtacgcctcacgcatgggcgagcaccctggcatcgcgctcaccgtggcccgtttcacggccgccgccgacgacgccgccgaagacgacgacgccatacaaaagcacatctccaacgtgcgcaaggccggaaacgacggagcgttcaagtacgacgaggtgtcggcccatggccggcaagaagtggcgttcgccatcaagacactgggtagaggcaagaacctggtggtggccgggcggtcggcggcggtggcgacgccgctggtggacaagacggactgcccggagctcggccacgtcgggagctacctggcgacgccggagttctcgacgacgtcctccgtgctcgtggtgcagaagtacgactcgagaggtgacactggcacatcgtcgtcgagccaagccggaggagaggcgaccgtggaggaatccggcgtgccaatccgccggccatagtcgccggaggagacggccgctacgtcgaggcagccggcggagccatagtcgcactgcctctctgctgcatgatagcacgtatatagcaacattagtgtgtccctcctgtcggtgattagatcatatttggttgttaattattagctaattagttgttaaattagggttcacaggtttatttagagaaagtttaatagtatagccaactatggctccaaatcgcctatataatagccaatgtatacaatagttacctataaatatatactatataattaataatgtctggtctcacctgtcatacacacatgaatcttagagtctgtgttgtagctggctacaaatatgtagtccgctgctcttatctcttctcttttatatttttaaaatatgtttgtagctgacttatagtttgctattgtacctgctcttagagcatctcgaacaggttccatatttaaattttagcaattttgaagcaaaatcgtgctccaatagccatccggctggccaaactactcctctcgttggccaaatttggccagccaaaatagcctagccaaatcgtgggtcccacctcttccccccctctcgtccgatgaacgttggcgccgcacctttgctacttcgcgccgccgcccgtccgcttaggcgacgccctccactggctccgccccaccgcccctccgcaccgcctctccgcgtcgcccctccgccggcggtgcccctccgcgccgccccttcacaccgccgcccgtccgcccgcccctccacgacgccgccccctgctttgccgacgctgccgttgaccgccgccggggccgcccctccgccaccgtcgtcctttgccggcgccgcccctctgcaagcatcgacgatgagaaggaacgaaagagaaaaagaaaaaaaggaaggaggagagagagaggggaagaagaggagtggagactgacatgtgggttcgttgttattttggagaggattaatagagagtctgttggagtgatcatctagtttgactagccaaattagatggagaattggccatatagatgtttggagaatctaatttagagagactgttgaaggtactcttagggaaagtgatgggctaactaagttagtggttaattagtacaaaatgcagtgcagctgtaattttgtaagaaaaaagtgttgtaaacttgtaccccaccagttagcgtcaaagcaaaagttaaaatttgaatttttaacttgattcgatattttctgagtaatttcttcttatttttggcttgtaaatcgctacaaataaatatataaaatactgtaaattaacataaatggcgaaaatattgtacatcacacaagcgtattctcacacgaatttgtaatcgttccagcggcacgcgctgccgcctccatttcccacgctaccggcaccgcccaccgccggacttcctcacccgcggctccggcggcgccaccgcccaccgccggacttccaccgcccgcccaagtactccctctatgcccagcatcggcgaacttctcgacccctcctcgccctcaccaatcccgctcctccccccaccccctacctcctctctcctcgtttagttgagattgcttaccctgtttgattcttcagtggtatgatgtgtagatgtagtccggatacgtgcagcgggagcgcgggcggagctggagtatggccaatctagagggcaaagggaggtaaattaaggtatagaatttcagttttatccattacgcctatgctttgttttccaattcatactcactctcatgtgcaaactaaccaggatctggtaattggaacgatccccattcctgcagactcatagtgtgattcattgaatcaagctaacaaactgactgaaaattacctcatcagtgctgagtctagatcataactaactttatacagaaaacattgagttgtacaacatgtatgatgtatctgtatcaacttgttcaatctcggttaactggaaccaatttatgaaaaggtggttatcacttcccttaatctctgctcaggttgttgttttcaccattttccttactgtagatcacttggtgttgtgcattcccgttctttctgtatgatgatcaattttttagactaaactcaggtccaagtctcccaagtccactaaagacttgactaataagtccatccacaatttctttctgtcagtttccttgactgtcaaaatactactccctctgtccctaaatatttgacgccgttgacttttttaaacatgttggaccgttcgtcttattcaaaaaatttaagtaattattaattcttttcctatcatttgattcattgttaaatatactactactactcaagttttttaataatattcacaaaagttttttaataagacgaacggtcaaacatgtttaaaggagttaacggtgtcaaatatttaaggacggtgggagtagtattcagtagtttacacttcacagggtctaacaaaagccattccctgcttagaattgccagtaggtttcttcagcatacaattactatctcatctcaaggaactgcagtagactcttccacctggacaatgttcccacatattctcttcctatccctgctgctcttggttcctgaagaccccaattttgccgctggagcttcagccaatgagtcattcattactttgggatcctctatcaacacaagcagcacccagtactggtcctcctcttcaggccgctttgcgttcggcttctatcccaacggccaaggcttttctattggggtgtggcttgtgattggtgtgtcaaggacaattgtgtggactgccaaccgtgatgagcccccaattgctggtggttctatcatatttgggcatggtggtgcgctccaatggtcacgaactccatcaactccaggtagccaactgaaccccatatctgacagttctacacctgctgcctctg

SEQ ID NO: 43720 - DNA, 3465 bp, Oryza sativa
tttgaactgtatgatatgaccagacaggtcatatggtctactttcagttttccgacagacacattgttggcaggtcagaacttgcgtccaggcagatttcttctttcaggtgtctctcagagtaatcatgccagtggcaagtataggcttgagaaccaacaagatggcaatcttgtgatgtacccaacaggcaccattgactctggtagtgcgtactggtctacctggactttcaacatgggcctcctcctcacgctttccttagatcctaatggtaccatatggatgttcgacaggaaaaactcctatacaaagatactgttccatgccaaccagccttccaatgcctcccctgatatggaaatttactatcgtctgacatttgatcccgacggcatcctacgactctactcacatgttttctttaagcttggcagggcacctacaacagaggttgagtggcttgagcctggcagtgatcgctgccttgtgaaaggtgtttgtggtccgaatagcttctgccatctcaccgtgactggagagacaagctgctcttgccttcctggttttgaattcttgagcactaaccagagcacacttggttgttggagagcattgccaaccggtggctgcgtgaggaacagctctaacgatgagacgagagtgacaaccacgatggtcgaagtgaagaacactacttggttagagaacccgtatgctgttctaccagccacaactagtattgaagcctgcaaactactttgcctctccgattgtgcttgcgatatcgccatgtttagtgattcctactgctcaaaacagatgcttcccattagatatggcaggatgcctggtaacaccacactctttgtgaagatctacacttaccagaccatatccggtactcgccaaagggctatgagtatccatgcaaattctgcattgatatcaggggtttccttggccatcttttctctgtttgtgctattagtggcatctctattacttatctgcaggcatcggcgatcattggcgcacatgacgatgacggcaccacggcaagaggactccaggattgatgggaacattgttggcctcagatcctattctttccaggaactagatttggcaacaaatggtttcggcgaagagcttggcaagggggcatacgggacagtattcaaaggtgtcgtggccgacaccaaccaggacatcgctgtgaagaggctcgaaaagatggctgaggatgggcagcgtgaatttaacagggaagtgcgtgtgattgcaagaacacaccaccggaacctgctgcgattgcttggtttctgcaatgagggcattcatcacctgcttgtgtatgagtacatgccaaatggatccctggcaaacctcctctttcactcagatgcctcccctgcctggagcaagagggttgcaattgcactagatgttgccagagggttgcaatacctgcattcagagatagagggcccaataatccactgcgatatcaagccagagaacatactcattgacagtttggggatagctaagattgctgactttgggctagcaaagctactgattgggaaccaaacaaagacattcaccggcatccgaggaacccggggctatctagcaccggagtggagcaagaacagagcaatcaccgtgaaggcagacgtgtacagctacgggatcatgcttctggaggtcataagctgtaagaaaagcatggatctgaagcgggctggggaggagtacaacatttccgagtgggcatatgagtgtgtgatgtttggtgatgctggcaaggtggcagatggtgtcgacgaagctgagctggtgagaatggtgaacgtcggcatttggtgcacacagagtgaacctgtgatgcgaccagcgatgaagagtgttgctcttatgattgaaggtgccatcgaagttcaccagcccccaccccctgcatcatattcgcagtcactaacatgagctgcaagcataattctgagtaagtaaaaggcaaaaaaaaaagaggtctacctgtaacatttttttttaaaaaaaaaactgttgataagcagagtgcaatctgaatctactgaatagatccagagtatatgagaagtggcacttagcaaaaggtgtgatcagaagaaacctcattgattgtgtaaagggaaaaaaacatttgatagcagatacccattacagaacaactctttgtcaacaggcacaaaagaacctagctaattttttgtaattttaacaattataatatttcagactttttttagttgaaatgtcaggtcgtttgctgatagaaatccttgtttaatttgcagaaaaatgatgaagtttgcttgaagcgctgcaaagtacagcaagggtcgtccgtctatcaccagttcaaatacatgagcttgcatcatggaacaccctgaaaattgacaaccaagtcttttacattatgcagctataagttttacattttgatcggtagaatgctatggatggcataagtacaggaacggtcctagcagatgctgttatgctagaagtctaatagatcatttcagtgcaggaaaatatatgatgaatcatgtactctgtttctgatatggaataaagtttatgagttctaaaaaaaaagtacaggaacggaaatccattttcgtctgcgatggagccttgatttttagttaactgccgtgttcgcttttctgatcgcgcaatgcatgttggattgttctctgaatcgttgtaaatacattgctgcattctatcgtatcaaatgatttgaaactatgtactacctccatggctctgtcctagaatatatatgaacttttaactatagatttgaatatgtacttgttcagatttatagtcaaaattattatattttgttacggaggtagtttgaagtaaatgattttgatgtcaagcaaatcaactatttgaagtaaatgatttggcaacaaaatgaaacgatgagaagtcccggcccaccaatggttactggatctcaggctctcagctactattcgtgactcgagttcgtgatgggccgagaccatgatcgctaccaatggtagagtgatcggcacagcaccatcgaaccaaattgcccaaacgccagaacgaatcactctgatgaatagtcgacaaaaaaaaagtatcactccgaaatccgaatccacgatgaagatgaatttcattagtccacaaaagtatcactccgaagtccgaatctacgatgaagatgaatttcattagcccacaaaagggcattacatcagactttacagaaagaatcgattcaactcttctcattagttattacagatcgatcgatcgagatgatcaatcgagcaatgcatatcttcatgcatctcagttgatcaaacaaacacctaactaattgattgatacgtagtacatagtacatgtctaactaaacct

SEQ ID NO: 43721 - DNA, 35370 bp, Oryza sativa
gggagaatctgaattgatcgagaaagctagagctagcagatggtagccgatcgagggtatttatcgtggacgtggcgcacgtacgcgcgatcaaatcgcagtacagacaatgcaatcgatcgagagttcgagaccgactcggactcaggcgaaccaaatggttttttttttttttttggcgggaatgcggtatttgtacgcgtaagacgagtatgatttactagtttgttgcaaaatggtaattagcccatcgaatttatgctttttctgatgggctaggcctgggacccaattccgtgacgggtgaggcccatcactgaaacgtcgtgatgcggctaggcccaaatttggacagcgtggccggggtcgtgacatcatcaggttcaaagggggttcggagtttccatcctccgaacccctttgacctctttttctctccaccacatgaatgcctttgtttctctggttccttctctgaatttctctgctaatgaagctcaatcaagttatcatgcaccaccattgaactactaatcttctaacacgcgtttattatcgatcttgccaaaaccatgttcatgcatgctctggccattcagcgtctgctactgattgatcatgcagtacaactttggtcccttctctgaaatgttaccatttttcttctgatgaagcgtacataccatgcgttgcatgaggcaaacattcattttctgcagccggagctggagagtagctcaagtcgtgacgccgccaggttcggagattaaagctccgacccctattttgacctcttttttccggccccaacatggatgcaaaatgtctccttcaattcagccgcccatggctctcttgtccttatcatgcatgtatggccacacatggtgaagaaatcgatcgatagaatcaaattcacgagacattcagacatgttggaattaatagatgggctaaggccaattcaaagattaattctttagaaaatcacaaaagcccatctcataagatggtatgtatgtgagtttaataccactttgcttattataggagagggaacctccttaaaagggaggatgccctcctagccacttgaagcatgtgtggtggagagaagaggggggaaatacacgcgctcgccctgtctcgcagggcagggttgttttgctgcgggaaattcggatttgttttgttttggaaacattccaaaaaatctggtgcgtgaaaacggcatggagttgcgcgacttatccggtttgctgcgggaaattcggatttgttttgttttggaaacattccgctgcggaaaattcggatttgttttgttttggaaacattctgaaaaatccgttgcgtgaaaacggcatggagtccgaataagttatgcgcgacttatccggtttgctgcgggaaattcggatttgttttgttttggaaacattacgaaaaatccggtgtgtgaaaacggcgtggagtccgaataagttacgcgcgacttatccggttcggttacgcggagtgaagatcatgcgggcgccctgatcaagcgacctatctctatataaaccgagtcgctgccttcacgcaacacacacgaaatcaatctagggtttgcctcctctgtactgcgccgtcgctcgtagactactacatcccgctcgccggcgtgcaccggcgatcgggagagcaggtctccggaacctctgccttcgacgtcttgcaccgggagaaggcggcaataagatttttgggaagcgcttcgcgcgactgctccctgttcgtccgtgacggctcgccttcctctccgctcacgtgctgcacgtcttcatcgacgcccgcaaccacgagtagttcctgccgagcaaccggtctttccgccacctcgatacgtgttcgacatgttgcgcatatttgatctgttcatgttttactacttagtttacatgtgtagatctaatgatgcgttcaatctagtttgcatctgaaatgtaataaattaaatcattatgtgcttataatttcaacaagacattcacaacattaacagtttagctgttagatggaatcggcagcataatatttacatgggtattactaccgctgcgtattttgccacaggtagacaaatcaagtgtgcttggcgacaagagatttgctattattgcagagagcttagagctccatcaacatggacaaaaatacagcaccggtatagttcatgaaaggtctgtttgctataaacagatccgggataacaatgtgggggtaaagtacggtctggatttcccaagaacagatccaggattttcttgatacaaatgctctcgaagctctacatgaaaagcatcacaagtgatccataagcatatattagacaggcatatgctaaaagaatatctactttttcatgcactatgtcatatgggaagcctatgtttacaatgtacattagtttcagtacgggcaagccaagaatattgtgcaagtacactccggtttcatgaaattaatggaccaaaatattttttttagttgcgccaataaataaatgcatgcaaccttaatatcttgttttattgcgcaaatcaagatgagcataacaatatactgatatgtccacacaacagattgcatagtattaatctcttgcctatcacatcaagtagaaaatgaccgcttgcgcttctgaacatcaaactcaacatcaatgaggccggttataccagctttgatcttctgtcctggtcgtactgggcctacaccctcaggagtacctgcagaggaattcattaataacccccacaatcacaactctaatgcacaacaaactgttctccaaaaatgtgatttaccggtcagtataacatcaccctccattaatgtcatgatggaactgatataacttattagagatggtatcttgaatatcatatcacttgtagatcccttctgcctaagttcatcatcaacctggacaagatttctctatgcttgttaataatttgttgtactttctacttcttagggggcaaatgaatagattcactacatgcctacatatttgtatagttacctttagccagagctctagatcatcaggattagctacatctgattttggaatctgttcaatagagcaagaatcatcaaggaaagtcaaatgcattggatgcagcaatggaattatgtagttcatattcagtagaatgacatcggcagcattcagagaatacgatccacgaccaacaaaaggagatgccaatctgtaactagtatcctgtggttcttttcatatgatattgactcaccttttccagcattctatgatttatttctatccattaataatcataaagattactggtgtatattccgtctcttcagttatccactactttgaatatggtacttggaactatttattacaagcaaatacatggaaatgaaaaataacgtgtcgagtcaccacctgaaccagtttctttaagcaagagaacacattgcttaccactgcactaattggagtgaaggtgtcctgtgctttacccaaagtccaaggaagacctgcagactacagagtacattggtttctaagtataaaacatagtacaagactgaaaagttatcttacattaagaaactatgtgattgattcatacaagtaccaaggatacaactgccaattagttaccatgattttgcacaaaaatagttataaaaaacattgtgtgtatatgatcaaacaagatagtggtaaccaaattcaaaagaaacaaatagttcttgttctagtagcttatacaattattagttgatatgattgcatgaacataataaagaagcagctactgagattatagtgtgcagcttgttgctgaatttcttttatcaatttgaatgttatgctcttatctatcctctgaaactaccaaggatgatagatggcaataaggtgacaagaccaaagaaaactagggcagctagtgcacaccttagccgcagactgaagttctcttgctgtcatgtccaaagcaagtgcataacctgggaaatccaaagatataccattagttataattgtactttgtcactgaaaggggaaaactgaaaaccagtatagctttttgttgactcgtagaacccacattaacaaatactagcataaaagaaagagtaatagtgaacaatctgctacttactgtagcataatttggtattgaaccaaacaataagatcaatttcactaccatgattatttagagaacatgaagcaaccaacgataaaagaaaatgtgactatgttaacgaatactcctcactaatgagactttcatgagcctggtcatggcaaaacaggcattgaacaagcagatggctaagagcttaaaattccatgtctgaatttttctaccaagcctgtcaaatgtatatggacaaagtttaccggaattgctgaaagagtgaaatttatatgtcctatagttgtccactttcagtctaagtctctaaggcctgctcaaatagttctgaatggcaattccaaggttctagtacgtagttttcacagaacaaagcatatcggcatctcctattcggatttttcggtggaaatcatattttgatttatttaccaaacttgtgattttcttccatgatcagggatatagaagtatacaactcatcacacaactaatcagctgaaaggatgccaccagtttagattagatccattttatcacagcacatcctagattatcaattacctcctacgaagtccatggcggatgcttcggggacgtcgcgcgcgcgctgggagatgacaacggcaagctcgacctcgtggtgcagcgactcgaccggctccggcacctcgatggcggcgccggccacgcccgcgtggaggaacgacgaggtgggcttcaggaacagcaccggctcctgcaaccagacgcggcacgggcaccaccgacgccggatcagggcaccccgcgggaagaaggcgaccggagaacccaccgccgccagtggtggttcgggattggagagtactgtaccttggggacggggttcccgagctccttggcgtgggcgacgaagttgcggcccacccctacgatcttcgtgctggccgccaggagcctctgcgccgccgccgccatggccgccggaggagagctgcgagcggcggagggatgcgtcgatcgaggaggtggaggtggtggtgacggggaagaaatggactccagcgcatggtcaagtgacaaaatatacggcccataagacaaaaaccggcatatcatggcccacaagacagacacctgccttcctgtgtcaaacttttataattttgacaaagttttgtagcaactcttgtaacaccaaattagtttcatcaaacctaacattgaatgtatatgttgatagtacatttgtttggtgttgaaaattttactatatttttatataaatttgattaaacctaaaaaaattgacttaaaaaaagaaaaagaaaatcaaaagtggtagtataaaacggagggagcataggaattagtttataggcatcctagaagctcttttaaattcattcagacccttgaaatttcattgtttgccagatagccaaacttggcattacaaaagctctgcagcattagccaaacacagcatgacaaaagaaccacaccatcagcctaaagcattacatcctttattctcttgaaattattctttacagcagtaaattatctcacaacctcgatgattttggagaagaaacacccgtattgaacttcttgatgtagttatagatgtgatcactgatttcctgtgctctctcctgctggatgaagtgcccagcacctttgattaccactacttcctcaagcataggaacatctttcttcaacctacccttgtgtatgtagcttttgactcctgggagatggtaagccaggtcaccatccccgacaataaactttgttggcactagaacttttgcacctgtccatggtgccatcagctcccaattcctgtgcatgcaggtcagaggttatgagttcctgctacataggattatatgatcatatcatgcaacccacaactgcgtatgttgatgcagttctcaagtccatgggagtgcatgcttgtgatcatgactggtgacaaaatattcaatatggaaattactgaataaataatctgtgtagttcagaacagatttctatatttaccataagtgttttttttcttgaatacgcaggagaattgcgaatcatcattatattaagaagaaggaaaaggaaaaggtcccgacaaactacaagactgagaaaccaaaaagacgcacagcacacggcacacccagtcacccacccatacatatccaccctcacaaagtgttatgcaaacaagaatttcatctctccgagatctgttaactgcagttcatataggttgtgagctcctggttaaaaacacacaacagatgctatgatatctcatagtagtatagaggtattgaattggacaacagttaattccaagcaacaccattatctaaaaaaaaaagttaattccaagcaacgtatgcagtaagacaaacaggatacacagcaatcagtgacaacaggtaaatctaaaggaaaaaatgtgatattgtgcttcatgtttctctctctagtaacctgtcagggagttcaaaaactgtattgcaacgttaaacaggttgtatgtgtgtcttcttttggatagaatttaggtatctggagaaaaataattcgagtgatttgacatgtatgaattctgcacacaatgatttggtaccttaaaaatggcatacttacaggtcaaaacatcggtagtaattaataccaccagcgaagccagtttttgcatacacacttgctacataactgatatcttcctcagagagccaaggaggcaatgttacttccctgttgtttgcccgcatttttttaatggacatagcagaagatcctgttgtttgaacaatcaaggccaatttgaagaatctcttcaagtcaagactggccaattctttttcaactccaggttcctggcagccaagatgacacttgtgaaggcaaattataaaaattacatgactgagagtccgaacatggttcagaaacagttgtgaagcactgacttcatgaggacaaaacttgttcagaaatgaaattattccacatagttgtgcaaaattgttgttgtttttctaagcattatttagtatttactcattagcccatgccaatccatttagcaaactatgtatgattgatatttcatttcaatgtgtacgcaaactacaattggagctgctcacaaagaggaaaaagggcttgcggcacgactatattacattccccaaagatcaattgacaggaaaatttaacaccccagcctagcacatgcacaaaaatgaaatttcctgagtatgtctatgttatgtgttcatctatatgactagtgtgttaagatgaagagcagatgtgagcaccataccactggtaagatactaaaagacttctttttgaaaataagtattcatagacacaactcacttatccattgcaatgaagtgaactattcactaataaacaaaataagcacaatcattctcaaattagttgataattagtggatgatagacatttgggacggggatttagctttaattcttcgattattaaacagatagcagtcgattggccatttctgtggcctacgggaacaaattgcgcacctggaatcggcagacatagtaatcatcgccatacgcgccgcggaagtagtcgaggggcttctcggcggggcgcctcggcatgaacgcgacgctgaggttgacaagcgcgcgcacccggtcaggccgcagcaggcacaggttccacgacacgatggcgccccagtcatgccccaccacgaacaccttcaccgcaacaacgcgcgacgcgtcatctcagcgatttgggggcggaaaggggagagggggcgcgtgctttttttttacctgggggagctcgagggcgtcgaggagggcgacgaggtccccgacgaggtggaagatggtgtaggaggtgtgctccggcggcgcggtggtgccgccgtagccgcggaggtcgggcgcgacgcagcggtatccgcgcgcggccaggtgccccatctggtggcgccacgagtaccacagctccgggaacccgtgcacgaacagcaccgcgggagcagtgccgctgcccggccccgcctccgcgacgtgcatcgagatcccgttcgcctccaccgtccggtgccttaccgccgccgccgccgccatggtctcctctccactccgtcgcgcgacgcggcgacgacgtgcggtgctctgctactggctgtgaacctgctgattacccgaggtagttggagatagttgactgacatgtgggtccagtttcctggatgggccgatgtgatactgggcctagttcctttagtttccaaatgcaaagtggcccaggacggatagagcatttgcatcgcaaagcatggtcaattataccaaatcaatgcatcatccaaacattgggaagaaaattacacaggaattcagtcttttacttatcagtaggactttgcttctttgcgtgacagctgtataatacgaatctcaaagcaacatgtcttcatccctgatttccccagagacttgacttgacgagtaaacgcgttctcctgccgccgccgcacgccagtatccttggcggtgccccctcgcttcggcccttccttgcgtccttgtgggctgtggccctccgcgcctctcgtcgtggcggccagcggtgctagcggcagctaagtggtttgcacgtgttgaccagccgactctttgttagactaactttgcaggtagtggggattatcacttagttctcgccagcacttacgttgtcaattgaaaagaagttcaacagctaaaagacaatggactaggcatgcctataagacttcaccatggtcttggtgatgtgcttctatgatctcgtgatggcttttctctggcagacaatgggtaggcatgccttcaggagttaggtccttgccatggaccctgttggaattaatagatgggctaaggcacattcaaagattaattctttggaaaatcataaaagcccacctcatgagatggcatgcatgtggagtttagtaccaccttgcttattctaggagagggggacctccttaaaagcgaggatgccctcctagccacttgaagcatgtgtggtagagagaagaggggaaacacgcgcgcgctcgctcgcctggcagggcaagcggcgcgcgtgcacgacgttactacgcgtcgaatggttcgaaaaattggctcctcacccttgcggataggttacgcgcgacttatccgaatttgttttgttttggaaacattccggacggttcgaaaaattggctcctcacccttgtgcagatgtagcctccttgtgaaaacggcatggagtccggataggttacgcgcgacttatccggatttgttttgttttggaaacatttcggacttatccggatttgttttgttttggaaacattccgaaaaatccggtgcgtgaaaacggcatggagtccggataggttacgcgcgacttatccggttcggtttacgcgggcgccctgatcaggcgatctatctctatataaaccgagccgccgccttcacgcaacacatgcgaaatcaatctagggtttgcctcctactctgtactgcgccgtcgcttgtagattactccatcccgctcgccggcgtgcaccggcgatcgggagagcaggtctccggaacctctgccttcgacgtcctacaccgggagaaggcggcaataaggtttttgggaagcgcttcgcgcgactgctccctgttagtccgcgacggctcgccttcctctccgctcgcgtgcttcgcgcctttgtcgacgctcgcaaccgcgagtagttcctgtcgagcaaccggtctttccgtcacctcggtacatgttcgacatgttgcgcatatttgatctgttcatgttttactgcttagtttacatgtgtagatctaatgatgcattcaatctagtttatatctgcaatgtcatgatttatttatggaataaattaaattattatgtgcttataatttcaatagacccatggtcggataagatgttggtctcctgcagaaggaggaagagaactcatgaagaaaagacaatgaggaattggagaagaggaggaatcatgctttgagatttggactggacaggtgtcaaacaaataaacaaagtcctaccgatgagtaaaagactgaagtcttatgaaattttcttcccaaacattgaaatttcataggaatacggtccaaattacaacaacatttggtcacatatacgttgacactgattggcacacacgcttgtttgaagagtttttttttttgttttttttttacggcgatgaattgcatctgacagttgagttgagttgagcgcttcagttgggttggggtatgaacttggtgatgaagttgtagataaggtcgctgacctcctcagccctctcctgctggatgaagtggccggcgccggggatgacgacgacgtcctcgagcagcggcacctcggccttgagcccgcccttgtgcaggtagtcctggatgccggcgtagtggtacgtcaggtcgccgtccccgacgatgaacttggtcggcacctgcaccttggcgtccgcccatggcgccgccatctcccagttcctgtccatgttgcggtagtagttgatgccgccggtgaagcccgtcctctcgaacgcggcggcgaagtagtcgatgtcctcctccgttagccaggccggcagcggcagcggcggcggcggcggcgactcctcgctctccggcttgccggccttgtggacggtgaagcggttgcacagtgtccgccttatgatgtgcctcgcgtgcgccggcgcgaactcctcctccgcaacgccaggctcctgcaaacagcaacaattagcggccggtattgggccagattatcctgtgcaattgggcctcataaatgggccgccggcccagagaggatgaaaggtaagtggtctcatgtatggcagtggctgaaccgaccagaggtgatcacgtacaagaatgtagtagtaaaagattacctagagaatcgatatctttcgatgagaaacggaatggccaagtaacctcagggcaagtaattagggcttaatctctcaattccctatttcggcttgatttgctccctccctgcacctctataaaatggcacgcacgtagtgctcagttgatcaatcgatcagaagcagatagagctttctgttgcgtcaatggcggagatcatcctgaacaaccactgcgagggctgcgcgatcgacatccgcaaggccgtcgagaaaatgttcggtaagaagctagatgatgtgtgcagtgccagtgcatttttgtcatggcgatcgatttgacattttgggctgcgtgcgtgcgtgcgtgcgtgggggtgcaggggtaaagagggtttgggtggacatgtatgggcggcgggtggtgatcgccggccgaaaggtcgacgcgacgaagctcagagagcgactcaggcggaagaccggcaagtcagtcaccatcgtcagcgacggcacgccgccgccgccgcccgacgacgtcccctttgtcgggatgatgcacctggcgccgtcgccgccctactacccattgcccgcgccgcctccgccgccgccgccggggagctacctgtacggcggcaactacccctgccagaacccgtaccaccagtacgttcaaggaggcatgccggcgcgcttcgtcggcgacgacacctacgacgacggatgctgctccatgcagtgaccgatcgtgctactaccagtcgtagacgaataacggaataagccaacacgtagtatttcatctactgttccatcggagacaccaacagtagtagcagtatgcattttttttttcttgtactgcgaccacgcactgtaccggtcaggctatcgagtccgtgcaggagaaaatttcgctactccggctggaccgctggttctgatccgtttgggactttgaacaatatttacgatagtattattctactactagtagcatatataaaaaaggttcgtttgcgtctatctgctcacgagttctacctaattttctcccatgctgcatgttgtagtagcttcaaagtagaagaaatatatatgcatatcattcgttacttattataagtcgtttaatttttttcttagtcaaacttcttaaaatttaattaaaatataaaaaaatatagcaatatttttaatacaaaacaaacatattatcaaactatattaaatttaataaaattaatttggtgttataaatattaccgttttttctataaatttgattaaatctaacgaactttaattaaaaaaataaacagtcgaatagcttataagtatataatatgaaacggaggaaacgataagtacgtagaggaaatggcagaggatgaggttctgtgtattgaacctggaagcggcagatgtagtaggtggggccgtaggccttgtggaagtgatcggtggtcttgatggcgtcggcgccggagcggatgaagacgtggcgcatgaaggcgacgctggtgttgacgagcgccgtcacgcgatccggccggaacaggcacatgtaccacgcgattatcgcgccccagtcgtgccccaccacgaacacctgcttcaatccaaaaccagatcagatcagatcagcctctaagttttatttgcaacagctagtagaaaatcttgtaaataaaaaaaaattcactagtagtgacgaattggcatttaattattagtagtactctagttctgcttgatttgattaataagttccaagattttcagtactgatctgcttaagtacatagcattgacagattagtcgtggagtcgttggatgatgccaatcaaattgacaggcaagccacggcgtcacgttgggttgggatatgcccatatttttttttcattccgtctacccattgttgatgccgccttcagtttgaactttgaaccgtatcgaagcactatcgaacaaaacagtcaacttctttgcgctcacatcacaaagccaaatcaaccaaaagcaattttaaaaatggcagccttttcattcgctatccatgttcgacgcttctagggatcacgtattttattttatttagataatgatcacatattcgcatattttaattaatagcggaatcaaacaatttaagcgcatgtgattaatcaattaacagtaaatcaaagcgtggtttgcatctgctaagctcgtacgtaccttggcgaggccgagggcgtcgaggagcgcgacgaggtcgccgacgacgtggaaggcggagtaggactcgatctcgggcggcgcgtcggtgtcgccgtacccgcggaggtcgggggcgaggcagcggaatccccggccggcgaggtgctccatctggtgccgccacgagtaccagagctccgggaatccgtgcaggaacagcaccgccgcgccatcgccgccctcgccgccggcctccgcgacgtggatcgagatgccgttcgcctccaccgtccggtgcctaatgaccgccgccgccgccgccgcgccctccatgctctctagctccttcgctttcttctctcctctcctcaccggcgagctgatcgatcagcgtgtgtttgcacacttcgcgtgcgaggtgtgagctcgtatttatcgtacgtgtggtgccccctgtcgtgttgacaatgaagaaggtattgtttagtttcaacttttttctttaaactttctactcacttttctacacatataaacttttaatttttttatcgtatcatttcaatttcaaccaaacttttaattttgctgtgaactaaacacatccgaactctcgtgtgaaagtggataaaccgagagagagagagagggtcacgtttgaaaaaaaagaaacggtggcgaagtgtggctgtgcaagcgtgtgacgtggacgctaacgcacgtggcgcgtgggaactggcccccaggaaaacggcgaccggaagagtgtgatcatagcggctgaactattttctcaaattaattttataaaatttaatatacttcgatcaagctatttctttaaggtggcatatcatgtaactatacagatttaaggtgaatttcttattaaactgtagatttaaaataaggtgtaagataaataaatatcaagtagcaaaatctcataactataagtttgttagtgtcaatttaatcataaaattaccacgtttataactccaacgtaatggtaattctagggaatttaagctttagaatttatagttctatgataactccaaatttattttgagagcgataacttcaattttaaatatgtagttttgtaatactttattataaatctatagttttgttataaaaaaatagttaaatttgtaagtgtataacatgataaatctataattttgtgataattcgtttaatatattatagtttttgaaatttagtcctttacttttggatgaaataggaaggttatattgacttggtcatggcctgcatcaatttcagtagcagtagagtaggtgcatccacgatgtgcttgaaaaaagcgataccccatcaacatgttcaataatacatttatataagtgctataaatcatattgttgaggagagatcctcaatagcggggaattgtgagaccccccatttgtgatttcggccgggggcggaggctcatctcttgaaaatcactcgctcgtccctaggattaccggcaagcttgcacgcagtcggattatacaggttcgggccgctatggagcgtaacaccctactcctgtgtttgggattatggatgagttttacaaagatttcttcactctagaaagcgcactcgcttcctctcttctggagttcaggttttctaggcgtcctcctctgtctcagtgggcagggtcctccttttatagctcaaggggataccatatgcgccgcctctacctaccctctatcggagggggatcccactccacttttcctgggctttaaaccgtgccttctcccggaagctaagcaacaaccggttctcgagtggaaccaggcgccgcccccgcctgacacgggggacagccctgtcattccctcataaatgaacgatgacctgtgacagcccttcctcgagtgacgcttggacgtgacgggtcatacccacccccactccgccgggtacaagggcgacgtgaggacatggttgccctatccatcggatgtgacggtgtcaggccggtcacatccgttggacagaggttagctaggcgcgccgcacgtctgcccttaccgcattaaatgcggtgagggacagttggggcgtcgcacttttatggctgttcagcctgtgctctcgctctctccctgtcacgcccggaaattcactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctctctctttcaacttgagtagttctaagacattgaaacttgaagacatttatgtggtcaacttatggaggtcagtcaagtggatcgaggaaggaccgaagtgccaagtggtcaagatggaatgaagtttggatcctaccttagaacctatgccgccaaagtgtccttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttgtctttagtgtaacccctctccttctatcttctctaatatgcaacagatggtgaacactcgcgccagtggaagtggaaacaataacaatgaagggaacccaattcttgctcaagttctggctcaacagactcagttaatgaacatgatgatacagcagatgcagaaccagctcaaccaagggaacaacaatgctccaccgccgcagaacaagttagctgattttcttcgtgtgaggccacctaccttttctagcactactaacccagtggaagcaggtgattggttgcacactattgagaagaagttggaactgctccagtgcacggatcaggagaaagttgttttcgcttcacatcagttgcaaggacctgcatcagaatggtgggatcattttcggatgaacagagcagaaggacaaccaatcacttgggtggagttcacggaagcattcaagaagacacacatacctgtaggagttgtttctttgaagaagcgtgagttcaggacattgaagcaaaaggatcataccgtggcagagtatcttcatgagttcaatcgtctggcacgttatgctccagaagatgtgcgtactgacgaagaaaggcaggagaagttcctggaaggcctgaaggatgaactgtcagttacattgatctcccatgactatgttgattttcagcagctggttgacaaagcaattcgacttgaagacaagaagaacaggatggataaccgtaaacggagaatgactgtattccaggaggcacaaggtagtagccagaggcagcatatcaggccactccaaattggtgaatcttcttccgctggtcaaggacagtcgcaacaattgaacatcgctggtgagatcaaatcagagactaatgaaagcaatgatgttaacatcgagcaagctaatcagccggtgccagttcagcaggaccagtctcaggagaataacactagtggaagggagcagcaggtatgtttcaactgttacaagccaggccactttgcaagagagtgtccgaagccgaagcgtcagcagccgcaaggtcaggtcaacaacattgtcgtcacaggagccaatgcagtgccagttgcgtcttcaagagttgcgtcttcaagtgttacagctcagccactagtttcaaagcagcagtagttttctttaaagccttagaataattatctgagttatggaataataagatagactacagtttacctatgcccttttctttctagccgttccgaatctcgggacgagattctttgtaaggggggtagatttatcacatcctgatttttgtttcaggatttataaattatttaataaattaataatagaatttatgttaaatgatctttaatttacaagtgaagttaaatgtgggaaataaaatttccttaatataaagcatggatggatttaatttttattaaattctccatgattaagtcaactctctgaaattttctcggatttttcggagctcaattcctaaatgatacaaagaacagttcagtaattatttgattttaatgatctaattatatttgttaagagcttttcttgtttaaaatccttaaattataaattgttgtttaaaaggaattattagaaatgattttaaaagcctagaagagaagatctaattttaatctgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagccggcccaaaacctcctctctctctctctccccggcccagtcggcccagctcgagccgctgctctcttctctctctcggtgccgctgacaggtggggcccacctgtcaggcctgtcttcctcctcgcgccggccgccgctcgaaccctagcgccgcgccgccgtcgtctccttccaaatccggtcgatcctttcccgatccggtgaaatcaatagaggggaaatgatcttctcgatctcctcttccttttctcttatggaatcatcgcctaattcggtttggaaactcgtggattcgaggtcgaatcggatcggtctctttccttcaaaccccgatctttccttcccgtcgccggccgccgtgggccttcgtcgtcgcctcctagcccctttaaaaggttccccgagctcttctctacccgccgccacctttgccttcgcctctcgtcgtccgtagtgccctagcgccgtgtagcttcgagccgccgtcgtcgccgccgctccagccgtgcgccgccgtcgtttcagccgtcgtcgtctctcgggaaggtcgccgtcgtgatcgtcaagtcaccgccgtcctcgtctgcctctttatcgccgccggagaccgccggagcaccgccgtcaccgtcgacccgaaaaccgccgccgtttcttcctcgtcgccggcgccatccgttgctcctccgctgttgctttggtcaccggtgagttcgccgcgtcgcgctctacccgttggtgccctccgtttgcgtcctcgcgccgtcgttcgccggcgagcttgcgctcccgagccgtcgccggtggtgacgtcatcgccgacgtcatcgtcgcccttccccgtgagccggtcgtggaccgttcgatctcggccgtccgttttggataggttctatctcgaccgtccgttcccgtgaaccgctgccgtgcacccggttcaccgcaaaccttagccgctgacgcaataatcctcttttccttttcaaaaataattcattattgcgtcataattcaattaaaatccatataagtgttttaatccgatttaatctttgaaaattcataactaattcatttcattgtaactcagtttaatgtggttcaagttgcaaaaattatataaaataaagatctacatattaaaattgtccataaattgaattaaatttatttaattctttttaaatgggctttaattagatttaatcttgtaaaattcatattaaattcatattaagtcagaatgaggccgttcaagtctcataattcatctaaaattatgatctacatgtttgtttactttttatgtattgtttatttggtttttattagtctttttcctcgttttgcgtgttagcttgtgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggcctgtttgcattgattactctattccttgataccttgggatattataacttgactagttgagctttatatattggttcagctagatattagatatgattgcttagccatgcttagaaacattagcacactattgggataacttatgacttaatattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtataacatggttcattgcggatcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtacttttcagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcagaatggttgggcctgtgcagcatgggtgtgttgttcagtgttgattaaaatttctgattaattactccactgttttacatctcttaaatgttttgctaagtgctgcttttgcaaatgagcctatattatgccatcctttggtatccttgtgcacttgcatatttgctttgtggcttgctgagtatgtcatatgctcattcttgcaataatcaatcaacctcagttgaagaaaaagaatccagaaggagaagacgtttggcttataccccagttgagctgcctgtgggagtggagccggagcttcggtagattttattttccgctgcagttttcttcatggtgaggactaagtgcctcttaagtaagtacttatcgttttagttaatttgatgaatctgtatattaaattgtcagtttgtgtacctcggctgattcctggacgaggattttatgcacaaataagtttggaaattactagtgaatttccgggcgtgacactccctcctccgcatggcagccgggtgagggcctcggggcgaacccgcgggatagcccgagggggtgacgccatgccccgagccccccccggccgcttccacgactcgcgtgacgcgcgaatggggctaacttgcaaagtcacgtcgccggagggaaagtaaccctctacttcacataccccgggtccatatctccgacagtagcccccgacgctatatcaggtatcgatttcctgagatcgttctgacatggtgcctcacgactcctcgagctggggttgtgggcccggcagggaatccaaaaggatatcgccgcgtggccaggttggcgtgccaaccataatagcggtttgaccgccactgaccgcgctcatgatgaagatgcttgaggcgcgataacccggggggtcagtcagaccacgcctcgattctcccgctcgctactcctgcggcggtagtggtgacggtttgctcaacttgcgctcatagccgttgtgcactccacctcgagtgtgccactgacagacgcactaaaggcgggagcggatacaacgggcgacgtgatgagtgggcgcaggatgcgaagagacaaatgcgggcgcgaggatcgtgggggcaagtatgggagcgcgaaacgaggaggcaagtgcggatgaagcgaggataaaagggggcggaggcagagactctgcccccttcctttcaccaaccgcccactcgtcctttcgcttctcaaaccctaacattctcgccacctcatactgtctcacgctccacgctctccgccggttgccatggcccaagacaccggcgacgcagtgctcccttcctcccgcatcacagcagacaggcaccttagccttccccgcaagatcatgccggacggtgccgtcgtgcgggcgggagagtcgcggcacggccacgatatccggagcgatccatgcacctcttgtccttcgccatgacgggcttgattccgccgttctccagattcttccatgaggttctggatttctacgaaattcatgccttgcatctcgcacccaatgccgtgatgacgctggccatcttcgtgcatttgtgtgagatgttcattggggtgcgaccgacgatgcggttgttccaggccttcttcattccgtagcttctgcaaggcgcggtggtggggggatgctacttccagccccggccaggcacagcgggtcagtacatcgagagcaatctccgcaagaaatgggaggactggaataaggactggttctacaccgcgttgccggaccatccgcgacttcgagttcccgctggccctcctgaaaggtctgccgcatggctggcgacttcggagctgggcgaggaatacgacgcggtgtgggatcgccttaggggcctgcggagcctgggcctcacgggggcgatggtctttggcgattacttccgccgctgcatcgcacctcttcaggaacgatcccgtggagcgtgggaatacactggtcccaacgaccccatgcggacgcatgtgggcgagcgctgggactagggtgaggaggacgcgaagagggtgattcggcgggtgctgggcctagactccgctgagccaacactaatcccagatgggattcttcccctctgctgctaccgtgaccgggagagcattctggccgtgatgtcagccatcgtgtcacgcccggaatttctatccaaaattccaaacgcttacatgtgtgtgaaccctcgtccaggaatcagccgaggcacacaataacaaattgataatagagtacaattattactctaattaataggcgaataaaatgtcattacagaggtagatagttcctctcaatcaataaagatctaagcagcggaaaataaaataaacggcgcagacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatctttttgcaaaagcagcattcagcaaacatttgagaatttaataaaacagttaagtattaaacaatattaacccaacgctatacaacataccctgttgcataggcccaaccattctgaacaaccatcccggctgcacaggtctatctccaaaccaggaatataccattccaaaccaggagctaatcaaattattaccaattatagcatcatttactatggtgagaagtgtgagactaatcacgaaagacattgttagacccgcccataaccgtgggcacggctattcgaatagttttactctgatcagaagtgtaccactgtacccacaagacacaaccccacatcatgtcaccatgtgcctcaataccaccacggtacctcggaaaggagttgtgacaataccccttgcataacacaatccactacagcgcacctttcctggatcataatcacccccttataaacaaggcatggactccccagcgacccccgtgggcttatctccgccacttctcagtctggtgctccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcaagtaattaattaaccagtcacgattgaccatcatgaacaatcattaagccatcattaaaataatagtgagtcataagttatcccaatagtgtgctaatgtttctaagcatggataagcaatcacatctaatatctagctgaaccaatatataaagctcaactagtcaagttataataacccaaggtatcaaggaataaagtaaccaagaacaaaagggctataacaaagaataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctcctgcgaaaacggactctccggaaacgacggaatctaaacagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaaatcggattaaaacacttgtattgattttaattgaattatgacgcaataatgaattatttttgaaaaggaaaaagagatttattgcgtcagcgggctagggtttcggtggaccgggcgcacggcggcggttcacacgaacggacggccgagatcgacttgatccaaaacggatggccgagattgaacggtccacgaccggctcacggggaagggcgacgatgacgtcggcgatgatgtcaccaccggcgacggcggctcggcggctcgggcgcgcatgctcgccggcgaacggctgcactacggcacgaacggagggcaccaacgggtagagggcgacgcggcgaactcaccggcgaccaaaaaggcggcggaagagcaacggacggcgacggcgacgaggttgaaacggcggcggagatcgggtcgacggtgacggcggtgctccggcggtcttcggcggcggcgaagcggcggacgaggacggcggcgacttgacgatcacgacggcgaccttcccgagcaacggcgacggctgaaacgacggcggcgcacggctggagcggcggcgacgacggcggctcgaagctacacggcgctagggcactacggacgacgagaggcgaaggcgaaggtggcgacgggtagaggagagctcggggaaccttttaaaggggctaggaggcgacggcgaaggcccacggcggctggcgacgggaaggaaagatcggggtttgaaggaaagagaccgatccgaatcgaacttgattccacgaacttccaaaacgaattagccgacgtttccaaaggggaaaaggtagaggagatcccaaagattgtttcccctcaatcaatttcaccggaaacggaaaggagcggccggattttggaaggaaacggcggcggcgcgaaactagggtttcgggcggcggcggccggaggttgacgacgaccctgacaggtgggccccacctgtcagcgggcggacgcgcgcgcgcggcggcggactgggccggactgggccgaggagagagagaagggttttgggccgactttcggcccaaagccaaaagaagactttttaaaacctttttcaatttaaattatttatgaaatgcaattccatttattaaaaatactttcttagctcaaataaatcccagaaaaatctaggaattatagaattaagcaaagtatttaatgaaattttatctggccccattttatattggaatttattaattaaaattagatcgtctcttctaggcttttaaaataaattctaaaaattccaattaaacaacaatttatatattttgaatttttagggtgtgacacatcggcgccggtaggagccggtccagtcgatgcggcgccagcggtagcgccgtcggcacgggtggcggtggtgcgaccgcgggcgggagccgggccggcggtccaggcggcggtggctcaagggcgcctggatcgagccgcggacctggagatgattccgccggtgacccaaaggggaaacggaaggtggcctattcccggccgccctctcccccacatggaggaggtgccgagcgtgcaacggatcgttcgccaatgggccacaagcgacctgccgggcccgaggctggtcggaaaaagaagcggctccggaagatagcacaaacggagccatgccggggggggggggggtttcatcgagcccccaaagtggaccttcaaccgccctccccgtaggtacgattattggcgctcactttggtgctcttacccaacccattttcttgttccttctttttcttttgttaacatgatctaggttctcttgtagcgagattccttctcagggaatctcagggtcagaccccccgcaagggacgaaatctgaacggttggggcagtccgagcccggccaaaccaaggccggggttttcgcagcctcgtggcgggacccagaggacacgcactgggcccgatcccgagcgaccctcaggcgggacccgtcctactgtgggtggcaggggtggcgacgctcctcccgggggcggctccgggaccagggtccacgcggagcaccaccaaggatcgggggatgagggaggtcgcggcctgggagccgaagccggaggtggtcccgagcttgaggttgaggctgggggcggtcccgaggctgaggccgaggctgaggccgggggcggtcccgagcccgagcccgaggccgaggctgaatccacccgaggacccgaagcggggggtgagagggacagccgttcccccttgcgcttggggcgccctcgaggctggtctcgcagaaggggggccgagagcagcccccagtctcgcgggggatccagcagtaccccgtcgtcccgggggcggaccgcggccttttcctccccaactccggcgagtatggagccacttctgcaggtgctcgccgccgccgactacactgtacgagaggggttgaacacccaagttcaagccctagcggaagagcgggcggccctggatgcagagtgggaacagctcgccgcggaccgcgcgcgagtcgacgaggggcgtcgcgccgtggacgacatggtaagggtgggggcgcaaaatgcatcaaacccaactagccaaaatccaggcgcgcgaggaggcactggactccgtcatgcgggaggcggaggaggagcggcaggcggcgctgatcgcctcgagcgtcctggatgaagcgcggggcgatatccgccttcagtacgaggctcacgccgaggacttggcgaagaggattagggacgcgcgcggcatcctcgacgcagccgctgcccacgagcggcgggcatcggaggccgacgcctcgctgcgggcgcggacgatggcactcgaggctgaacgcagggccttggatgatcgtgcccgctctgcacaggagtttgaagccacaatccgtcggcggatcgaggtcctcgatcgaaaccagcgtgagcaaaacgcgtgcggtgaagaacaggcacggcgggcccgggagctggaggagtgagcacgcctgctagatcagctggagtctaccttggccgcccatgaaagaacggcggcagaggtggaggcttcccttcgcctccgtgaagaagccgcggccgagcgtgaccggatcaccctcgccgcgaaagcttccgcggaccgccgcgcggaagagctacggctgcgggaagaggcatgccgggaacgggatgccgcactcgccgagcgcgaagccgaggtgaatcgccgcgaggtagccttgcgccggctaggcgagcaactcgcgaaacgagaggaggccgttgccgggcgcgaggctcgtcatctggagagcgcccgcgctgagcgtgcggcaatatcagcgaaggtctccgagctggaggcccgggagaaggacttggtagcaggcgggccgcccggcggcgcgggtttggcgagccagctcgccatggctcagagtaccctcgccgacttggaacgcctggtgcaggatcaggctggggaaattgcggccctccgcctcaccaacgagctcgggcccgggcaactctccgacaccgtcgactggctggagcacgcggggcgccgagtcggcatctctgtgcgtcgggacagcaaactcccgcccacacagccagcactcgcgcttcggctggacgggctggcggtggacctggaaaggctggaggaggaggtcggcgagaccataaagtcttcgtcagtttctttggcacgggctgcggtggagctggtcctcgcgagccaccaagcgcgcgaccccgaattcatgccgtggcatgcgctcgaggattttcccccgggtaccgaggcaagggcccgggagcaagtccgggaggcggctaacgcgattgtctcaagcttcgaggggtcggccccccggttcacctccgggcttaccgcggacgaggaaaacggaagcgggggtgacgacggcgatgacgactaggacgacatcgtcagtggcgctggcctcggggggccgggcactccgtgaccactcgcgcctttaattcctttttgctgtgtgcccgtagcaggcacttcttgtatttaggccattgtgccatcctatcttgttctgcaactgaaacttctttaacccctcttactcttttgctttttccattggatgcctgtgatataaagagaagaaaaaaccaggacaaaaggggattattagactgcctgcgattgatatgtcgttttgaccccccctctcgggcttgttctagcgagaagataaatccgcgctcggtccatggaatctaagtggtgaaaggcaagaccatcgccccgagggagccgcccagcaggactggccagaccgaggctgcgacgaccgggggtcggggacgaccgtgtgtaggcccttccgatcccccggggttcggcacaacccggggcgcggcccgcgctcgtgctccctttcggcggttttcaggccgtcttacggcacttagggtttagagtaaacgcggattatcccttgaaccgggacaagccagagaaaggggagaaaacggtctccacgaaaaccaaggggttgtgcgggggctggcccgtgctccaggaaagcaaaaaatctcgatgtcatggatagaaacgacaaaggtgctcgatattccaggggttgggcagctctgtgccgtcctccatggttaaccgaacggagcctagccagggcacttcgatcactttgtatggcccttcccacattggcgagagcttcctcagccccaggcgcgactgaacgcggcgtaggacgaggtcgctagcttgtagtgatcgggcccggacgtggcgctgatggtagcgtcgcaggctttgttgatagcgcgcggcacgcaaggccgctcgccttctccgttcttcaagataatcgagatcttcgcggcgaagggcatcttggttggcctcgttgtacaacgcgacacgaggcgacccgagggaaagctcgaagggtaggaccgcttcggcgccgtacaccaagaaaaatggtgtttcccctgtggcgcggcttggagtggtccgatttgcccacaacacggcgggcaactcctcgagccatgaatccccgtgcttcttcaggacgttgtacgtcttggtcttgagtcctttaaggatttcggcgttggctcgctcgacttggctgttgctcttggggtgggcgggtgaggcaaagcacaatttgatacccatgtcgtcacagtaatcgccaaacagctcactggggaactgggtgccgttgtctgtaatgatacggttgggcactccgaatcgagacgtgatgcccctgatgaacttaagagcagaatgcttgtcgattttgacaactgggtaggcctcgggccacttggtgaatttgtcgatggcgacgtacaagtgctgatacccgcctcgagccgccttgaatggcccaaggatgtccagcccccaaactgcgaaaggccaagatagtgggatgatctgtaaggcttgggccggctggtgggtccacttggcgtggaaccggcatgccttgcaccgctggacccattcttgggcatcttgtaatgcagtcggccaataaaaaccttgccggaaggcttttccgaccaaagttcgtaaggtcgaatgggctcggaactcaccctgatgggcgtcggctatgagctcgatgccctgctctcgagaaatacacttcaagagtatctcgttggcggtacgccggtatagggtcccttctacaaggacgtaccgtttggagatgcgcgcgagcttttcagcttctgcgcgatcctcaggatgagtattgccttcgagatatgcccggatgtcggtcatccacacgacctgacgaggggggtcagggttgaccccctcgggccccgaggggcacaggtcgcccggagtcgggtcggagggcgtgtcattggggtccctcaaagggctcggtcgtgccgatggttgcgcgagcctttcctcgaaggtccctgggggagtggggctcgtgccgacgcaacatgcgacaactcgtcagcaattgtgttgtcgcgtcggggcacgtgctggagcttaagtccgtcgaagtggcgttccatgcgccgtacctcgcggacgtacgcttccatttgcgggtcgttgcactgatactctttggatacttgatttacgatcagctgggagtcacccaagaccaggagacggtggatgcccattccggctgccgccctcaatcccgcgaggagcccttcatattctgccatgttgttcgtggctcggaagtcgagacgaacgacgtatttgaggacatccccgtttggcgaggtcagcgtgactccggcacttgcaccttgaaggttgagggagccgtcaaaatgcataacccagtgcccgtcgcgaatgtcggcgtttggatcctcttcttctccagggaggggaaaggggacattagacgaaacaggttcgtccaccggggttcattccgcgatgaagtcagccaggatttgacttttgatcgcgtgccgcggttcgaagtgcagattgaactcagccagctcgatggcccattttaccactcgtccagtaccctctcggttgtgcaaaatttggccaagagggtatgtcgtcactacggaaacccgatgcgcttggaagtaatgacgcaacttccttgaggccattaagacgtcataaagcattttctgggcctgcggataccgggttttcgcatctcgaagtgcctcgctaacaaagtagacgggccgctgcacctttcgacggggccagttcgtgttgtcaggggctgatgactcggagcgcgcctgttcggaggtcccggggggatcccagactgcctcgggatcataaggctcggggccacctgccaaagcctccgctcctcccttgggggcctcggggtcctcccgggggctggaagctttgggcgctaggccttcgggggacgaggggccatcgcaagccgaaggggcctcccgttcgccttcctcacgctcaactactagggcggcactcaccacatggggggtcgcggccaagtagagtagcaatggttcctccggtcccggggccaccaagacgggagggaagttaggtaagctttcagctgattgagagcttgctcagcttcctccgtccatacaaatggcccggagcgcttgaggagcttgaataggggcagcgccctctcacccagcctcgatataaatcgactcagggcggccatgcatccagtgacgcactgcacatccctaagcttgctaggggggcgcatcctctctatcgcgcatattttctcaggatttgcttctatgcctcgggaagagactagaaaaccgagaagtttgcccgccggcacgccgaacacacacttatcggggttcagctttacgcgcgtggacctaagactatcgaaagtttcggccaggtcctgtagcaacgtgtcttggtggtgcgtctttaccaccagatcatcgacatacgcctctacattgtgccctatctgattacttaaggtaatacgagtcatgcgctgaaaagtagggcctgcattcttcaatccaaaaggcatagttgtataacaaaaggtgcccacaggagtaataaaggcggttttttcctcatctttcctagccatacgaatttgatggtatccagagtatgcatctagaaaacacaaaaggtcgcaccccgcagtggagtcgactatttgatctatgtgtggtagagggaagggatctttggggcatgccttgttgaggtcggtgtagtcgatgcacatccgtagcttgccattggccttcgggacgaccaccgggtttgccagccactccggatggatcacctcgcgaatgaaatcagcctccaggagccgcgccacttcctccctgatgaaggcctgccgctccggggcttgacgccgcactttctgccggacaggtcgcgcatccggccgcacggcaaggcggtgctcgatcacctccctgaggaccccgggcatatctgacggcttccatgcgaaaacgtcagaattcgccagcaggaaggagacgagcgcgccttcttatttggcgtccaaggttctgccaatcttggcggtcttagatggatcgtcgccaagggggatttccttgacgggcacctcgtcagccgaggggaggcgcttcttggaagcgtgggacgcagaggcttctggggcctgcggctccgtggccaccgccaggttgtctgcgcgctgctccgcgcaggcgagggcgaccttgacatcaccaaggacggtgatgggaccagcaggacccggcatcttcatctagaggtaggcgtagtgggtggcgaccatgaacttcaccaacgcgggtctacccaaaaccgcattgtagggcagattgaggtccgccacattgactggcccccccatccaccagcacatgcttcatcttgacgttgtggatggtcggggagaccaccagggccaactttccccccccccccccgagcgagcaccgtcggatggtcgctctggtcgaatgtgagcttcacctccgaccagcgcaccttccggaccacctcatgcgtgggaacaatggccagaagctcccacttcatagccttgaagcttcggcgagaggtgtgagcgcaagccccccccccccggtcgagcgtggcgacggtcccctgaggtatctggaaatccagatcctcaccgtctccgccatcatcggcgggggccttgtccttggcctcccctcgctggtcaccggttgaggtcgcgggggctttgccctcccgtcgaccctgccgcttttcctcatcagcctttcggaaccgctcggctaaattcttgaccgagcggcagtcggcgagactgtggcggtaagtgttgtgtaccgagcaccacttgtccgccgaccggccctcgccggagggaatggtagggctcggcctatcgacggtggcattttctttgcgcggggcccgcgtgggcccgtctgctgcaaggacatggccctcgtcatcggagcgggctggtttccttttgcctctcctatctcactgcttagagcgggaggcagattcgggggtagccgcagccgccgcaccggtgctgggagagttccaggcccatgcctccttcttctgggccaccttgtccgccagctcgaagagctcggcagtggtcttgagctccttggaggcgatcttctccagcatgcgattatgccgcacgctgttccggaatgcatacacaaccgcgtgggctgggatgcacggaatggtgttgcggacctgacagaagtgttgtatgtacgaacggagggactcatcatccttccgccgtacagcatgtaggtccacctcttcccccgggcggggatatgtgccctggaagttcgtaatgaactgctggcacagatcctcccaggagtgaatggagccggggggctgggtcatcaaccagccacgcgcctgacccttgagggccatgggaaagtaattcgccatgacccggtcgtcactccctgccgccacgataaccgtggtgtagatctggaggaactcggagggattgatgctaccatcatacttctccgtaaggttggggcgaaacttcgggggccaccggacattccggagactcgccacaaaggccctacaacccgtccccccaggggtgagtgtggggggagggccgcctcgtgaagaggagcgtggcgctccagatgaggaggcgccttcccccatacgggtagctcggcgctcgtctcggcgtcgctcgatgttgattcgagcgtcctgcgtcccgtacaggccgtcatggcacctccggctttccgaggcccctgacgatgttggaaccgtggaccgcctctagatcgtggccgatcgacgagcccttctccttgccgacgaggagagggtgaccgaggtacgcgacgtaccagcggcagcggatcggccactcgtggctaactgccactgggtagtagtgaccaagttggccacgtcgtccaaccagcgctgaacaggagtctccagctccgggtttaccgggggatgccgcagaagggcgcctgctacctgaagcgtgccttggggcaaaccgccgtctccatagtcgagacggcagcgtgccccggcgcgtcgcggcctccctccgccagggggcggagagagagccgaatcactgaacgagtgggatcctccctccgcgaaggttcgcggcggggaggagttggagaaccatggcgacggtgacgaggacctcggctctcgccggaatccccactcccggacagggtgggagtaaatgccaccgcctcctcctatacattcaggacttcgaccatggtcggataaggcctggagagaattggcaaaaaagaaagcgacttcctctcggaatgcgccaccgcccctacttggcgcgacatctgtcgaggagagatcctcaatagcgcggactcgtgagaccccccatatgtgagttcggccgggggcggaggctcatcttttggaaatcctcgctcgtccctaggattaccggcaagcttgcacgcagtcggattaaacaggttcgggccgttatggagcgtaacaccctactcctgtatttgggattatggatgagttttacaaagatttcttcactctagaaagcgcactcgcttcctctctttctggagttcaggttttctgggcgtcctcctctatctcagtgggcagggtcctccttttatagctcaaggggataccacatgcgccgcctctacctaccctctatcggagggggatcccactccacttttcctgggctttaaaccgtgccttctcccggaagctaagcaacaaccggttctcgagtggaaccaggcgctgccccccgcctgacacgggggacagccctatcattccctcataaatgaacgatgacctgtgacagcccttcctcgagtgacgctcggacatgacgggtcatacccacccccactccgccgggtacaagggcgacgtgaggacatggttgccctatccatcggatgtgacggtgtcaggccggtcacatccgttggacagaggttagctaggcgcgccgcacgtctgcccttaccgcattaaatgcggtgagggacagttggggcgtcgcacttttatggctgttcagcctgtgctctcgctctctccctccgctgcgtggcagccgggtgagggcctcggggcgaatccgcgggatagcccgagggggtgacgccatgcc

SEQ ID NO: 43722 - DNA, 12786 bp, Oryza sativa
taatgataccatcactccacgaaatgaagtttaaaagccatattgtgagtacctgcacgttggaattttctcaactagatgtggagatgaacacgagggaacacggcgtgtaccgcgatttcattatgttattattatgagattgcatctagtaacaagaaaatgtatgtgttagacaataattatgaaactgacggactaaccatccataccgacaacatagtgtgtgccaccgctccttttcgatacgtacaatgccctactatacgttttaattttattcctcattagcatttacagagtacgttaccatgatcgatctaacaaaaactctacttaaggcgccgaagaattaactaattaaaaagtgattttacagttcttgatacgatactgaaagataccgtgttttttatgtaaaatttaatacctcgcgatatcttcaataataataataatagaagattaataccttcaataacagtagaagatatcaaatttacattaaaaatttttggtgtatctccgaaggattgtaaaatttctcgtgattaaatgatagtgtagcatctgaccacgatcgaatcatgccagtttcagagcaaggcggcgacggtgacgagcttctcgaactggcgcgcccggccgcttctgcgacgtcggggaggcgaacggcgtgggctggactttccgttagtgggcctcattcaggcccactgttatcaccgccgatccacatttccgtcaataaaccgacagttgactcagatgttagttcaaagcattggccagagtgagtatatttggatctgtaataacaatatttactttacttgcagtttattcacgtgagctaaaccaacaaaaagagagagggaaaaaaacgaagacgggatacagctggggaagaaattagggtactcaactctgaaaaatcaaaacgaaggctagctaactatgatcgcaaccagagaacgtacgtactgaagagggttaactagggggctctcttaattaagggataatcgctggataatccagtccagcgaactgaagtgaagaagcaagcatattcagtgcagccgatgaggagtaggaggagcaggaggagtagaacgaggaggaggaggaagcggtgacttcttcatcttgctgatgaagttgacggcgatcctcatcatcttctggaactggacgaggctgtgctccaggatgaccgccatgtcgccgttgagctccctgcagctgtacgttcacatggtgacgtcgttgatggcgcgaagcacgagcgtcttggcgacctcgtcgtcgccggccttgagcgcggcggcggcgccgtggatctccttcatggcgctcgacaccgtcacgctgcagttgtcgaggcaggccttgaagtccggcacggacttgttgaacccggggagcttcccctcgaacaccgtcgccgccaccgcgccggactccgtggcggcctccatggcgacggcgaccagggacctgaagtccacctgccccggcgcgccggcgatggcggcgccgtggttcgacaccgacgtcagcaccgtctggatgtccagcaggcggtggcccaggtccttgacgcacagcttggagaacggccccgccgtgcacgccgccaccagcgggctagaccccggcgggaggcgcgcctgggcggccattgctgaggcgcacatcaggaccacgacgaacatcgccatggacaacaacgacgacgccatttaatttccttgtcgatcactctgctaatgaagcttttctagttgttattcaagatctgaattacagtaaaattcgatcaaacgcaataatatatataagctgaagagacagatctgttggtttgatcagtgagtggttcttctttgtgctctcagctcgtcgccgtagtcgctgaggctgggaggggttttctctggatggtgcgtgcatgcgcgccatgagtggtcgcgcgggagtgaactagcagaggaagcgggccagcttgtgcgagtttgccgcgctcttccctctcgccgtctcgcgtcgcgtacccgcgcccccgtacgtcaccgctgtcacggtgtcacattgacttttctagttgtgtggagtatgtttctgcagcgcttgtactctgtcagctgattgttgcgagaagaggtcggctaagccgtgtctcgtagactttgatcacatcccttttatatacagtgcaaagtagctcaaataatttcgcatgtaagtcccttttattttctattttactctttatattttgttgatttaggggaaaacttcaatattttacaatgaacacctcaaaaatcatgaacatttataaaatcacattccctcctctccaccggcaacttcctctactgaagcccctctctgccagcgccgctctccccccaccccttctgccgatgacactccccccaaaacactgatgatgctagcttccatccccatccgccttgtatggggccatgccatctcctaacgtgctgctcgagctgtgcctcggtccgccctgataaatcctaacgatgaacacatgttttaattgggctcagcagtattcactaaatatgggaaaggcggatgtggcatgaaatctctgatgtgtaaagctggggctaaacaacaactaggcacactgtgaaagccctaagggtactcacagtgcaagccacaggtatgaggagcctggactaggtcacaagttagaaatctctatctcacagtgaaaagtggctctaggatgacttaatttatcatgtgctcccttgtaattttttactttaatactcatatactttttaaaatttagagagtagtctagcaatttgcatagaacaccctaaaaatcagagaaaaaaaaatctactccctaacctcttccccgccacccacccgtcactttcatgttcccctcgcttcaccggctttaccactcacatcgtcggtgatgagctcctcagtggcgccatttctcccctctctcttcccggtgccacctctatccggacggccgtcgagtatattgaaacagcaaaaaggccgaaggcaactccgacggcgcgtcaaggaagccacgaatgggtcaaggcggccgccaatgccgtctcgtcgagctccgccttccgtcctctctttcttctccggtaggtggcggcagaggtgacggcatgaatctggcgaccctcaacggcgtggagtgagacaacacggatgtggcggtgggccttgatagcagaggactccaaggcaagttaatggctgacggctccgtggagtggccctctacagcggaggaccccgaggtgggccttggcggtggacctcgacggcagaggactccaatgcaggctgacggctccgtggtgcggtggagtggccttggcgggggctgcagatctggccgtagcgatgaggttccgcaacggctcgccgtcggccagtctgccgccaccaggttcttcctttctccagtcctcatctcctccccagctcgctggcgatttatggcgatcacggaagccacttaaggcgaggctacagttgtaatctccacaatgcgggtcgcgcccatctatcctcatgccgcacgccctcgatcggatcaaagaacctttggctcattttggctacgcatagtttgtttggtcactataggagcgaacgtggagtctaatctactacgtggaaggtcgaggggcgaacgacatgtcgacgcactatgaacgccctaacattgcagcacattgatatctgatattttgtctatcgggcttaggttgatggacagtagcagcagttgatcatatattgcacttgtttattgagttgcgcgtttactcgtgtaacgagattagaagtatggttaactttgtgtttatcacgcgttctcattggatgttatgcatagtatatctaccgttgacaactagagaccttttacagggtctgtattccaaaaaaagtagaaatccaacgctccataatgaaaggtaccctgtaaaaggtatttgagtattggcataggcacttaggtaccaagggtaaaaagataaatttgctagtagagaggaaaggaaagagttgtccgtaaattcagatcggtaccgcgtcggtaccagttaagttgcatggtactagcattaaagttctcatttacgtggttttctctagatttacatttttgtttccaaggacatggtagaactcttcccattaattctccattacgttatttgcatagttattttgatatttatattttgttcccaagaacattaaaatatcactcaaggtttacgttttaagttttacattttatttgtggaaaaaagaaaattgtagataaaatattcctaatgattgcgtccatctgaacatgctatgttaggttaaccaacaatatcagagcttctctcttgaccctatcttcttacaggttcacctattcaaaccctagaagaagaacatatgagaatatctcattttagtcccttatatgaaggaatttgttaactatgtaaataacgaatcaatcgtgcaaataagtataggagcagaggagatctttcccgatgcgcttgcacctagccgtcgatcggcccatcttgaaccctcaactgtgccgatatttctctggaccaattcaaaccctagaacaagaacgaagccggggtcaaagaaatgaggcgttgatctttttttttcccggtgcagaactgcagatcgatcgatgcattaaattgttcgaaagatttactttgttttctacctaacaattctggtgattgcacccaggtattcgattcactcaaaatgctccaggtattcgattcactcaaaatgctcattttttagtagttaattactccattgctactagttatgaaaattttattccatacttgcccctcttttaatcaatggttcacattgttctacctctcaataccttcaagtacctcgcaaacaccgtaaaaggtctctgacaactattataccagttgtgccgctgaaacccgacttgaaacccggctgtgtgtgttgtcaggcagcaagaaagataagacattacttacaaatcaccgacggcatgtgcgtacaatagacacattcaaacatatatactgcatctatttgatgcaatgcaaagatttatgaatgaattgagagggaaagttagaattgtctaataaccgtcatccagtttatttttatgtcttccaactagctcttggtatgcaatgttaccatacatctgagaagtagtaagatattatgcgcggtgatactactatgctcttaaaatcggtttctaaggttattaaaaagttattaaaaatttgaaggtatattgcttcagttccatgcctccttttgaatgaatgaatatttcaggagaattttgagaggaaattaacgtttcttgtaaaattcttgttttcaatatgagaatttctagcatcatctttttttcgtcgggacaatacatgaaagaaggcggtccgaatttcactagagtttaaaggagtttactacataaaagctcgttaaaccagttttgctgatgaaagtcgtattctcggcgcttacaagttacaacgctaaaaactacactttactacaatcgtgttgctagattagactagcatcctgccaaattaaccacttgtgtctgtgatccacaggccaacaggcggagtttcacagatgcacagaaaatacgaaaaggtggtccggtccgtcgtgagacagtcagagtttaaaaaaaccgtacggttattttgattatcatgtatagtaacctagctttaattttttttcctgcaacttaacaaaagagtagaaattccggtctgtggcatggaatgaccgttcaacggcgcatgattaaagggttggcgtgtcagcgcatttcagcacacactgtcgaatttctggagtattccttcttattggaaatatatgggccggccggcaatatatattttgtaagaaaaacatcaaaacaatcaactgtacacaccctcgcgcgatctcctttacggttctactaccacatataagcatgcgtgtacacacataatatgcaccatgcatgcatataatcacatgagtaattttatagttcttgagaaggtatcatgaggtatcatttttttctatcgtagatttgatatctcttggtatctaaatactaggaggtaccaaaaatttaatgtaaaatttggtaccttatgataccttctcaaggaccgtagaattgttctaatcacataaaaactgctcagtacatagttcttcacaaggccggccgaatacgagaggtgatcgatcgacgattcgaagctagctagcgtcccatgtgttgcacggcgggcgcggcggcggcggcggcgcggcgctccatgttgaggtgccacccaagcttggggtcgtagccgcgcgcggcgagctccctgtactcctggatgagcgcgcatggctcgcaccagcagtggatgcagcagtcgccgcagggctcgccggagaggccgtactgggcgcgcatcttgccgcggtaggtgcaggtacatccactggaacccggtgatcacggccagaaacacgtagagcgcgccgctgtggccgcacgacgtcgaccccctgtccacgatctccgccaccctcccgaacgtgatgcacggacaccaccatgtcatgcaacctgcagatcaaaatacatgtttgtttaggattaattgattaattctctgtaatccatacactacttgagaactgatctttactgcttggtcgaccgaaaaccacaatagtcccaacactgaaaatgttttttttcccggtttataactccaacagaaataaatgatctttagttctaaatatcatatttagttctgattcaccttctaacagggcctttcaggggctgggatctttcgtcccggcctatgcatgcttgccatggtatggtgtggccggaggcgcgcgccgcggcggcgagaacgtacgtacataggccgtagtcgtcgaagcagtcgcagaggccagacgaccagggagcggagccgacggggacgccgggcgctggcccggccgttggcttgtctggctgcatctcctccttaattcggttgcccctgctagctgcaagttcttgtgatcgacttgttgtttgcgctgggaaactgagcacaagctagctagcgggcgggacgatgctcatatatagcacgcgacaagttgcattggccccggtgtgatctggacatatctggttcggttaaaccaattagtcattgaggagaagacgaaggaaattccatgggacggggcctaaacctcgtcctctgtagtcgtccctgttacgattttgacatgcagaggacgacgtttaggcatatcgccttttagacgatatgatatgacatgatatatgcatcaagattacattgattagtcaccatcctgtccgttgcacggattattattgactaggcaaatggtggcagctgtttcattggcatccgggagaagtagtgtgtttgtcgataacggcagatccagtgcaattaaagagtatttagatgcatatccagttcaattcaagagtatttagatgcatatcgaatacagtatgtcatacgtatgtttataaaataaaaataaataaaaataaaaactgaacatgtttccgatgctttaatatgtcgtccgtatttgagtttgtttttaagttcgttcatttttaaaagtacataagaagtcgtataagaaacccttttaaaaatctcgcatgctaatttagaactaaagtcggacttctaattgctttacaattctcaccagaccgtaagaaagcaacgtgcaagatatgatcatcatcccaatgaggtttctggattagatatcaatactatcaaaataaaaatcccatatatactttttagaaaaaaaattaacaacaatacgattaaaatagtcttcacccgttgtaacgcacatgcatttttttcttaaaaaaaaaggaaaagagaacgtattcgacctaagaagcaaatgactttccgttttcggccatttgctatttttgatatatcctttttcggcccaaccacacacgatcaatccggcccattaccaaatttggccacacgttttcagactttcttttttttgtaattttcctgtggtctttattactccctccgtttcatactataagtcgtttgactttttttttctaagtttatagaaaaatatagtactagtatttttaacaaaaaaatatattataaaaatatattcaatgctagatttaatgaaactaaattgatattttagatgttcctaaatttttctatagatttgatcaaacttaacaaattttaattaggaaaaaagttaaatgacttataactagcatggtggcccacgcagattgcgcggctagcatcattatattttctcttatataatagcatatatgttttctcattatattattcaaatatattaaaatgacattataattttaaattttgcaataactatacgaaactacaaatgtgtaatattcatattgtattttatatacgtgttagttattaattatttttaatatcaaattttagttatttgtaaattatatatattcctatatgtactctagactcgtcttttaatatatttttttaattccgaattttttgtaaattgtatttctatatagactctaggctcttctttcaatattatttattttttatttttgattttttattatttctaattatatttatatgtggactctaaactcatctctcaatattctttaattttgaatttcagttacttctaaattatattcctatattgactttaaactcttcttcccatgtttttcttaattttgaattttagttatttgtaaattgtatttttatacagactcaaaactctacttttaattttattatgtttattctgaattttagttaattttaaattcctatatggactctatactctacttctaatattccttattttttaactctgaatttcttttttttcttaattgtatttctatatggactctatgctctacttctaatatttcttatttttaattccgaatttctattatttcctattcgtatttctatatggactctatactctacttctaatattccttatttttaattccgaattttagttattttctaattgtatttctatatggactctagtctcctcttctaatattccttatttttagtttcaaatttcaactatttctaaattgtatttctatatggactctagtctcctcttctaatattccttattttttaattccgaatttcagctatttctaaattgtatttctatatggactctaccttttctttttctccgattaatgtgagagtttctaggccatgagagcgaacgtggaggctccttttctattcctttaataatataataatagatatgtaacagagggagtatttaacaggccggcctaattcatccattcagaccgaattgggctttttctcttttacacacatgcatataaagtttgtacttagtccctcatattcagccatgtgtataaaatttgtatacgtatgcatatacttagaattcatacatataaactttgtattgtacccaatacaaagtatatacatgtgtatatacgaatagagcggagactagaagcccaatttggcgaccgcggcgagggctcaggaaggcgacggcgaggacgggagctcatcaggaggcaggagctcaggaagtcgatggggccggcatattttaagttcacttacttcaaaacagtcattcaaaaccaagtttattaaacatatgtggccggccggcagctaatttgaagcaaatacaacagatatataagaaatgggctgaagaacagactcgacgaggcactcatcttaagtagaccacccgtactattagcgtcgcatcggcgggttgtgcttgggcgggacgtgctggttgtttccgagccagccaagcgagggtttgtagccgaggctcttgaggtgcctgtactcctggcacagcgcgcactgcaggcagagggcgtggacgcagcagtcgcagcatgggtcctcggggaggtggaagctgtcgcgcatcttgccgcggtagcagcaggagtagaggcagtggcagtgggcgaagaagccgagcagcacgcacatcacgcccgccgcgcagcacgtcctctcccccctcgacacgatctccgcgctccgcccgaacgtgatgcacgggcacaccgtcgtcaagcaacctgcatatatataattagtttgtgtcacataaagacgtgaatattaaggaatgatctaatatggtaccaaatgttatatggtaaaattactcaatcaatatatatattccgggaaataagcttaaattagcttagaattaatagatggtctatacaataaatgcaatatatataatctggtgaaggacgatcgatagaatcatcgcaagtagtatagtactgatcgacaatatggaagtaatatatacgcacaaacttcgcagtcattgaagcaggcgaagagtccggatgaccagtcattgtgttgcggcctcgccatctcctccgatcctctccttcgctagtgcgaccactgaccagctgctgctgttgtgatcggcaggcttgctagctaggagcgatgagcatgagcttagctaggagcgtggctcttatatagcagtagcacgatcggtatgcatgcatgtttactgaaactttaaaacgatgatttttaattatatatattagcccgatctaactagcgtttggttgacccaattaacttagttgactccaccagaaccgaccggcaacactagtcaatgaggcagtgaatacctcggacatgacctagatcaggtctcacgagtcatacaatgtcgctggcagtggcagtagtacttcctcctccgttaaaaaaacaaaaaaaactaacataataataatataataataatataggatgggacatatcctaatacaacaaatcaatgtctatattcgtgtttgggttttttttttatggatgtagtaagtagtaccaactattatatattcatgccttagaaaccatgtttattttgattatcatcttaattagcgtgtggcataccaactatgtgcttgacagttgggagcttgggggatttcacaataactatgtacgttcacttctttttcgcgtatattgaagttccggtcagttaattagccaaccggccgccggaatttcgactccttcccaatggctatttcctgaccaatcttttcatactctatttttttattaaatggtgtctcctaatatttttttaatctcaaatgattaagaatttctttcaacgaggaaaatgtcaatcgatcaagatcaatatatcagttgcaagttgtcaggaaaatgagtaaaagagacaggttctgttcggcttgtttacacttacctacttcttggatcggtactacaacattagaacattataactagctagttactaacttaattagtaccagagttaggttaagatagtaccattagtaacatatttgtgcattgattgctggcaacagctaagctaggcacaaatgtactaggattctaggaactcatgacatttctgtgctgtcgttgcctgaaaaatgatccgttgatttggtcttagaaacctaccccacgagatcgatcttgagctcgaaaacatgagcccaatcagctcattacatatgtgctactgctactgaaagggctttgttgagaaaactgtgtgcttgaaacagccaaacataggcaggatcacgcctgatctgataggccattataagggcatactcagactgatgacgttttcaaccataatatcattatttgttaaaattgataattatgtggctacatttagtttgttattaaatattggcaatgtatatggaattttggcaacattttaaagccaatcctatcaaaattttgacaatgttatcaatttgttaaaattttggtatattgccaagttttggtaatatttattttggcactaatctgaacaaactctaacttgtaagtactgtacaaacaagacttccgagggtctgtactgcaggtcaaaattcatgcaagagaatacttgccatgcgaaagcctttcgttatatattggtatagtagcttcactgcttatgactcactcgattagttaagcacaataattaattgttgagaagaaatggagcaagggagaggaaattctatttgggacttgggcatattgttttggaactgaatattactacgagtagtaatgagagttttaggccccgttcgcttcaggtggcgtgcaaaatgtgatacataattagcagtaattaattatgtattaaacttcgatataatatttttttaaaaaaaagtacaagggagcaaaatgttgctcactacaagtagctcatccaatgagataaccggacaggactccagtgtatccggatattgggccgagagcccagatagcccatctggcgacatgccctccttgggccggatggtccatcaggagagcagctaaagataaaatatggccgcatgctcatcgctaagcgaaccagaagggcccacccaattttgtcgtgcggtaagggtgaggaatttttttatttttaattttt

SEQ ID NO: 43723 - DNA, 10194 bp, Oryza sativa
gcgattttgtactgtgcggggggccgcctgcaaatgggcggcgagggggcatggaattttgcaggcggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctgcttcgctcacttcatcacaggtttgctcccatacatcttttgcatttgtactaatatgttatatttgagtatatatgttgcgttttagttttagttccatatattttagcatatctgtagcacacagcacatatgtgtagatccagagcatagaatataatagtatgaattgagagatagatagtagtgttaattgtaagatgtagtttagtttgatctggagaatgtacttacttttagaattttggagaacaatattgtagagaatgtaacttagggtgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacaacactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggccgacgcacgcatcatccgatgaggaaggtgcatgtaatggccactgattgggcaaatgaggacttctctggacttgattatatcacagggtgatcatgtaccctgggaagtataaggagaaacgaggctaattgcacggcgcatggggtatgctcataaggatgagatgaaggaggcgggtggaatcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttaaaccaaaatcaattattaggcacatcgagaacaaattcaagtacaccataagctatgcaaaggcctagagagccaaacaaaagattattgagatgatgtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaatgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacataattgtaacatcttacgcagacatatcgtccaatgtgcaacttcatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaagactccccacgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaatcatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgggaatgcaatgcattctgaccgacctagaaggtgccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaattcgccctcccccagggcggcaagggggccgcctgcaaaattccaggccccccgccgcccatttgcaggcggccccccgcccagtacaagatcgccctagcagagggcggcaagggggccgcctgcaaatttcgttgacggccgtcgcccgagagcgaacggccgtctgccacgtcactttcaccgccctctgggatggcgatttttaaaaatcgccctcccagagggcggtaggcgaccacttctgtcaattttcaaaataaaaaattatttttgtaaaacttttaataaaaaaaattaaaaataaaaaaaattctaagggtgagtgggtgcagacgtgcagtatggggtatggctggtgtttacagccgtcagatcaaaacgaaaccgactcaaaatctgtgtactgttaaacgaaaaccgactcaaaagctgtgtactgttaaagaatgtctacgatacacagtactacgatttttttttgaacggacagtactacgatttgattatgttttactaagatttgagtatatagcttcataattttaatccaaaattaacattgggctggccgtcggctaattaataatttgttgggggcatatacatcggacaaattaacatgaccatcatcatacacacattaatttgcaggtttacaagattagcaatgcgaggttaattagggatcattagcaactcaggtcgtaatttggcagtcgtgcagaacgagtatatattacaaacgattgttgataagtcgtcgtcgttgatagtatcagtagttggcatcgcactgcttgtataatgtgtgtatacgcgcactaaatcttacctaacgagattaattcagttgggcatttgtctatttgcctgtgtcatctaccaaacattctacattgtcagaagatatatgaagtattccctccgaattttcagcaatacatatgcagcttcataaattatagaactcgtgatggatgcgaaatgaacctaatgaattaacaataatgcatataattttcaccctataaaacggggttatatatgtagtaaaatatagggagaatagccaacatcatccttaaagttttgctcggggatcaatttggtccctaactttttatattgtccaaacgagtccttataatttgtcaagtgggctaatatagtccttgggccaacttaaatcgccacgttagcataccatgttatgctctcatgcataatatgtggtgaaatgtccaatttgcccttctatataccatagaaaaacaatgaaatgagtttacaaactttgttcaatgtgactatggatatatggcaaacttttttcactggattatgctaatacaaaattaaattagctataaccactaaatatataattaccatgccaaataaatttcatgtaagtagttgcattttaatgttaaaactctaacggatatttaatatgcaagatcacctacttatattttgtatttttctcgttttctttctcttttttccctatgacgatatgtgcaagggcaaattgggtatttcatcatatatttgcattggaagatgacatggcatgttcacgtgacaattttcgatgggccaatgactatatatgtccacatgataaagtttaatggcttgcttggacaatttgaaaggtcagggactaaaacgatctcggagcgaaacttcagggatcatagtggctattctcccaaaaatatatataaacttcagggccaacagttccaattattgaagtatatacggagtatgaactagctccgtgttgaccatcaccattgtaagtttgtaacatgtgtgccaacgaaacacaacatgatatccggcttgaactgcgtgttatcagtcaataaggaggatatacaaacacagcatgtggctagagtacacacattcaaccgtaatacgtgttcatattgtcatatgctatacatattgcgtctgtttgttgcaaaggggttaggaattgaaatggaaagttagaaggcagaattagtattttagcaaaccctgtgcttgactccgtaaactaagaatttgaaaaggctgaatttttagtttctaattaatatgcgattctatgtgtactaaagctactcttgagttagcaaatttaggcagtacgagtgtagaatctctgtcttgtactgaaacgattgtaatatccaccctttcccgcaaaaattaaaaagtaaacattgggtagtttttaccactagaatattcttaccactcttgatacgagtgtaactcaactggttaggtttctgttggaggaatatacccacacaagttcaagtcaacttgtcctgagtatttacatttacggttaattattgtttcagtgatagacgacatactcatcgatgacaggatacgtctgcagtgacttcttgaatctcataatacgacgactaatgggtatatgatagaggggtttggaatgactttttgaattttaggatatattggcccagtcattatatgggcgttacatttgcactgtgtttttttaaaaaagaattacaaaagttcgaaatagacagttgaattaattatacttgaatattgcgtgtgtccactagcttgtacacctaaacattttcatacttcggcgccgtagaccgtaggatacgtatagtactctcgttgacgaataatcacactcataaatataaatgcacctatacttttgactttgaaccagagaagcttaattttcaacgaaattattcatttattattttgccccgaaacaaggggcaggccggctaatttggagagtacaatcagaaatccattaaactggagaaaattacaaacaaaagctgagaccacgcatcaccaaacacgcatttacaaacttaatcccatgactatagtcgtagatatcaaataaaacacacgtaatttaccacgggtaattaaaatttttaactggatactctaaaagaaatttgttccggatacttttcgtttagagatttgttccggtccaaataaaaagtatcacatggtactgatacctcacggtatcaaatagtttccgatcgatgaatctaacaatgctcatcgtcctgtccagctaaattcaacaatcagaaacgatttgatactgtgagataccaatatcttgagattttttttgaccggaacaaatcacttttgtttaactgaacaactcttatttcacagtccaagtacgctatttagcggcccatgtactgcacggcgggagcggcgccggcggcggcggcgcggtcggcgttgaggtgccagccgagcttggggtcgtagccgcgggcgacgagctcgcggtactcctggcacagcgcgcatggctcgcagcagaagtggacgcagcagtcggcgcagccggcttcggcgagcccgtactgagtgcgcatcttgccccggtaggtgcaggagtagatccactggcacccggtgaacgcgcacagcagcccgtacagcgcgccgccggtgccgcacgacgtcgagcccctgtccaccatctccgccaccctcccgaacgtgatgcacgggcaccagcacgtcaagcagcctgcagattaatgtgaattaattagtaaattacagatcatgttcatgatatgatctagccatggcacggtggccggcggcgagagcgagaacgtttttttcgtgaacacgtaaaatgattacatatcaatataccacaatggaatcagccagaccaacttatgtcagaagaagggagaaaaagcaaaataaagagctgaagcttataaaaaagagcgagaacgtacataggccgcagtcgtcgaagcagtcgcagaggccggtggaccaggcggcggagccgacggggacgccggtcaccggagcggcgcttggcttggccatcgatctcctcctacttttcttccccggcgatgtgatcagagttgctagctagctactgcttgtgctgagaatgagcatgagccgggagtgggaggacgctttatatagcgcgcgagcggcgagttgatctggtatgcaatgcaagcgaacaacacagctaagcacccatgttaatttactacgaactcgcgacatttctgtgctgttgcttacgaaacgaaccgttgatttagtcttcaacccccacgagatcgatcttgatcgagatctcgcaaacattgagcccaatcagcccatcacattcacatatgtataatgtgctgctgctactatactgatacacaggttaaataaataaatccagaaaaaagggggctttttgttgagcaaactgtgtgcttcgaacttgaaaccaccgaactggaaatgatcacgattcaagcctggtaggctattctaacttgcattatgtgttcaaacgagacttccgagagggccccaaaattcatgcatgcaagagaaggcatgccatgccatgccaaagtctttcgtgataccattggtatatagctccactgcttatgactcgctcgattaattaattaaggctgagcacaataattagccgtcgaatagaagtgggataagggagaggatcagaggaaattctatatcggttttttgtaccgatctaggcttcactagatttatattagtaggttatctatctggtagtactatgttgtgtctaatattgtactaatctacattttataatagagggagtatgcttctttttttttagaaaaaaggattagtaatttagaaattggactcacggaaaaaggaggtagttgatccgatgagcttgatccaacagggccttagtgcattcgcaaattggccgatcagcccaattagcccatttagcgacacgctgagtcccttaaatgggccggacgtcatcgccaagcgaactagaaggcccaaatttgatttgcaggtgtttacaaccgtcagatcaaacgaaaccgacggcggctaataattttggggcatatatatcatgcagattaacttgaccatcaccatacacacattaatttggagatttacaagattagcgatgcgagattaattaaggggtctttagcaatgcagatcgtaattaattttgaagtcgtgtagcgaacgagtaatatatatacaaatgttcttgatattcccaagctagtagttaggccgttaatttgaagcataggtcggatttaatatataatatttaaaaaattctaagtcgttggtagtaccaggagttgacaatgcactattgtataagcctggataaggctatacgcgtactaaatcttactgaactagattagatgcgtgttgtttaattgcttgtgtcgtctaccacacatcgtcaaaaaaatgaagtgtttccttccgaattttcagcaatatatacagcttcatgaattattaattagaactcgtgatgcgaaatgaacctaacaatgcatctttgttctcaccctaaaagactgcgtaatataagtttcagagccgacgacgcttccaaagttccaattattgaagtacggagtatatacactagctccgttgactatcaccatcagaaaacatgtgtgccactcctgccaacgaaacacaacatgatatctgccaacgaaacacaaacatgcatgatatccggcttgatctgcaagtgtcagtcaatgaaggaggatagacaaagcttacaaattaatacgagaaaacccaagaaatgtaatcaacaaacgctctattctaagatatcattgacgaacctaactttatgaaaatgttatgatacaagcatctttatatcagaaatatcatcattgttagatttttgttagtagtcttccgttagtgctataaaagattattttattgttatatattgttgaatgctcaataaaattattgttttttcgttagcattaatttagtgtaaagagcaatatataaattagtgtagtcacaactcttattatatgggctcatatgttttagaaaaaaaggatatgtatttaattagggaaaccacataatctgtcattttttttggtttgtgtaagatttaatagaacgataaataatttgaaacagaaagactatatccaatgggccggacgccaactaatttacagcaaactaatacaacaacaatcgattaagcgcagagaattacaaacaaaacttgaccatgcatcaccatacttacaaacttacaggagtacaggcatagtccctagatatatcaagtataataatttatctggacagctcttcacactcactacctccgtctcaaaataagcttatttgtgagtttttatgttcaacatttgaccgtccgtcttatttgaaaaaaaaaagtaaaataagtcacgcgtaaagtactattcatattttatcatctaataacaataaaaatactaatcataaaaaaattaaataaaatgaattgttaaacgctagatatagaaacctacaaata

SEQ ID NO: 43724 - DNA, 3258 bp, Oryza sativa
tagtctcctctaggttagttcgataagcagcacggtttggcaatcctgggggtatctcggctggaaagacatcctcatactcctgtaaaaggttagtaacaacaagatgtatcgaactagcaatatcatctaaagaaaccaaggcttgtttgcatatcaagaaatagcacatatcatcatctgaattttcagcaatgtcacatttcgttgcaagcataacaccacccttcgacttaattcccttagccttagaactaggtgaaagattatcctttttaggtggaaaaacagttttagccacttgctgattttcagattcatcaagtttcaaactagcagctcgctctttatcagcttctacaatttcagcaggggtcaaaggtagcaaagtaatttgcgtcccattatgcacaaaagcgtatttattactcctaccatggtgtgaagcatcattatcatgttcccaaggacggcccaacaaaagtgaacaagcttgcataggaaccacatcgcaatcaacagaatctgcatatgagccaatggaaaacgaaatcctacaaacttgtgttacctttgctcttccggaatcgtttaaccactgaatatggtaagggtgtggatgtgtacgtgtagtcaagccaagcttcttgaccaaatcagaactcacgaagttgttgcagcttcctccatcaatgatcacacgtgcacgacggttgttgatgacaaagaaaatctgaaacaaattatggcgttgcaacctgtcatgctgctgtacctgcgtgctgagcacccgctgcacaatgatggttctgtagtccgttgtgtcatcacgaccaaagcttcgccatcctcatcctcaacttcttcttcctcctcttcctcttccacgtcggaggtggtgatgtagccatcttctgtagcaacataggcccgttgactagggcaatctttctgcacatgcccaaacccttagcaacggtggcactgaatgcgtcccgtcgaggcgacatatgaggcactcttggcgggtacctgcgaggatcctttacctgactctgctggtcgtggtggtggagatggttttggtgccgcagaagctccggatgctgctggtcgcttgcccgctggctgggaggatgcccgaaacgagatggccttgggcagtcccgcagatggcgtcgtgcgcggagtgtatgtgcttgccttgctcttgccctgatggtcgcacccctgtaattccttctctgcaagcataacaaatcgaaacaactggttgacagagttaaattccttataatcaacaatgttctgaatttcctccctcaaaccagaatagaaacgacaaatagcatcctcgaccccctccactatgccacagcgtctcacacccttttgtagctcaccatagtaatcctgtacagatttatccccttgttccaaacgcatcagtttcttgcgtaaatctctatgataagatggaggaacaaacctatcgcgcatagctaccttaagttcttcccaagcagtaggtagtaccccctcatcagataacccagcccaccacataatagcaaaatccttgaactcactactggcttgtctaactctatgttgctcgggtacaaggtgggcattaaacttttgttctaccgtcatctcccaatcaaggtatttctcagcatcataatatcccgaaaaagatggtattttaaacttaaccttagcataaggatcatcgggcacatgattattattattaccttgttggtggcgagtgccacccatacctgtgcggtttgtgcgtaggcgatgtcgtagccatgcttgccttgtagccagtgcatcaatatagccactggaatcatacaccgtgtcttcaggatgagcatcgtcgtcaccactcaccacttcctcattggaaggtgtctccaacgcggcgacctgatcagatagcgtggatatccgcttgtccaacctctccatgtggttcaggaaaccgattttagtgaaggcatcttgaacagactttgcaacggcctccgtgatgtccttttgagtattttgttggagagttcgtagttgctcttggctgacacagtcagcaaaatcctagggactcttctcaccttcgttacctgacattgaaacaccaaaacataaacaaaatggtgaaggttatccctaataatctactacgcaggtgtagtggtgcctctcaacgattctaagcaatatggagttcctaaccaagctcttataaggttcttaccagcaaagcaaaggatacctagaaggcgtagtcagcgattgcagggatcaagaacctgtgctgtgcagaagtaatatgtggagctaggaaggccaaatatatgtatatgagtggtacacaatccaatgacagatagtaatgctgaataaaaatcccaagtcacttgcccatagttgctagtctactcatgtcctagacagtagtgataacaaagatggctcaaagaatatgacactagtaaacagcaaagaaggactggcaggcaagcttcggcgagtttcagcaaaaactacaaaaccgaactggcaaataagctcaacggagcgcgtcatgagctcaatgcactagtggaaatcaacttttctttttttttcttttatttttttgatatttttttcttttttcagaacacaaaaataggcagacctccaagttacagcttaatcggagtaggtatgtggcctatggatttttctgaaaccactataaacaaggtgcaggaacttgtgagctcgaacagacaattttgcaagccaattttcggaattttggattcgccaaacccgccgaaaattttgcaagccgatttttggaatttttgagaaaatttttttctcttatctgaaaagttaaattttgcctgattccgagtccgtatgcaaaagttatggccgtttgaagtttcggcttctggctaggttttccaaaggggatataacctagtctattttgcggtggaattggggatatggtggcagcggagttgtagggtgttctggtggtgatctggatgggtgtttatgatggcggaaacggctctcaaaggatgaaccctagcacacggtgaaaggtagcggctagggttacgaaaggacaaacacacgactagactaaaacacgcattagaccagcaataggaatttagactaggactcaaactcaacactacggactctgaaaaggaatcatgcaaaggctaaacatggtct

SEQ ID NO: 43725 - DNA, 8445 bp, Oryza sativa
tgttctcgacagattaatctaagcaaaacccaaaaacctaaagatggcggtgggtactgatatatagagtttagggtcgtgcaaacccctctcgacgccaccctaatgggttccaacactatacacgggccaaaggcccaaatacggtgacgcagcaccgggacagattctggatgtcaatttgttcggtcatttcccattgactcggaaagaatttagacgtgggaccaaaaccattggaaatgttatcttcttagctttccatccatataaagtatgccccaatccggacacgtatgcgacctgggcgcccgttttagtgcagactggtcctggactccgaattgcacccgacgtcgacttggtttgggcctccaccttgacttggacgtcccagatgatcctccatggctctaagtccttctccaagtgtctccttgtcccctccattgttcctaattacaacataatcattaggtagcaatctattctcgaattcatacaaagaagaacataggaacgagctcacctctaaatttaattgtcgcgcacgagctcttgttatcggtccttgaatgaccgttggaggattgttgtgtgtatccgaggtagtgatgtccgcatcagtaggtacacaggcccgagaataccgatctctttgacaaggtgacaaagcagatgcgtcattatattgaaaaacgaaggtggaaatgtcaactcaaagctgacaagacattgcaccacatcattttgaagggcttctaatctatccggatcgatgaccttctgcgaaattgcgttcatgaaagcacattgctttcttattgttgcccggacattgtctggaaggataccccgaattataactagtagcagttgtgtcatcaacacgtgacagtcatgagactttaggtttgtgaacttcttctcctttatgcttattattcgctttatattcgtggaggacgtccaagaattcccaatagggtaactcccaaaatatagagttctttttccacatcgtcgcgtgaccatctgcgctatcattaggttggctgccaggcccctttccaaacactactttaagatctttcaccatagcaaacattgttttctcactgcgatgtttaggcttcgtacagtggtccgccttatgttcaacgtgcttgcctttctttcgtacagggtggtttgcagcaaggaatcgacggtgacccatgtacacaaccttcctacagtgcttaagatacgtactttctatttcatccatacagtgagtgcaagtcttgtaccccttgttaaactgcctggataggttgctaagtgtaggccaatcgttgatggttacgaacagcagcgctcgtatgttaaactcctcctgtttgtcctcgtcccacacggggacaccttctttcttccacaacagtttcagatcttcgaccagtggtcttaggtacacatcgatgtcgttaccaggttgcttggggccttgaataataatcggcatcattatgtacttcctcttcatgcatagccaaggggggaggttgtagatacacgtcgtaacaggccaagtgctatggccgctgctcatctctccaaaaggattcatgcctgtcacgcccagaaattcactagtaatttctgaactaatttatgcatagaatcctcgtccaggaatcagccaaggtacacaaactgacaatttaatatacaaattcatcataataataacgttacatacttacaaaacaaaagaaaaacaacagcggaattacgatctagcgatggcttcagctccactaccacaggcagctcaattggggtataagccaaacgtcttctccttctggatcctttttcttcagctgaggttgattgattattgcaaggtgagcatatgacatactctgcaagccacatagcaaatatgcaagtgcacaaggataccaaaggatggcataaataggctcatttgcaaaagcagcatttagcaaacatttgagaattgaaaaacagtagagtaattaatcaatgttattcaacatgaacatcacacccatgctgctcaggcccaaccatcctgtacacaaggagctaagcaaattattaccagttatagcatcaataattatttgagaggtgtgacactaatcacgaaaaatattgctcaacccgcccatgaccgcgggcacggctattcaaatagttttgttctggccagaggtgtaccactgtatccacaagacacagctccacgatatgttaccatgcgcctcaataccaccacggtacctcggaaaagaactgtgacggtacccctcgcacaacacaactcatcatagtgcaccaatcctggatcataatcaccccctctataaatataaccagaggcatggactccccagcgacccccatggacttctcgccgcttctcggtctaatgtcctgcaatgaaccttgctatataaaaggtaaagccgttgcccacgctggcttgtggttggcacggttaatgtctcacaacagtagctcgcgaaccggtccttaattgtcatgagcacgagcttcaaaaccatatgctcacaacccaccattatcaagtttaaattatcataacacgattaaccatcgtgagctaccattaaatataatcataaataataatgtagtatgattcattccattaatgagctaatgtttctaaacatggctaagcaattatatatatagcatttagctgaaccaatccaatatataaggtccatgctaatcaatttattacccatagaaaaataaagtcatcttcgaccataattaattgggaaaggctcaccacccgatggcattcgaaaataatgcataagttgaaataaaacattagctttaaacaggttcaacatgctcaaagggttgtttgggatatgtgtgacttgccttacaataatcagtcttcaattaatcttctgaaccacttccgacgctctcacgaaccttcgcaatgacggaaatgacaagctaacacgcaaaacgaagaaaaagactaataaaaaccaaataaacagtacataaaaagtaaacgaacatgtagatcatgattttagatgaattatgagacttgaacggcctcattctgacttcatatgaattagttatgaattttacaagattaagtccaattaaacctattaaagaaaaaaaactattccaaattaattaaacaatttacaaataatttataactgagatataagactaaagcatcctccggaaattattggaatgaatttagtagacgacatatagtaaaaagaactaatatgccattgaaagggataacatgatttatattgattttggaaggctgagatcaactttgacctagttgaccaaaattggatggctcggattgatctgatctaaggttttagatggctgccacgtgggacaaaagagatgacgtggcacttaggtgccagggacggtagctgacaaggcgatgacatggcaaccacgcgggatcgacgtcggctgctctgttcggcggtgaggacggcaaacggcggcacaacggcggaaaccgagagcatggggaggatgaggatgacgcgacgatccttaccaacacttacgcagcgatgaacagcgaaggagatggccggcgacgagatcgggagtggcgatggggtactgatcaacgacggcgacggcgttctccttacagatgcaaatccaatggaggcaacggcgaccgaaggcgacgacggacgacgacgaacagcgcgactggagatcaaaccatggcaacaacccacaggttcacggcgacggcaaccttccggcgggattcggcctcgggtaaggggtggacggggtgtagcttgaccttgcggagccgagagaggtggcggcgtaggagggcgacggccgaggcgacgacaaacggcggctggagcgactgccggcggcggagaaagaagacgagcgtggggaggcggctagggttagggaaaacttcgggaaacagaagaggaggctgaggggatgctatttataggcaaaggtggaggagatcggctcgggaacggatgaattcggtgaaggaagttaggatttatcctgagtttccccggataaaaacgaccaaaattcgtgagatagataacgaatttgatgaggcatcttagggatatgatagaggagatagggaggaatccgtttttgcactcaatttggaagggaagcaacggatgcatcgaatttgatgcaggagacggcggctctcgggaagaacacggcctctagacggctggctggagctttaagacgcactgtatcgcgggggaggccaaacagactttaggctgggctgaggaacagggagaagggaggaaggaatggtcccaaaagggcccaagctgaggaggaggatttttattgcttttccaaataaatcaatcaccaaaatgatctttgaattgttaaaaatacttcccatgctcaaataatttcaagaaaaatcctgaaactaattggacacccaaagtacttaactatattataatcagaccatttacggattaatttattatttcaataattgctgaactgctctttgtattattaaaattaggaattgagctctgaaaaatccgagaaaatttcagagagtataattaaccatggagaatttaataaaattaaatccagccattctttatatttaggaaattttatttcccacatttaacttcacttgtaatttaatgagcatttaatataaattctaaataaacacaataaactcataccttgccttagcatctaacaaacggcggctcaaagatgtgatgttgtatccgtcgctgttcatcttctcttggttccctcataagcataataatgtcttgccccttgagcaaaatcggctttcttgattgcacgatttcaaaggcaagacgaacaccgcaccaacatccatagcatcatgtgaaggagacttatctctaatgaccgatgattcttctctcatcatattggatttatcactagtttgggaaatcaccgatctcttaccttttacttctataggtctccacactcgcttaggtgtcattcgaggctctaaattattacatgttttgttctccatatattcggcctccttttctttttgacctatggcccgaagacgctgtagcctcctcttttgagagcgagataagtcagaaggtatccatttcgactgtggttgttttccaggagctaagcaatgattcttcatatttttggtcaaagtggaagctcctgtgttgctctcaattttctcactcttctccaatgcccctcggtcaaaccggcctctgagctcggtcagaccggccacaagccgtcggtcagaccggccaggagggtcggttagaccggccgttgtctggcggttagactggccagctgttttggtcaggccgccgatgttgacagtaacggcgtcggcttcagtctcctccgcttgtatagttttcgccgcatctccagtaggtacatgaacatcttgagattcctcattgatagcaacgacctccggagctttggcttctttcctcacccacaccttcttcacctttgatccaccggaccgattcttttgtgggaaacgatcttgtcttgaattagatgaatgattctgtactgacctaggtgattccttccactcttgataatacggcataggtggttgatgcatccacggcatgtaatacataaaaggataaccaaacggtgacattggatatggataccatggcatcacaaccggtggtttatatggagttggtatagttgatggctccgattgctttgatgtttgaccaaatctcctcttacgagatgatcttggtctttttgaatcactagtttgattatcaaatcgttgaccggctaatcctttcttgtacttagccataagcatctcaaaagtgagcttcggctttttggtcctttggaaactagatgactcatcctttgcaactttatgatcttcggccttcgcattttttattctattcttgggccgaggatccccaataataacacttttccatttctttttgtcaacatcaatagaactaacagggagagaatcactaacaattccggtcttaggcatagaaataaccgaaatagtttcacaagtgaccgatgaatcatcaaccgatcttttctccatcaagcttgcatctttaaaataatcatgaaactcatgctccatttgtaaccatgtagaaattgaagtaggagcaaggaaactataccatgtagatgcaaagtttgacaaagaaaggggaaacaacttcaaattaagcaaatcatcactatcgcccttaccacattaataaataaagcggccgatatgctccattgtagtcatagcattctcacctttgaatttcgtgaagttgggcacctcaaatacttgcgggtatgggaccgaatctacatgttcaggatatggcctttgatatgtatgcatagctactttggattctatttcaccactattgtcacaccctaaaaatctccaaattataaattttcgtttaattggaattagtagaatttattttaaaagcctagaagagaagatctaattttaattaataaattccaatataaaatggggccagataaaattttattaaatactttgcttaattctataattcctagatttttccgggatttatttgagctaaggaagtatttttaataaatggaattgcatttaatgaataatttaaatggaaaaaggtttttaaaattcccttttggttttgggccgaaagtcggcccaaaccgctctctctctctccctcggcccaagttggcccaagccgaccgcccgcccgcgcgcgcgcgcgcgaccgccgctgacaggtggtgacccctttcctctcgccgaaaccctagccgagctgcgccaccgccgccattccaaatccagccacccctttccgtttccggtgaaattgattgaggggaaaggatccccatgatccactctaccttttcccttttggaaacatcgtctaaatcgctttggaaatcgccggatttgagttcgattcggatcgatctctctcctccaaaccctaaactttccttcccgtcgccggtcgccgtgggccttcgccgccgctccctagcccctataaattgacccccgagctcccctctacccgtcgccactctcgccttagcccgccgccgtctgtagcgccgcctccgcgtgagaccttgagccgccgtcgctgccgtcgctccagccgtgcgccgctgtcgctccggtcgtcgtcaccgctcgggaaggccgccgtcgtgatcgccgtctcgttgccgtctccatccgcaccttctccgtcaccgttgaccgccggaacgccgtcgccgtcgtcaagccgaaggttgctgccgccttttcctcgtcgccgacgtcgtccgttgctcgtccaccgtcgctttggtaaccggtgagttcgcagcgatgcccgcatcgtttcggagccctccgttcgcgccgccacgccgtcattcgccggcgagaatgcgtgcccgagccgccgccggtggtgacgtcgtcgctgacgtcatcgtcatcatccctcgtggtctagccgtggaccgatggatctcggccgtccattttggatggatcgatctcggccgtccgtttcgtgaaccgccgccgtgcacccggtcaaccgtaaacccgacccgctgatgcaataattcccttttccttttcaaaaataattaattattgcgtcataattcaattaaaatctacataaatgatttaaatcgatttaatctttgaaaattcataactaattcatcttagctcggatttagttggttcaagtctctaaatttttctaaaattgagatctacatgttaaaaatatccacatgtactgttcatgcgtgtttatgtgctgttttggtgattttgttcttttctctttagattccgacgttccgggagagtctgattttgcaggagaagactttgaggatttccaaggccagcaaggcaagtcacacagattcctaacaaccctttgagcatgttgatcctgtttaaagctattgtttctattcaactattgcatttattttcgaatgtcattgggtggaattaacctattatttgttatggcccttttgttcttgattactttattctttgataccttgggttaatgtaatttgactagttgagctttatatgatggttcagctagatgttaggcataattgcttagccatgcttagaaacattagcacactactgggataacttatgcttcactattatttaatgatggtttaataatagctcatgatggttaatcatgattggtttatcaattaatctgccaacta

SEQ ID NO: 43726 - DNA, 6158 bp, Oryza sativa
catgtgaatatttttaacatgtagatctcaattttagaaaaatttagcaacttgaaccacctgaaacggatctacggttatttagttatgatttttcgaagatttaatctattagaaaaacgggaaaaagaaaaagatgatgatgtcatgatgacatcatcaatggtggccggaccgagatggtgacctcgccggagattggatggtcggctgcgaacatggaggacatgtacacgtagaggacgacgagacgaacccaacggtactcaccctcgagccaaacgacgaacgacgacggccggcgacgagatgaacggcggcggcggctccggtcggtggtggcgagtaggctccggtggtcggtggctacgggggacgggcggccgggcttcccctcaccttggcacacctattggcggcggcggcaagcggcggcgacgacgaaggcggcggcgcggcgctaccggagttggccggcggcggtggcgagctaggcggcggtggcggcggagctacggagcacgggaaggcttgggagacggggaaaacgaaagaggaggactaggggatcctatttatagccttggattgaagagatcggactcctcccgcaagaaatcgatccgggaaatcaaaaactcggttttggagataaactcgagaacgagtttgattcggataaaatactcaacgattagctccaatttttgggggtaaagatagaggaggatgagaggatcaaaaccccttaaacaatcgacttcggggagcccggatttatttcggttttgcagggaaaagggggcggctcggcgggcatggctgggctcgcccagccgactgctagaggttagggaagggtccaacatgtggggcccacatgtcggtctcccgagtggagggggtggctggcgggttgggttgggccggctcggtggctttgggccggctcgggcgcgcgggagagagagaagttgggccggaatcggcccaacgacttagggaagggatttttgaactttttaattaaaataatttgtgaaatgttgttccaattattaaaaatacttcccttgctcaaataattcccagaaaattctagaaaatagaggaacaactaaagtatttaataaaattttatctagctcatttttatgttgaaaattttcctagattattagagtttaacttgtaggcttttagaataatttctaaaaatgatttaaaatatgcatttttaatttaggcgatttttagggcgtgacagcccctctgtcagaatagagatccaaggtgtacctttcctgtttaaccttattctgttagaatctaaagatcatgatgtcatcctagggatggactggttagccagatataaaggtgtgatagattgttccaatagaaaagtaactctcaccagcaatgatggtcaagttgtaactgttcatgcattgccctctgaacctcgaaggtcaagtctaaaccaaataactttggaagagattcctatagtccgggagtaccctgatgtgttccctgatgatttacctggtatgccgcctaaaagggatatagagttcagaatagatctggtgccaggaacaactctgatccataagcgaccatatagaatggcagccaatgaattggaagaagtcaagaggcaagtagatgatttgcttcagaaaggatacatcagaccgagttcatcaccatggggagctcctgttatctttgtagaaaagaaagaccatacccagaggatgtgtgtggactatcgcgcacttaacgatgtgactatcaagaataagtatccactgcctaggattgatgatttgtttgatcaacttaaaggtgccaccgttttctccaagatagatcttcgatcagggtatcaccagttaaggattaaggaggaagatatacctaagatagcttttactactcggtatgggctgtttgaatatacagttatgtcttttggacttaccaatgcccctgctttctttatgaacttgatgaacaaggtgttcatggaatacctggataagttcgtggttgtctttattgatgacattctcatatattcccgaactaaagaagagcatgaagaacatcttcgtcttgcattagagaagctgcgagaacatcagttgtatgccaagtttagcaaatgtgaattctggttgtctgaagtgaagttccttggtcacgtcatctcagcaggaggagttgtcgttgatcctagtaatgtggaatccgtaaccaactggaaacaaccgaagacagttacagagattcgcagtttcctaggtctcgcaggatattaccggaggttcatagagaatttttccaatattgccaagcccatgacacgactgcttcagaaggatgtgaagtacaagtggtcagaagaatgtgagcagagttttcaagagttgaaaagtcgcttaatatcaactcctattttgattttgcctgatccaaagaagggtttccaagtgtactgcgacgaatccaagcttgggctaggttgtgttctgatgcaagatgggaaggtggttgccaatgcatctcgtcagttacgtccgcatgagaagaactaccctacttatgatcttgagttagctgcagtggttcatgcgttgaagatttggcgtcactatcttttcgggactcgaacagaggtgtatacggatcacaaaagtttgaagtatatctttacccagccggatctgaacatgaggcagcggagatggttggaattgattaaggattatgacctgggaattcattatcacccgggaaaggctaatgtcgtagcagatgccgttagtaggaaaggctattgtaatgctatggaaggacgacagttgccattggaattgtgcaaggaatttgaaagattgaatctgggaattgtcagtagaggctttgttgcagctttagaagcgaagcctactctcattgagcaagtcagagaagctcaaatcaatgatcctgatatccatgagatcaaaaagaatatgagaagaggaaaagctattggatatttggaagatgagcaaggaactgtatggttgggtgagagaatctgtgttccagagaacaaagatttgaaagatgcaattctgaaggaagcccatgacactttatactccattcaccctggtagtactaagatgtaccaggatctcaaggaaagattttggtgggcaagtatgaagcgtgagatagcagagtatgtagctgtgtgtgatgtttgtcagcgattcaaggcagaacatcagaaacccgcaggtttgctgcaacctttgaagataccagaatggaagtgggaggaaatcggtatggatttcatcactggtctacccagaacgtcatcgggccatgactctatttgggtgatagtcgacagacttaccaaagtggctcatttcatcccggtaaggacaacatattccggaagtcgctaggcggaattgtatatggcaaggattgtgtgtttgtacagtgtgcctaagaaaatagtatccgatcgaggtagtcagtttacttcaaagttttggaagaaacttcaggaagagatgggttctaagctgaacttcagtaccgcttatcatccgcagacagacggacaaactgaaagggtaaatcagattttggaatacatgttgagagcttgtgctttagacttcggtggaagttgggataagaatctgccttacgcggaattctcgtacaacaacagttatcaagctagtcttcaaatggctccttatgaagcactgtatggtcggaagcgccgcactccgtttttgtgggatcaaacgggagaacgtcaggttttcgggactgatatcttaagggaagcagaagagaaggtaaagatcattcaagaaagattgcgtatagctcagtctcgtcataagagttatgccgacaatcgccgcagagatttaagttttgaggaaggagatcatgtgtaccttcgtgtcacgcctcttcgaggggttcatcgttttcacaccaaaggaaaattggcaccgcgttttgtgggaccttataagattgtcagtagaaggggtgaggttgcttatcagttggagttacctcaatccttggcaggtatccataatgtgttccatgtgttacagctgaaaaagtgtttaagggtacctactgaagaagctaatcttgaacagatagaagtccaagaggatctgacatatgttgagaaaccaatccgtatcttggagatagatgagagaagaaccaggaatcgagttatccatttttgcaaggtacaatggagtaatcactcagaggaagaatctacttgggagcgagaagatgaactaaagtcagctcatccgcatcttttcgccagttcttccgaatctcgaggacgagattctatttaaggggggtaggtttgtcacaccctgaaaatcccaaatatgtaaattgttgtttaattggaattattagaaataattttaaaagcctagaagagaagatctaattttaaataataaattccaatataaaagtgggccagataaaattttattaaatacttcacttgattctatagttactagatttttctgggatttatttgagccaaggaagtatttttaataaatggaattgcatttcggcccaatgccaaaatgaggatttttaaaactttttcaatttaaattaacgcgcgcgcgccctcgccgctgactggtggggccggcttcgtctacctcgcaccgccgccgcagccgaaccctagccgagccgcgccgccgtctccttccaaatttgatcgcgtctttccttctccggtcgaatcaatagaggggaaatgatctccgggacctcctctaccttttctcttttggaatcatcgtctaattttgattggaaagcgccggattcgatctcgagtcggattcctctctctctcccgaaccctaatgtttccatcgcagtcgccggccaccatgggcctccaccgccgcccctagcccctttataagaacccacgagacctcctctccctgccgccaccctcgccttagctcgccgccgcctgtagcgccgcctccgcgatcaaccgtgcgccgccgatgccgccgcgagttcagccaagcaccgccgtcgctctggtcgtcgtcgtcgctcgggcaggacaccgtcgggatcaccaggtcgtcgccgtcctcgtccacccctccgtcatcgccgaggatcgccggaagaccgttgtcgtcatcaagccgaccgtcgccgccgcttcttcctcgtcgccgtcgtcgtccggtcgctgtccgccgccgttcgtgcctcggtaaggatcgccgcatcgcccgcaacgtgtagatgccctctgtttgcgctgccgcgccgtcgttagccggcgagcatccgtgtccgagccgccgccggtgatgatgtcaccgctgacgtcagcgctgacgctagccgtggaccggcggtagatcgataagatctcagccgttcgttttcgtagaccgccgccgtgcacctggtccaccgtgaacccgagccgctgacgcaataatccctttttcttttcaaaaataattcattattgcgtcataattcaattaaaatctatataaatgatttaatccgatttaatctttgaaaattcataaataattcatcttagctcggatttagttggttcaagtctctaaatttttctaaaattgagatctacatgttaaaaatatccacatgtactgttcatgcttgtttatgtgctgttttggtgattttgctcttttctctttagattccgacgttcccggagagtccgaatttgcaggagaagactttgaagagttacaaagccagcaaggcaagtcacacagatcccaaacaaccctttaagcatgttgatcccgtttaaagctactgtttctataaaactattgcattcattttcgaatgtcattgggtggaaataacctattgcctcgttatagcccttttgctatcgattccctattctttgtcacttggtcaatacatttgatcagctagaacattatatggctttagctaaagcgaataggatgcttacccatgcttagagacactagctcatactaaggggatactcatgattgactatt

SEQ ID NO: 43727 - DNA, 2556 bp, Oryza sativa
  unsure (1)..(2556): unsure at all n locations
nnnnnnnnnnnnnnnnnnnnnnnnnnnnnnnnnnnnnnnnnnnnnnnnnnnnnnnnnnnnnnnnaggagaagactttgaagagttacaaagccagcaaggcaagtcacacagatcccaaacaaccctttaagcatgttgatcccgtttaaagctactgtttctataaaactattgcatttattttcgaatgtcattgggtggaaataacctattgccttgttatagcccttttgctattgattccctattctttgtcacttggttaataatttgattagctagaacattatatggctttagctaaagtgaataggatgcttagccatgcttagagacactagctcatataaaggggatactcatgattcactattatttaatgttggtttaatgatagctcacgatggttaatcgtgattggttaattaattaatttgccaactaaaatatgataatggtgggttgtgagcatatggttttgatggttgtgctcatgacaattaaggaccggttcacgattttcggttgtgaaacatttaccgtgccaaccacaagccagcgtgggcaacggctttactttctgtatagtatggttcattgtagagcaccagactgtgaagtggtggagataagcccacgggggtcgctggggagtgcactactttgaattgtgttatatagagggtattgtcacaatctctattcgggtacttgttaagtatcacgacgcatggttgacatgatgttgtggttgtgtcttgtgggtacagtggtagacctctggctagagtttaaactattcgaatagccgtgcccgtggttatgggcgggtctaacaatgtcttttgtgattagtttcacacttctcaccataataaatgatgctgttaataatttgtttagctcctggtctggaatggtatattcctggtttggagatagaactgtgcagccgggattggttgttcagaatggttgggcctatgcaacagggtatgttgtatagcgttggattaatactgtttaattaatattctactgttttattaaattctgaaatatttattaaatgctatttatgcaaatgagactatactatgccatcctttattatcctgtgcacttgcatatttgctgcgtggcttgctgagtatgtcatatactcaccttgtaatcattcatcagaggaggagttctacagtgatgccgatggtgtgtaggattacgcgtagccctggtcaagctgcctgtggagtggagtcgtctgcgccgtttatcttattttccgctgcttagaactttattgattgagagaaactatctacctctgtaatgacattatattcgcttattaattaaagtaataattgtactctattatcaatttgttattgtgtgcctcggctgattcctggacgagggtttacacacatgtaagcgtttggaattttggatagaaattccgggcgtgacaaatttacacccaaacttcaccatacctctcatcttctcctaggaaacatctacatggggccactagacagccactcatacttggttgagtgaagtacaagtgggatcacagcctcaaaccactgccaactcctttaaatcgtttctaatcctcatgttgacaactagctctcactttccaccttcacttttaccattcactactacagccaagatatttgtgtgagggctaaaacgatttttgcacgcgggtaggcggcccgcacgcacctaggtgtctgggaaaatgatgatttttggcgcaccaccacgggaaaacaaaaatccgaaataacataatttttttataccaacaaaaccctagaatccggcggtgggcttccgcccgacggccatagtgctgccggcctccgcgtcacccgctgtcggatccgcgctcccctccggccgcaacgccgccgacgcccctcccctccgccggatctaggcagggaagaaagggaaaaggaggggagctagatctggcgctgggaaaaggcggcccggctgcgggatacatgcggggacggccgccaccgctggattcttgcgttgacgtccaccaccgttggatccgtgtaggcactgccgccgcccaccggatcccacgccctccaccgcctccacatggaggaggccggcacgctcctactcccaccgccgccgcgcctctgctgtcgccaccacgccgctactgtcaccgcgcgccgccaccgctaccgctgtcgagaggagaggagaggagagtggagagaggagaggagaggcgtgagagagagaagactgagaggagatggtctgcgtggaaattttaaagtggaaaaagggatagaggggaggggagaggagagaaagaggggaaattttaaagtgagtgagagaggaaagagggagttagtatttttgcatgcggctctcttaataggtccgcatgggaaaatcggctcattttcacgtgctgtccatttaagaggaccgcatggaaaaatcgatttttcccagaagcaacgagttgccgcacggaaaaattgatttttccgtgt

SEQ ID NO: 43728 - DNA, 6045 bp, Oryza sativa
atttttccgtgtcgtcctctttaatggaccgcttgcgaaaatgagccgattttcccagaagcaacgagataccgcccgcacggaatctaaaagatccctatccaggaaaatcgtttctgtagtagtgattcatgaagttccttctctacttgatcgatccattttctttgtttcttttttggcatagattgaacacttggtggtgcgctcgtcggcgttcctggtgtctagagcaccaccatcgccccactttgtcattcccgtcaactcgaatcatctccggttgtaccattgcgccactgacattgcctaggtcccaggagaacgacgcccacatatgatctagccaatacgccgccacgaacgccgtcggtcgccgttgctctcctactgcctctgcttctcttgctgccgagtcaccgacatgtgggcccagctgtttagctacttcattaggtgctaaggactttaattaggttctttttgtaaaattgctttgtttgccatgtgggcttttggacctaaatgcaattcacctaatgcccagggacctttttgtatagggtttagggcttaccctaaaacatgaaattactatttcatgcatttattacttgatataatagcttgatgagtatattgttatcacccttgctttaaccccctcttttaaatcaatttggagtttttgccgaagccaggagtttaatcatataaattagtttcattccaacttagttcccaggtatagattagatagatggtttaattctatagcaaaacattagagttggcttatcctatagcttctacagtaatagttagccacaatcttgtgaataccctattattttatgtaaagaaatttccattggagccttaatcaaatgtatgcgatgaagattcagattgttgaacctgtatcaatctactgatccaggggttgatacagtttaaaaatgtcggttacccaatctttaattttaggacccgacaaggtgtgtgggtggggccccctgtgatttgccagcctagagcgggcgtaccgctcgcgccccctccccccagagccggccctgactacatgggccttaaaaggccaaatggcatcttatgacgatttctgggcttgatggcgacgaaaatggacgccatagactctatgacgacagaaagatcgtcactagattaatgacaaaaagataagctttctttatagaacgccattagagtcgcatgataggtgacgaatcatattcgtcacacgaatgtcacagatttcattgcatgacttaaaattcaatttttatgacgtaaatgagcatcacctatcataagattcttggctatttgagaggcagtttgcagacatacagcacacagtttcataccgtgtgcgtgcctagttggcaactggatcctagtagatgcaaattttgaaacattcaacccaacccaatccttcttctcttaatcttctcttcctacacttgtgtttgtgtgtgtgtgtctaagaggctagtagtagagtagctagcctaaaattttttgcacgttgcagctactaactgtgctgctggcttgtcgtcctctgcttcaacattaaagagaaagctaatagatcggtgattcactttggtttctttgatgctatccagccacgtcaccatgtatgcgaattttgtggatggagtcagaggctctgcatgcacggagctgatttaattaattaacttgttgccagctagtacctaattaagcatgtgtgttaatttattattaattactttgctagtgttaatttatccttagtttttttattccaaactactagcatgcatgcctttgtcagagagagaaaccgatggaatatcctcgtttcaaaagtccatgcataatgtgcatgctgtgtggattcgtgctgtattttcctgggtagataagaccaaaaaatcccacttaccaactaggttttttaaaagtctggtacatcgtgaaccatactgcttcacgtggtcggaactatatacgttaagatcaaatgtgctcaacgtggtctggcacatcatggaccatgctgtttcatgtggtcggatctagatgcattaggaataatccttttcgtagtagtgaaactaaagaacttcacttgcgaactacttcctccgttttacaatgtaagtctttctagcatttctcacattcatattgtttctaatgaatctagatagatatatatgtttaaattcattagcatcaatatgaatatgggaaatgctagaatgacttacattgtcaaacggagggagtagtttttgtagagactgaacaaagatgaaactttttggaaaggtgctcctgatgaccaagttcaattcaccaactgaaatcgcacactggatttacatgaaaaatgcgagatagacaaaaatgatttctttcggttttaaattaatactcccggccatttgggaggagcaatatgtacatatgcattcatcacacttcaggttttttgtcttttttttccttggagttgtaagaatgctcataattagggcatgcaagttgatccattgatatattcgcaatatttgacgatttttttttcattttaaaaattgttgacgatattagcttaattttggtatggaaaatatcggttaatttatctccaatttttatcaagagagaaaatgaaccatgagagttgaggtgcgaattaaccacaagcaaatattcattttaatttgtggtatatatatatacacgagcatgcatgtaaagatggaaatatgtgaaaaatacaatggtgctagtagatttgtctaaaacacttccataatactatgatcaggacactcgataaggacaaagttaaattttagggattgtgtcattatcaaaattatcaatgaataattggccagagggccgggattagcatgggtctactactgtcctgccatttcattaattaattagattaagtccccgattgcttgcatccctaattggcctacgagaaccgacaaaaatcgcaagatgggaggattgtggtaggttatcttctccaactgtgcctctcaagtggccataacatattagccagaaggataaataatcatcaatctgccttcacagttttgatcatctcatgagacatatatataaaccacccattagcaagagtctcctaggtgaattaattaactatactgatacacatatacttaattggtataagaaaattagtggtagttaattagtataaaagcatcaatcaaatggagactattagctagctaggagaccgggcaatttttgcaaagcattgatcttgactaggaatcgtgcacgtacaaggcacgtataaaaaaaataagtataaaatgtaaactacatataaaaattaggaagtgtgataaaatgtcataactgcataatttaccaacgtaacagccaaaaaaattaaaattatctcagtgcaccaataacataaacaaaccaaactttggtagatatatattaaaaaattgaggcacatcacagattgaaattagtcaacaagttcagggaatgaactcagaaatgaaccggtaccacctagaatattaagttcaggtacatccccggataagatcagaaaatactatagcaaatgttccaaattttgtttctgaattctccttaatccacatgaattgtccttaatacaatccaggataagatcagaaaacaagacctctcttacaagcaataacgcatatattatttgtcaagacaaagccaagtgcataatccacatcaggttatcctctagatgatactccagccatgctccctggtcctccaaaaacaaccaggttcaatagtccaatgcataatgtaaataacagggccggcagaagaatctgaacatggtaatcttaaagcgaccttatataatctccacaaataatattggaaattatttgaaatactatcaagtgacaggagcaaggttacaacattattagcaagtgacaggtgcaagactaaaacattagatcagtgaacctgaagtaagacaaacaattgttgattaaaaataaataacacttgttgacaaacacaaaatggcattttattcttgcacgaagaccatgtctaagccttgatatatgcattatgccttcatgatctttaaagtcaatagatacctgcataaagcatcaactaagaaaatacattgtttttgttccaaaaaaactgataaataacaaaaatggcatgataaaaggaacaccttaatggatacttttgttaaaaaagatagtgaaattcttgattattcaacgccggatcgaatcatgtccaatggtcattggaattttgtctatccttctattcttcaaaataattcagatttgttagccaaaatgcgaagaaataggtttgccattccattacagtatcatcaagaacaagcgaaagaaccaatatcctgttttgggatttcgattgaaataccctttatgggtgttttacgtagaaatactatagttgcttattttgacaacccacgatacaaaaagagataaaaaggttttgagaattgttaaatttagatataggaccacataagcaacacaattaatttaaatacagaacatatggacatacttctctctttgctgccctgtgtttgtagatggttcaactatcaacataggatgctcctcagcataaaagctaataaagcaaaaaaattcagtagttgcatctccatgccatacaaaggaaatcctactatttaatcaactttatccggttgtacacataagaagggatttcactatcagtatatttgaagagcataaataaatatgtaaggtgaaaagatggtgggcataaagcagtaaccatgctgacatccaaaagattccatagaggcatagaagattaactttgttgctgattctaaagaaactatgttaaagatagagtttggttcatcccaaacttccccagaaacaagttaggcacgttcggccttttgcggcaacgggcaagtgtttggccaaccacataagcagtgtgccaaacctggttactccagtgcctctcatgtcatagatttatttttcagacaagttttgccacaagtgtggccagctttttgggcgtgcacttttggcacaaaattactcagatctgcatcaaatagataaagcaactcacctgaaagcatgattccatatattgtcaacaatatcccaatcaataaatgttccatctttcattggtgaaatcacctattgggcatggaagaaaatcagtgataaacaatagttaacaaaatcatgagcatcaatattgatattttagaatgttgataaactaacctccatatgatccctcctaaatagaataaaaacaccttttagtacatacactacaatagagtattatcacaggccaaatataaattgtctccaggtaaaataaaggtagcaagcaaagcaaaattcagacaaaaaataatagtacatgttattgcagaaatttgtagtgtagagcttcgttgattatccattgaaagtattcagaaagcacggctatgttgtggaccactattatggtagagaactgcaaatgcaagacactcttatgcatcagttcagaatcctcttatgccatggacgcccatcgtagacagccagagccagccagcaacccactcagccatggacgccatggacaaagcaatcaaagcaaccataaaaccaagaaaagaaaaatcaccggttgccgaggagagcctggaggtggacgatgagcttctcctcctgctcagtgaagttcccccgcttgatccccggctggaggtagttcgtccaccggagcgggcagctcttgctgcaacgcatcacccctgcacacacgcacagatcaaacatgcaaaaatctcagatctcgcaacccaacgcagatcgatcgatcaagaacacacaagaacacgtaccggtgttggtcggcacggcacgccagttgccggcgccg

SEQ ID NO: 43729 - DNA, 1454 bp, Oryza sativa
ttcctaatcacaatataatcattaggtagcaatctattctcgaattcatacaaagaagaacataggaacgagctcacctctaaattcaattgtcgcgcacgagctcttgttatcggtccttgaatgaccgttggaggattgctgtgtgtatccgaggtagtgatgtccgcatcatcctccccctcttgaattgaagtcgtccttgactcaagctcatccttttctcccaagtatggcttcaaatctgaaatgttaaacgtgggactaaccccaaactcaggaggcaactcaagtttatatgcattatcattaatcttctcaacaattttaaaagggccatcaacacgaggcatcaacttagactttctcaattctggaaatctatccttccgcaagtgcaaccatactaaatcacccggttcaaacttaacctcttgcctacctttacttccagcaattctatacttttcagtcatcttttcaatattgaacttggttgactcatgcattttcaaaataaattcagcgcgtgccttagcatcattatgaatcctctcactagtaggtaaaggcaaaatatcaattggagcacgagggttgaaaccatacactacctgaaaaggacttaccttggtagtagaatgtgttgcccgattgtatgcaaactccacatgaggcaaacattctctccacatcttcaaatttttcttcaaaatagccctcaacatggtatccaaagtgcggctgactatcttcgtttgtccatctgtttgtgggtgacatgttgtagaaaacaatagctttgtacccaacttgttccatagtgtgcaccagaaatgacttaagaattttgcatcacgatctgaaacaatagtacaaggcataccatgcaagcgaacattctcatggaaaaatagatcagcaatatgaacagcatcatcacttttatgacatggtatgaaatgtgccatcttagaaaaacgatccccccccccgaaaatactatccctccccttcttagttctaggcaatcccaaaacaaagtccatagaaatatctgcccaaggaatagaaggtacaggaagaggcatatacaaaccatgtggattcaaacgagacttagctttctgacaagtggtgcaacgtgccacgaacctctcaacatcctttctcatccttggccaaaagaaatgcatggccaaaacatcttccgtcttcttagctccaaaatgtcccatcaaccctcctccatgcgcttcctgtatcaacaaaagacgaacggaaccaactggaatgcatagacggttagctctataaacaaatccaccattgagcacaaatttgttccaagtacgtccctctttgcaatttatcatcacttcattaaaatcaggatcaagcgcatattgttctttaattaattcaaggccaaaaatccgacaatcaagtgggga

SEQ ID NO: 43730 - DNA, 6914 bp, Oryza sativa
  unsure (1)..(6914): unsure at all n locations
nnnnnnnnnnnnnnnnnnnnnnnnnnnnnnnnnnnnnnnnnnnnnnnnnnnnnnnaaagctattgtttctattcaactattgcatttattttcgaatgtcattgggtggaattaacctattatttgttatggcccttttgttcttgattactttattctttgataccttgggttaatgtaatttgactagttgagctttatatgatggttcagctagatgttaggcataattgcttagccatgcttagaaacattagcacactactgggataacttatgcttcactattatttaatgatggtttaataatagctcatgatggttaatcatgattggtttattaattaatttgccaactaaaacttgataatggtgggttgtgagcacatggttttgatggtcgtgctcatgacaattatggaccggttcacgagtttcggttgtgaaacatttaccgtgccaaccacaagccagcgtgggcaacggctttactttctgtatagtatggttcattgtagagcaccagactgtgaagtggcggagataagcccacgggggtcatcttcggccattaattaattgggaaaggttcaccacccgatgatattcgaaaataatacatagttgaaataaaaataatagctttaaacgggttcaacatgctcaaagggttgtttgggatctgtatgacttgccttgggcttccacaaatgtttcggaaccttactcaacggaaacactctatccggaacgtcggaaactaaagcaattaaacaaaaattaacaaaacagtacaaaaacaagcataaacagtacatgtgaatatttttaacatgtagatctcaattttagaaaaatttagcacttgaaccacctgaaacggatctacggttatttagttatgattttccgaagatttaatctattagaaaaaaaactggaaaaagggaaaaccgatgatgacgtcatgatgacatcatcaatggccggcccgggttggcgacctcgccggagatagggcggtcggccggaactttggaggacacgtacacgtggagaacgacgaaacgaacccaacggtactcaccctcgagccaaacgacgaacgacgagggccggcgacgaaggggcggcggcggcggctcggcttgcacggggcggcggagctccggtgaccggcgacggaaaaggaagggtggccgagcttcccctcaccacggcgcacccaacggtggtgacggcgaccggcgacgacgatggagacggcggcgcggcggcaccggagatggccggcggcggcggcttgctaggcggcggtggcgacggagctacggagcacgggaaggcttgggaaaaggggcaaacgaaagaggggaactagggggtcctatttatagccttggattgaagagatcggactcctcccgcaagaaatcgactcgggaaatcaaaaactcggttttagagataaactcgaaaacgagttcgattcggataaaatacccaacgatttgctccgatttttgagggtaaagatagaggaagatgtggggataaaaacccctcaattaatcggactcgagggcgaccggaagaggcgaaattggcggagagaggcggcagctcgggctcggctaggcggccggccggctggaggttagggatgaccccgacatgtgggccccacatgtcggtggctaaaggaggagggggcggggcggctcggctgggccgacttgggccggcttggccacgcgcgggaagagaagagttgggccggaaacggcccaacaactttagggaggggttttggaactttttaattaaaataatttgttaaatgttgttccaattattaaaaaaaaacttcctttgctcaaacaattcccagaaaaatctagaaaatagaggaacaagcaaagtatttaataaaattttatctagaccatttttatgttgaaaattttcctagattattagagtttaacttgtaggcttttaaaataaattctaataattccaattaaacaacaatttatatatttaggatttttagggcgtgacaaacctaccccccttaaacggaatctcgtcctcgagattcggaagaactggcgaacagatgaggatgagctgacttcaattcatcttctcgctcccaagtggcttcttcttctgaatgattgctccactgaattcttctgaataatccacgcacattctctgagtatgatctttcttctccacaaagatgactggtgctccccatggcgaagtactgggtctgatgtatcctttctgaagaaaatcacccacctgtctcttcacctcagctaactcattagctgccattctgtatggtctcttatggatagggttggttccaggtaccaagtatatccgaaactctatgtctctcttaggtggcatacctggcaaatcctcgggaaacacgtctgggtagtcttgtactatggggatctcttgtagagcaacttggtttaagatcacaccatgatatttaggagaggacacaaagaaagaaacggtttccccattgctactggttaaagtcaccttacggttggcacaatctataactcctctgtgacgagataaccagtccatccctaagataacatctagatctttggattctagcaagataagtgaggatgggaaaggaacttcttctatttctatagtagcggaaggacaatactgtgtcgaagatacttgattgcctggggtattaactagtaaaggtctcccaagactaataacttccatctcatgattgctcgcaaaacttttagacaaaaaggaatgtgtagcaccggaatcaaaaagcacagatgcgggtatagagttaacaggaaacgtacccaaaaccacatctggtgcattctgagcttctgctgctgcaacatgattaacacgtgccttcggtgctggagcattggagttgttcggggctggagcgttcttcacgcgccgaggcttaagacacttatcagcataatgtcctggatcaccacaattgaagcacacccctggcttgcttccctgttccttcctgacgggctggttctgagctggagttgctgcaggacgagcaaccatgttgcggttgtcattgccacgattaccagtattgttgttgtagaactggcgttgggggcggacaactgatgaagatcctccttgagggtacgatggagcttgaggttccgtaacgagacgcggcctctggttactgccctgttgtgccttgaattgggcagccctgcgcttcttctgctccatccggttatacttgtcttcctgacgaatcgccttgtccaccaactgctggaaatcccggaaatccgtagacatcaaggcataagacaactcatcattcagtccctccaagaacttctcctaacgctcttcatcggtgcgaacatcttccggagcataacgagctaaacggttgaaatcatggaggtactcggtgaccgaacgagatccctggttgagtgctctgaattctctcttctttagagctacaacacccgttggtatgtgtgtcttcttgaaagcggccgtgaattcctgccaagtaataggctctccttcagccctgccttggcgaaaatgatcccaccattcagcagcaggaccatgcaattgatgcgaagcaaaagaaactttctcctgctcagtacactggatcaaatccaacttcttctccaccgcatgcagccaatctcctgcttctactggattggtggtgcttgaaaaaggtagggggtctcacacgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagcagctccacttccacttccacttccacttccagttcgcgtgttcaccatctgacgataagcagagacaacaggaaagaacgacaaagagacacccttagaacggagttatttaattaatttaaattctatattgctcttaactgtgtatgattacatttaaattgcattaacactatctcaccaactatcttacactctgacaagcaaaagagctagactcatgctgttacatcccaccaatgatgtaagcaacaactaaaacccacacactcacaagcaaacttaaacaagcaatctaacacagcgaactacggcaacgatctaactaagcgactaatcccgccttgcgtcggaacgaagcgatggatcttcttcctctggagtagctggctctctttcttcagggtcttcctcttcctcctcatcacttacgatgtcgatgacaagttcagcacgatcgggcacaacttcacccatcacgcgaatctttgaagctaactggagacgaggtggcggacaggttctctttcttgcggtgaggagaagcttgggtgttggcagcggcgtttctcctttaagttcagctaattccttctgtagatggtacaccttgctctccaacttgcaaatcttgcctcgattccaattttccctgtcatgagctgctttgtctcgctccacacttactgcatccatagcactaagcatatgcaccgcatgcatcagagtggcactctcttcaccatcaggacaggtataggttccatagtcttgaccacgaggcttgtgaggatgatactggaaagctgatgaatccaactcttcttcaaagcgttgacgcaactctccaatggccaccaaagctgcttcttgacaagcatggttgtacgatcttcctctagtttcgaacttaatggacggaaggtcttcacgatcactagccaacgtcacacgaacacgacacttctcctcgttggggtcatgggaaatccggcgatactcaggagcaacttcatagcctacctcaaaagccatcaacctcagctccctgacgaatcctaacaccttgatcaaatttctcggtgaatggggcggcatctaaagaaacatagaagagaggaattaatgcatttttttttaagttagctgcaccatctagacttaactgatttgaccaaagaggaagaaaaataaaagaaaagacacatacttaagctattatacatatatttttagaatttaactttttggacagagacaaataatttttttttgacaaataactaaaataaaactaaaatacttatgatctattatatgcacggtacagtgtcaccataagaaggatgagtagtactagtgctatcatgattgtatcgataccataatagatgtacagtgccgactaatcaatgaagtttactaaggcggaataggaaacattttgagaagaacaatttttttttcttttaaaagaaaagaaaatgaattaatttaattttgtgcataaccttgcatgtgctgccaacttaattaatttataagagaatagagaagagcagttctatttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaataacaaaattgataatagagtacaaataattaactatttaatattcgcaaataataaattgctacagaggtagatagttcctctcaaaaaaataaccttctacgcagcggaaaaaaactaactataacaaactacggaacagctatggcgactccactccacaggcatcttaaccagaacaagctcaatccttcagatcatcaccttcgctgaaatactcctcttctgatgattgaatattgcaagaatgagcatatgacatactcaacaagccacacagcaaatatgcaagtgcacaggataacaaaggatggcataatatagtttcatttgcaaaaacagcatttagcaaacatttgagaatttaataaaacagttaagtaataaacaatattaatccaacgctatacaacataccctgttgtataggcccaaccattcagaacaaccatcccgggtgcacagttctatctccaaaccaggaatataccattccaaaccaggagctaatcaaattattaccaattaaagcatcatttactatggtgagaaaggtgagactaatcacgaaaaacattgctcaactcacccataaccgcgggtacggctattcgaatagattaaactctgatcagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcacccccttataaacaaggcatggactacccagcgacccccgtggacttctcgccacttcacagtctggcgcactatattgaatcatgctatacaaaagataaagccgttgcccacgctagcttgtggttggcacgataaatgtttcacaacagtagctcgcgaaccggtccttaattgtcatgagcacaaccatcaaaaccatatgctcacaacccaccttaaccaggttttaattatcaattaattaacatcacacgattaaccatcgtgagctaccatttaatgtaaccataattaaaataataaagtaacatagtttataattaatccctttagttagctaatgtttctaagcatggctaagcaaacctacataaagcatttagctgaaccaatccaacatataaggttcatgctaatcaaattataacccataggaaaataa

SEQ ID NO: 43731 - DNA, 1920 bp, Oryza sativa
atgaggacccaactgctgtgaagcataagaaaccactttgccatcttgcatcaacacacatcctagcccctggcgagatgcatcacaataaacctggaaatcttttgtctgatcaggcagaattaaaactggtgtggacaccaaccgtcgtttgagttctttgaaactcctgttgcattcagcagaccagataaacttttcttccttcttcaagagctgtgtcattggcttggcaattttagagaagttctcaatgaaccggcggtaatagcccgcgagtcctaagaaactccgaacctgagtgactgtccttggtggggtccatttggtgactaactccacatttgttggatccatagctactccttgagcattcacgatgtgaccgagaaactgaacttccttaagccagaggtcacaattgccgaacttggcatatagctggtgctctcttaacttttcaagtaccaactgaagatgctgctcatgttcttcctcggacttggagtagataagtatgtcatcgatcaaaaccactacaaacttgtctagaaattccataaacaccttgttcatcaaattcatgaagaaggcaggtgcattagtgagtccgaaagacataactgtgcattcgaacaacccataccgagtgatgaatgttgtctttggaatatcctcttcacggatactcaactggtgatagcctgatcgcaggtctatcttagagaaaacagtagctcctttcaactgatcaaacagatcatcaattcttggcaacggatacttgttcttaatagtgacctcattgagtgcgcggtagtcgacgcacatccttttcgttttatctttcttttccacaaaaataactggagcaccccatggcgacgtgctcgggcggatgtatcccttctgtaactgttcatcaacttgcttcttgacttccgccaactcgttggctcccattctgtaaggcctcttgtggatcggtgcagttctaggtaccaagtcaatccggaactcgatattccgttttggtggcattgttgtcagatcgtccggaaaaacctctggatattctctgactatgggaatatcctccaacttcttagtggttttatccactactacctcttgttcttcactagtagcctggttcagactgatccctggcttctgcggtactggagacgggaaggttaccacttctcctttcgcattggtcaacttgatggtgcggctagcgcaatcaatcactcctctgtgccttgtcagccaatccattcccagaataacatctagatccttggattcaagaaaaatgaggttggctggaaaaatcaacccttggatttcaactgtcactgacgggcaatagtgagttgtggtcatgccacctccaggagtatgaactcgcataggtatcttaagcttcactaaagataacccatgtgcaccagcaaaacgcttggaaatgaaggaatgagttgcaccagagtcaaacaatattactgccggtgtcgagttgataggaaatgtgcccaatataacctctggtgctgactgcgcctcctctgcatacgcatgattgacactttccaaccgtgtgtccgggtttgttacaattgaagcagagtttgggctttcctccaaacctctggggctgttctggctgagctggcagagctgactgaactgactgatctggaatcattagtcgacttagagtaaggttgaggctgtgctgcttactgttactgtgcctgccactgttgttgatgccgttgaaattacccgggtggtacggacgatgttgccagataatcatggtggaaggtgcaccctgacatcccatcgtgaagcgaggcttctgacttttcccctgggaagtcttgaactgacctttttttacggttcattttg

SEQ ID NO: 43732 - DNA, 1225 bp, Oryza sativa
gggttggtggtacttgagaaaatgggcggcttgactcagagaaattctaacagtttggactgtggaggtggaggaccaaactgcaggttctgctgctgctgctgtgcttgctgatgcacctgctacaacacctgatggtgctgtcgctgcatctgttgcatcatcattgtcatcatctgagtctgattgtccaacacctgagcaatcgttgggttctcgggcggtggagatgaactgctgctagatgcatcgcttgcacgtgctccactgatctgctcttcgctgccactggcgttgttggattcccgggaaccattccttgtcttcaccatctgaagggggataggtagaaatatgagaaaaggaagaaaaacagggggctcagaatctaatctttcttataaatttaggtacaattatcttaattttgattaaaacaccgaaaaggaagcaaacaactcctaattaaggcagccataccactcacacatgatatcgaccgccgactaacccacaagcagcagacctaaacacagaaactagcaaacaacaaactaagaaagacgataaagctaagggcggcgactctgaagctcggagcggcgcttgcgatcggagaacaggtctgacatctaaagatggacaagggataggaaccaattcatgctcaaatccaaattaaacaaagcaacaaatgactcaaataaataacctagcatggctgatttttatgcatagaacatttttcgtgaactcaaatgaagatactgatgcaactggctaatcaataaattaatgcataaaatagatgcatagctataatgatacgcataaaattgccccatcgaacagagacacgacttagtgcatatcacccgttagatttccgactgactgtcgaataaacctcaaataaaattttactaaaaccctagactgagctaattttaaagatccgatccgaatgaactaccaagatttttcccgcaaaccaaagaggcaaaaccccaaattttcccgaaacaaatccaggtgcaaaaggcatatgcagatgaaaagcggttcagagggctcttaggtttccagttggcttgtcctacggtcaaggctggctctgttaccaacttgtcacgcccagaaattcacgaaccagaatttctaagaatttttcctgggattaaatattgcactttggtgatttttaattggttaaaattatttccaa

SEQ ID NO: 43733 - DNA, 1462 bp, Oryza sativa
aaaagggctagggtttaaggtataacctatatcttagggattatggggcttgtatttgctagtggtaggtttaggtggtataatacctagggtttagttatatgggagtcgattgtggagtaggatagcatataggttaggctctatattttatgtggaggttctagaggattggaggctagaggggattaagcaattattgtcgcttatattttatgtgaaggctctcgtggtttggatgataggaaatatgctggatagttgatatggttaaataggcatgtggctaatatgggtcaaggttgtacttttgtagaatagtggctagggtttagttgtttaggccgatatcaaggtaggataaatatcggctagggttttgggtgttcgctagtcgtcgctagagttggacggcatgacgactagatttggtatcatttctagccatgtcgatagacagcatatcagctagaagaataggaggtgggtgcaggtttagtggggcggaagtgttactccgacaaccgtgagtggcggcggagcggctaggatcacacagagctcaagagctaactgtgcggcgtgcaatggaggtcgaggggatagtgaagctccgaccgatgtacgcatcaaggcgtggggtgccaggagcagcacttcgaccttgggtttggtttatgccgggctttacaaccaacggtccgacgttgaggtccgtagaccgtgaacgtccccatggaaggcgtaaagttccaaccggcggctttttagtggctaaagggtattttggaaataaaagaaaatatttgaaaagcaaatataagtttaaattgtaaattcaattataagattaaatcaaatatttattcaaatggtatttgaataaattaaagaaattcaaataaaatcttaaaatagcaaatttgatatcaaaatgaagagtttgaatttagatgaatttaggtccaaatttcactggaatcggatctacggtttaggagatatgggcttctaaagattgggatttgaattaaatctagaaaatacgaaaaggtactatttatgggcccacctgtcaagacctgcccttcttctcttcttcttttgttcttcttcttcttcttgccggcaacagaaaggaaggagggaggtggggcgccagtgctccagtggccaaagtgtggcgacgttagcggtatatcgtgttcccgggcgacgcgcacttggggattgcggtacctagccaagggaaagaaggagatggccggaacggcggcgacgagagctcaactccggcgataagaaaaagtggtggtggcggtttatcttaagatggagggagaggggaaaggggaaaaatggaatcacctccgtgaggcggaattggtggcgcaagggtttggctttgcaagctccggtgagggaaattggccaatggcaaccatgggccggacatgggaga

SEQ ID NO: 43734 - DNA, 2780 bp, Oryza sativa
agccaaaagaagacttttaaaaccttttttcaatttaaattattcatgaaatgcaattccatttattaaaataacttccatggctcaaataaatcccagaaaaacctaggaactatagaatcaagtgaagtatttaataaaattttatctagcccacttttatattggaatttattatttaaaattagatcttttcttctaggcttttaaaatcatttctaataattccaattaaacaacaatttatatatttagggatttttagggtgtgatagatgctagggtcaatcgtcactgtgaaagggggttgcccatcaaaccatgtcctctactccgatgatttttctttttcttgggagaaccatgtggcgcttcggctcgtcaggccctttgcccttttttcctttactagatatgtcgttgacgcaaaaaacttccgttacatcattgacagggacaaacggttcgtccgagtatccaaccttgttaaggttaaccgttgtcatcccactgtcatcaatcgttacgcctccaccagtcaacctaacccattggcaccggaacagaggtaccttgagaggtccatagtcaagttcccatatgtcctcgatggcaccgtaataggtgccagttgtaccatcgtgtcccatggcatcgatacgaacagcaccgttctggttcgtgctcttcatgtcttgggctctcgtgtagaatgtgtacccattgatttcatatccctagaatgttgcgatcgagccagatggtcccctcgccaggaaggccagttgttggttaatcgtctcgttacccatgagatgttgtcgcagccacgcggagaaagtatcaatgtgatgccgtgtaatccatgcatcggatttaccgatgtttctggcgcgaactagagccaagtgctccttgatgtagggagccaccaatgaagattgttgcagaaccgtgaaatgggctttacggaataaattgttgtctaccatcattattgctttccttctgagagtcccctttccccgtagtctcccttcatggcgtgattcaggtatcccgattgggcgaaggtcttcgataaattctacgcagaattcaatgacctcctatgttccataccccttggcgatgcttgtctctggacgagcacggttacgaacatacttcttcagaacgcccatgtacctctcgaaaggaaacatgttgtgtaggtacacaggcccgagaataccaatctctttgacaaggtgacaaagcagatgcgtcattatattgagaaatgaaggtggaaatatcaactcaaagctgacaaggacattgcaccatattattctgaagggcttctaatctatgcggatcgatgaccttctgcaaaattgcgttcatgaaagcacatagatttgttattgttgaccggacattgtctggaaggaaaccccttattataactggtagcagctgtgtcatcaacacgtgacagtcatgagactttaggtttgtgaacttcttctccttcgtgcttattattcgctttatattcgtggagtatcctgatggtaccttgatgctttccaagcattcaaacatactgtttacacccaaatttggcatctgtggacgaaatagggaaaaattgccaaagtttggaaagtaacgggtttccttactcgggaaggcaggtttagtgtttcctttggtttctatcccgagttggatgtggagaagggcctatagagggtaagaccaacccctatataagggacaaggccggttcattgtaaaacccccgaatacaatctacttgaatcgttcttttactatgtcttctattttaccctagtttagtccatctttgtcggtttgcgccgtaaaccgtccgccgccgctacgagagtgcgacacctctttgtatgtttgtcctgaaaaccttccgttttgcccacgagacgggtagttatcctcatatcgatctaaatcggcctagaggctgattttgatctctaaatcggctccgctagccggtttaggttttgtttctacaaaacccatcttgatttggccctttggctagatcgaggtggttggcgactccatatcaccgcaaggcgtttaggtgttgcgatcgtgcttgtcaacttgtcaaaaaagttgccaacacatactttccttctctgccttgctaagagtgtagctggctggactcaaataatgtcttcgtttctcctttggtttcgggtgaaggtcgccgcgttgttccatatgcttcagatcattacgtgcttccagtgtatctttcgactttccatatacacatcggaagccaagaaggtttacgcaaaggttcttagtgaggtgcatcacgtcgattgcgtggtggacgtccaagaattcccaatagggtaactcccaaaatatggagtttttttttccacatcgccacgtgaccatcttcgctctctataggctagctgccaggcccctttccaaacacaactttaagatatttcaccatatcaaacattgttttaccgctgtgatgttttggcttcgtacggtggtccgccgtatgttcaaagtgcttgcctttcttccgtactgggtggtttgctgcaaggaatcgacgatgactcatgtacacaaccttccgatagtgcttaagatacgtactttctgtttcatccatacagtgagtgcaagccttgtaccccttgttggactgcccgaataggttgctaagtgcaggccaatcgttgatagttacgaacagcagcacttgt

SEQ ID NO: 43735 - DNA, 3051 bp, Oryza sativa
catcacctgttaatactgttagtcatactactccacatatccctaatgcttacaatgattctaatagaagatattctcctgatactaggtatggccaatataacaatattgcgccacaaacacaacctattaggccaccaagtccaccaccagatccaccaaggcctgaaactgtggagaattggtttagaaatattatcagggagaatttagcaaagctaaggaatcgctctagggactaccgaaagccgtatcctgattattatgacattttcccatatcctcgtgattataaaattcctgaatttaccaagtttagtggtgaggatagtaggactacatgcgagcatgtagatcaattcttagcacaatgtggtaggttaaaagtgatatttttaaattgcgcttgttttctttatctttgtccggtactgcttttacatggtttacttctttaccggcaaattctattgatacttgggctcaattagaacaaaaatttcatgattattttcacactaataaaactgagcttaagttatctgatttaacatcggttaggcatgaatacaatgaatctgttgctgattatattgaaaggtttagagatgttaaaagccgatgttttagtttgaaaataactgataaagatttggccaacattgcatatgatggattgcttgattctattaaagagaaattgaatggccagatatttcttgatattgatcatgtgttgcatgaagctctggctcaggaaagccgagtggatggcaatagcttacaagctagtttagatgaaaatgcaatatcatgtatagccgaaccaagcgatggttcggattgtgttaatgatttgtgcaatgatgcaacaaccattatagccgaaccaagcgacggttcggattgtgttacttgtttagacaccgatggaatagccgaaccaagtaatggtttagattgtgttgctagcttagagagtaacatcattgaaaatatagccgaactaagtgacggttcggattgtattacaagcggaagtgaaatagcattgtcacctaagaccgaatcacaaatcggtcatgtggatattggaaaagataatgacaatgtcttgtgggatagtggtgaaatagaatccaaagtagctatgcatacatatcaaaggccgtatcctgaacatgtagattcggtcccatacccgcaaggatttgaggtgcccaacttcacgaaattcacaggtgagaatgctatgactacaatggagcatatcggccgctttattgattaatgtggtaaagccggtagcgatgatttgcttaagttgaagttgtttcccctttctttgtcaaactttgcatctacatggtatagtttacttgctcctaattcaatttctacatggtcacaaatggagcatgagtttcatgattatttcaaagatgcaagcttgatggagcaaagaccgattgatacttcatcggtcacttgtgaaacgatttcggttacatctatgtctaagatcggaattgttagtaatcctctccctattagtcctattgatgttaacaaaaagaaagggaaaagtgttattattggggatcctcggcccaagactaggatcaataatgcgaaggccgaagatcataaagttgcaaaggatgagtcatctagtttgcaaaggaccaaaaagccgaagctcacttttgagatgcttatggctaagtacgagaaaggattagcgggtcaacgatttgataatcaaactagtgattcaaaaataccaagatcatctcgtaggaagagatttggtcaaacaccaaagcaattggagccatcaactataccaactccatgcaaacctccgattgtgatgccatggtatccatatccaatgtcactatatggttatccttttatgtattatatgccatggatgcctcaaccacctatgctgtgtcatcaaggatggaagcaatcacctaggacggtaccaagtcattctaactcaagacaagaccgtttcccacgaaagaatcggtccggtggatcaaaggtgaaaaaggtgaagaaggtgtgggtgagaaaagaagacaaagctccggaggtcgttgctatcaaggagaaatctcaggatattcaagtacctactgaagatgcggcgaaaactatacaagcggagaagactgaagccgacgccgttgctgtcgacattggcagtctgaccgagccagccggccggtctaaccgccagactacggccggtctgaccgacccttctagccggtctgaccgacggcttgtggccggtctgatcgggcccaaaggccggtttgaccgggcggcattggataagagtgggaaaattgagagcaacataggagcttccacttcgaccaaaaatatgaagaataattgcttagctcctggaaaacaactacagccgaagtggataccttctggcttatctcgctctcaaaagaggaggctacaacgtcttcgggccataggtaagaaagaaaaggaggccgaagatgtggagaacaagacatgcaataatttagagtctcgaacagcacctagacaagtgtggagacccaaagaggtaaaagttaagagaccggtgatttcccatagaagtaacaaatccaatttgatgagagaagaatcatcggtcattagagataagtctccttcacatgatgctatgggtgttagtgcggtattcgtcttgccttcgaaatcgcacaatctagaaagccgattttgcttggggggcaagacatcaatatgctcatgagggaaccaagggaagatgaacggcgatggatacaacatcacatctttgaaccgccgtttgttggatgctaaggcaaggtatgagtttattgtgtttaacattatattatatgcatatgccatgttattagaacattgcttgctatctagcacatgtgtgtttttgcttatcaaattgatattatacatacatgttgcaaatgccaattctaggtagtagaattggtaggttggcatataatttgtttgaag

SEQ ID NO: 43736 - DNA, 1603 bp, Oryza sativa
catgtgacacatatgactttgatgatttattattgatcatacttcaattggctaagtgttgtgatgccatgatgattattttttcaaaagccaattgaattagtattcatctagacatattagttggatattatgatttttcatatgtctagaaaggagttttggttcaataatttgatataccaagcatctggctattatgtgaagaaaaatttatatactaaaagccgatgcttgatttcaaaagtttggacgaaattggcaaagtcatagaccaggggcggtctgactagcattgcacggccggtctgaccggtggtagccagcggtctgaccggctctgcatggccggtctgacagggcagacagggtggtctgaccggcattgcgtggccggtctgaccgatctcgggcagagagctgggggcacgttacaattgattaaaaggccaaattaattatgaattcggacatttgtgctcatgagttagaaatagcttggagaattcctttgattaaatatttgaaagatcctacacttaaggttgatcggaagattcggcggcaagtgctcaaatattatatcgccgaaaaatagatatagtattacttagataatgatcaatctaaagttgctaggagagtagtacatgaagggatttgtgaaattcatcaatatgcccgtaagataaattggttgcttaggagagtggggttttattggctgaaaataattgatgattgtttcaaatgctatagagagattgaagcttgttaacggatcggcaatgttcaaactagcgcctatcgctatattgaatactatcatcaaaccatggccgttccaaggttgggctttggatttcattggtcaaatttatccttcatcatcaaaagggcattggttcgtgctagttgcaatggattacttcactaagtgagtcgaagccgtgccactcgagaatattacttgtacggagataattgactttattttgaagcatattgttcatagattcggtattcctcaaacgttaaaggagcttcttttatgtccaaagaagtgagaagttttgccgaatcttatgatattaagttgttgagttcttctctttactacgctcaggctaatggataagccgagtcgagtaataaaacattgttgaaattgccgttttgccagttgaggtaaatcttggctctcttcggtatttcaagcaaggcgacttgtcggttgaagattacaagaccttgatgggaagtaatttttgaagatgtcatcgacgagcgtttgaagactttgagggagatgaagacacttcaagacggtgttttcagagatcaattaatgggaaatacttgaagaaatacttctcgagcacttggcaagatgcttaggaagtcctatggccggtaattggattatcgccctgagataacatgttctatgctttcaggttcacgtctgttcaccaaaaaagcaggggggcatgtgtttacacccaaatttggcatctatggacgaaatagggaaaaattgccaaagtttggaaagtgacgggtttccttactcgggaaggcaggtttggtgtttcctttggtt

SEQ ID NO: 43737 - DNA, 2143 bp, Oryza sativa
gaacccaaaacctccgtgcttccatggagagcctcaaccactagtctatgcggcttgctgtgaaaccaatataacaaacatctatttgaacctgtttaaaccggcggtttgaccggtccgaccaataaacgaatgacccgagtgccttaccggtttgatcacctgtccggtcttaataactatggcccaaagtgaaggaggggagatttaattgtttttctttttattaaattggttaaatgatctttgtgactttaaaattactacttgagctccgaaaattcacagaaaaattcggagagtattttaggacacaaagaatattataaaatattcccggccaatgatttttaaaggaattttttaatttccccattatttcacttgattaacttgatttaatttttattttatttctagaaaatacattattaattgatttttaatcccaaacgaaaatcggggcgttacaaatctaccccccttacaggaatcttgtcccgagattctgggatggctagaaagaaagctggtgtgaggcggtctgactgatctgcttgatctgcacactgcattgttcctttctgtttcgaactgactgattgtccgattgaccaaacctgcatgactgaactggctggatttgactttttgttccttagctttgcaaaaactggaccgattggttatgcttgaactgacccagacaaggactgcagatgctcatggaacttacatatcttagactgaactgttatgctggcaattttggtaacctgacaatttgtaactcattgaccctacgtccgcttgaactggacctgactcgaatgacgagtaattccaggaaacctgcttgacctgtctttcgtctaaactgtaaccgtccctaatgttgcttctctaggccgaactgttgacctgcttcacgagtgtaacttagaattgaatctgtcgacttgagattggggtaactctgctagtggctcgcaactgactcctttaactactaaccactttgtttcacctcgtcgatccttcgactgaaacgatgacgaggtaagccaaaactcatctctgagacctacccccccttacagtgggtagtcatactttcgcctgactgggaacaattgaactattgtccttgagaaaatcaccaacacttctcgaattacgaagagccctgactttgaaaattgaaaacttgaccagtcaatcaaaatgaagcaatgacggtgcactttcatcccggcaagacctgtaacttaacccttagctgatgataggaaattccacataaaagtgactcccacttagctcatgaacatactgactcttgactaactttctcatcagttctaattgttggtatgattgtcctgcttctggcctgacttcggtgtcgagttgcatagttgatttctgaaaactaacctgaccgactctgcattggaactgatgcaacttgaggagttggggtgctgcaaataaagttgtcgacctgatgacactaacgccttgccgttggacaacctacggaggagtgacatgtcgtacatcttccattaatgttgaacaccttgaaagaactgcccttgaaaaccataaccattgtaggtagcacttgttgctcctaggattagtggtggcttggctgtgctggtctgctgagaacttggtggtgtactgtctgaggttccgggtgcttgctcttggaaaacaaaactggctttggctctgatccaaaatcccgcttgcatcttgagcttgtacttgttgttggagacactgttgttgcatctgttgcatcggactctgtgggtgctacataatatctggcacatccatcttccaatcttggctaaccagagcgaggtgctctaactaagctggtagcttgttgtcttgaactgatccactgactctgaccgcaacacactactgctggagtttcttccgctgcattcgaccttgcattgagctttgcatctcctgcatcaacatccaacacctaatcttggacaccaaaaattgatgacgagcaggggttcttctggcattggggcaccttgcagctttcaactgaaccattgatttgtgaccttaacacatcgttattgctgttgttgttgttgttgtt

SEQ ID NO: 43738 - DNA, 14132 bp, Oryza sativa
cttctttaatgaagcctgccgctaacagcttggttaattcctccttgatcgcgtccttcctgtcttgcgcaaatcggcggagtcgttgtttgataggctgggcatcttctttgacatgtaaggagtgctcaatcacctctctaggaataccgggcatatcagatggtttccatgcaaagatatctttattgttctgaagaaaggtgatgagcgcgctttcctatttacaatctaactcggcgcctattacagcagttttagtagaatcagagggatctaggggaatctttttagtcttagcttcgctttctccgctttttgaagtcttggtagcgggcatttctccttcgctcgtcgtggctgcagccagtcggatatcctctcgggcagacgctatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacgccgggcgtccgagtatggcgtggtatgctgtctcgaaatcggcaacttcaaagctgatattctctgtgcggaagttttcccgagttccaaaagtgaccgggagggtgatctggccgagtggagttgcggataatcctggaattactccgtgaaaaggtgcattgctgggttttagctcggagcgaggaatctgcatatcatccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaaggtactggggcgtgtcgggctgaacagcattgatctcccgttcggtcaacttttgcttccgtttagactcataagccaaggggccaccgaagatatggttgagctccttgcggtggtcttgaaatcctgccggggcgtcgccgtcgtccttcttcctcgacgtgctttgttcttcgtcggagttcttccgtgtagtcttggtgtattgatccgcgaattgcttgtagacgaaacaatctttggccacgtggttggagttaggatggtgcgggcattgggagttcatgatcttgtcgaacgtgttgacgcgcgagcgctgtcgagaagagtgactggcggttgcaacaagttccgcaggcttacgcttgcggtccttatgattgttacttccacctcctcccgtagccggcgtacccttatttggcttccaactaggacccgactgctttgatgcggtgacggcgtcttcagctttggcgtactcgttggctttttcaaacataagcttgactgtcctaggaggtttacgcccgaacttgccaaccaattcttcgtggcgaatccctttggtgaaagcggcgatgataacgtcgtcggtgatgtcggagatcttattacgttgttcagaaaatcgccggatgtaatctctgagggattctccggacttctgaataacgttgtagaggtcgtattgtgtgccgggacgctcgaaggtgccttggaagttggcgatgaagtggtcgcgtaattcggcccaagatccgattgtaccacggggtaatccatggagccaagatcgggcggaatccgctaaagccactggtagatagttcgccatggccttgctgtctcctcctgctgcgcggattgcaagaccgtagacggtaagccacgattctgggttagtggtaccgtcgtacttctctattccagtcggcttgaagccggctggccaatccactcgacgcagatcgtcggtgaaggctgctactccgtcaaggtcgtcgtcgtggcggtccggcgaatgatgatggcctcgagctgctcggcgctgtatgatcgtgtcgcgaagatcgacggggcggcgacgaggtggtgagcgaggccgttccactcggcgctccccatgatggtcgggaggtgagtgaacggaccgcccgtcgtgacccttgctcctgcgattggatcctgcgccggtgatgctgaggcttggatgacggtagtcatgagatcggaagtggggaactcggctgccagtcggcgtgtggacgctttcggagttaactgggaccgaagccgcaatcatggtcttcgtctggttcaagatgttgacgacgtgatcagattgattgagctcgttttccttgaggagggtgtcgaggagggtgatcgcggcaaccgcattctgctgaggggtgcggaaaaccggtgtcccttcaacatcttgttggccgatgagatcacgcgctcggcgccctgcttccaaagctcgctgtcgtcgatcttcagcctccttcgcggtccgctcacgctcctgctgctcacgccgtaaccgttcttgttcttgtgcttgacgctcctcctccagtcggagacgctcagcctcgcgacgtgcttcggtctcccgggcttggcgttgctcctccgtctcgttatcggccatgaagacgccgaagtagagaggggtgtagttgtcatctaggctttcgtcgaagtcgtcgagatccggttcgttgtagcgagagctaaactcgtcgtactccacgatgtctgtggggcgcgagtcgacggtgggagagctgtagtggccgtccaactgatccgtcgaaaccgtgccgagtggttggaggatgacgccgacttccctgaagctaggcgaaatcggcgttgaagccgacttccgcctaggcctacgggatgaagacgctgtcgtgatgggggcggccgccgaatcgtcggggagcttcattaggatcggtgggtaagccccatcatcttgatctggtgtcgttggggaagatgcgatttcgcccgagtggtttgaagccaactcgattgagatggtcttgaagtaactttcggccgcgtttgggagtccaaacgggaccgaaagccggttctctcccgactgggccgacaccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaatagtaaaagggggtggctatcaagctagaaaagtgtatgggtttggagacaaaggatttatacaggttcaggccttcttattcaagaagtaataccctactcctgtccggggatggatccgccgagtgtattattgattgtatgattgggagaaaatcaacctatgccccaagaggcacccggaccctccttatatatgggaaggagtccgtgttaaaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcctcgccgtgtagatatgggatatccataatctccacaggccttttgctctaatagtagattgaattgtttttgaaggaacagaaactattccgttacatattcataattataggaacagggagattagcttctgttgcatgcgtatacatatttatgttatgcagattagcttctaccatatttttagcctgttttttcatttgccggctagtatatatcttctgtcggccaggagcagaaaatcaattccaaaaagaacagaacatcagttagttaggagcagaaaatcaatttgaaaagagcataacatcaacaattgcatgtgctgcccgtttatatacaacatatcaccaaacagtgctcactttcaaacgaaattaataataaaaatattggtttgagagcagaacatattctgcctccttataagtagatcgagtttgttttgaaagaacagaaggtattcttctttcttcttgccaaagcttcctataagtaaacggactttgttttttgagcagaagatatatattctgctttcttgtttctagaaacagagataatttcaggtacaaaattcaaatctctttctgctccctttctaaccgatgttctgctcctttggtagtttctgctgattttcaagttttggatcaaggagcagaacttaccgatgatgagatttaattagacgaggagaagttgaatatgtactacttatctaagtacgtacacagcagaaactatacccagcagaaactcggttatgcagaatatgtactacttatctaagtacgtatagatgacatacagtatgttagtaatcaaccgacagaacatgtactgccatcaaaaacagatacggagaaaaaaattaggtggctgttctgctaatttttttaagttgatgttctgtcattctttttaattcatgctctgccattttttctgttggccggctaatatatatgttccaccggcacgagcagaagataatatgccaggacgagcgggtgcgaggaagaaactgcatccgagaagttggtttgcatgcagccgatgatttagcaactatctgaactaacaaactatttaattaaacaacacaggtattcatcgttattggatcctcgtcactccattaactgaatccgatccataataggagggagtaactactctcggtagtaggaaataggctatatatatatatatatattagaaaaactattctacacccggggtatagaatagctattctatacctccctcccaccaacccacctcctctccccccaagggcccaaaacccacctcccacctcggtcaaaggccagtcaaaggtctctcacgtcggtcaattctaggtcaaacccgtcggtgactttccccacgaccctctctcttcttagctctcgtctcggaatgacgtagtaacgtgttgttcatcgtgtagtaacatagtgttttacttgcagtaacaaaattaaaatttactcataatatacttatgatggatctacttttggtaagcaattttttttgaacatcatggtgcaaacggtttttaaaaatagtacatggtgtgagagatattacccttcaaagatttgtttttgaagatttaactctccacaagtagtaatactatatcaaaagttttactactgcctgttttgcgttactgcaatcacatcatgtcattactacaagatgtagtaacgattataattttcacgtaacatagtgtcttactgtaattacttgataacgttactgcaagactataagttttgcagcaataaagcgtctaactacattttttgagtagtgttactgcataaacacgtggtaacgtgtaattgtcgtgcagtaatacttttacttttgtgcagacttttgtgcagtgacaagtgtatgattagcatctgagacttttaacccatatatttttgtttcaattcctgaattactgcaattcaccacaatattacggtcaaaagtgcaataacgtcatatacatgcagtaacgttatattggagggaggaaaccaattttcttgagaagagggaggaaaaacggttcttgaggaggggagtacgtagatgctttttgaagtttaatcctccacatgcagtaacacgataacatcatggtggaaacggttttaaaaaataatacatatcttatgacatattgcttttcaaagattgacattttgaactttagccctccacatgcagtaacagaatgtgtaatttacagtaataggggtttatacatgcagtaacatggttttaccaaatgtataaaattattcaaaatactcctacatcaatcagaccttgctcaaagccacctacaaactttatctatggcccacctattcgaacttcatctcgtaaaaatgacatagtaacactgcatttatcatgcagtaacatatctacttggaagtggtaacatgcacctattatgtagtaacgcttctacttttgtgtagtaacaagtatatggttagcatgtgaggctttaactcatatatttttatttcaattcctagtttatgtagtaatactattcaagaaaatgcaagacactttgttactgcaaagcttattgtctttactagactcttatagtaacgttgtgatagaaatgtagtaacgtacagtagtaacaagtaatgctattgtattattacttgtggagagtcaaattctaaaaagaaaagcttttaagaacaatatctctgatgtcatgtatggttttttaaaattgtttgcaccatgatgctagaaaaaaaatgcttatcaaaagtacatccatcatgactatatttcaattatatttgagcgttgttactgcacgtaaaacacagtgttacgagacggtgaccgccgcgttactgcacagtttcgcgaaacgagagctaagaagaggtgggtggtgaggggagttagtaggtgggtttgactgagctttgaccggcgggagggagctttaaccggcgtttgaccgaggttggaggtggtttttgggccttagaatggagggggaggtgggtgtggcccttgagagcgaggtgtacaatagtcttaccctatatatattacatatatattacgcacatatatatatggaatacatatatatatatatatgcatatgtataaatacatatacatgcatgtatagtacaattcatttgctcactagctagctatgacttcgacgccggcgttatgtcaaaagaagaaagaccgacgttatgaattgtcgatccgtcgtagtagaattcaccctcgggattaaggacttcttcgttgatgaatctcatcagttgttcctgaacaactgtgatagaatctttgtgtgggagattgtccctgatgtgaatacactatcattcgaaaaataatgacatatgaatatatgaaattaataaacaacaaatcgatacgcaatgaaattttgaatggtttatatatacgtacatcgagctctcgtgtggtgtagatttgggttgataggaagtgggcatactcgcatacgtagtagccgcacaggttagttccctggtcatgctttgcacattacatgagaaaggacaagagatttaatatacacttacattaactgtaactagtaatcatatataattagcatatgcatgatttaaaattgttaaaaattctaattatcatatgtaaataccacatgcatgatttaaaaatgttaaaagttctaataatcatatataactagcatatgcaaaatttaaaattgttaaaaattctaataatcatatgtaaataccacatacatgatttaaaattgttaaaaattctaataatcatatgtaaataccacatgaatgatttaaaattcttaaaaattctaataatcatatataataagcatatgcaggagttaaaacttttaaaattctaattatcatatataactagcatatgcatgatttaaaattttaaaaattctaataatcatacataattaacatatgccgtacaacaattgatttatatggatattcaatacatccaaaatattttacatcgtgtacacaacaattacggcaatacatcggcggtgacggttgaccgcacgtacttcctcctcactattgttccttccttatgatcgctacgtgagtaaggggtgtcttcgtttgataggaggatgctagggtcaaccgtcaccgtgaaagggggttgcccatcaaactgatcataatcttcatcagtcttgtcctcaactccgatgatttttcttttgcctgggagaaccacgtggcacttcggctcatcaggccctttgcccttctttcctttgctagacatgtccttcacataaaaaacttgcgttacatcattggcaaggacaaaagattcgtccgagtatcgaaccttgttaaggtcaaccgttgtcatcccactgtcatcaatcgttacgcctccaccaatcagccaaactcattggcaccggaacagaggaaccttgagaggtccatagacaagttcccatatgtcctcgatggcaccgtaatacgtgtcagttgtaccatcgtgtcccatggcatcgatacgaacagcactgttctggttcgtgctctttatgtcttggtttctcgtgtagaatgtgtacccatttatctcatatccttggaatgttgctatcaagccagatggtcccctcgccaggtaggcaagttgttggctaatcgtctcgttacccatgagatgttgtcgcagccacacgggcaatgtatcaatgtgatgccgtgtaatccatgcatcagacttaccgatgtttctggcaggaactagagccaagtgctcctcgatgtaaggagccaccaatgaagattgttgcagaaccgtgaaatgggctttacggaataaattgttgtctaccgtcattgctgcgttccttccgagagtcccctttccccgtagtctcccttcatggcgtgattcaggcactctgattgggcgaaggtcttcgataaattctacgcagaattcaatgacctcctctgttccataccccttggcgatgcttgcctctggatgagcacggttacgaacatacttcttcaaaacgcccatgtacctctcgaaaggaaacatgttgtgtagttacacaggcccgagaataccgatctctttgacaaggtgacaaagcagatgcgtcattatattgaaaaatgaaggtggaaatattaactcaaagctgacaagacattgcaccacatcattttgaagggcttccaatctatccggatcgatgaccttctgtgaaattgcgttcatgaaagcacattgctttgttattgttgcccggacattgtctggaaggataccccgaattataactggtagcagttgtgtcatccacacgtgacagtcatgagactttaggtttgtgaacttcttctccttcgtgcttattattcgctttatattcgtgaaggacgtccaagaattcccaatagggtaactcccaaaatatatagttctttttccacatcgccgcgtgaccatcttcgctatcaataggctggctgccaggcccctttccaaacactactttaagatctttcaccatagcaaacactgtttttccactgcgatgtttaagcttcgtacggtggtccgccttatgttcaaagtgattgcctttcttccgtacagggtggtttgcagcaaggaatcgacgatgacccatgtacgcaaccttcctacagtgcttaagatacgtactttctgtttcatctatacagtgagtgcaagtcttggaccacttattagactgccccgataggttgctaggtgtaggccaatcgttgattgttacgaacagcagcgctcgtaggttaaactcctcatgtttgtcctcgtcccacacggggacactttctttcttccacaacagtttcagatcttcgaccagtggtgttaggtacacatcgatgtcgttaccaggttgcttggggccttgaataataatcggcatcattatgtacttcctcttcatgcatagccaggggggaggttgtagatacacatcataacgggccaagtgctatggccgctgctcatctctccaaaaggattaatgccatccgtacttaaaccaaaccgtatgtttcgtgcgtccttaccaaagtctttgaatgttctgtcgatgtttcgccactgcgaaccatcggcggggtgtgacacagtatcccgtcctgttgatgttcttcagcgtgccaatgcatcattctagcatttccccttgctcctgaactaacgccttagccgtggtattatagggaaataccacatcaccttagcaggaattctcttcttcgttggctgcccataaacttcacatggatcatctcgtctaatcttgtatcgtagtgctttacaaacagggcatgcttttagattttcgtactcctcaccgtgatataggatacaatcattcggacatgcgtgaatcttctgaacttctagtcctagagggcagactatcttcttagcctcatacgttgtctcgggtaatttgtttccctccggaagaatgttcttgacgagtttcaataaatcgccaaatgtcttgtcactaacatcattttttgccttccattgcatgaactccagagtggtatccaactttttgtgcccctgctcggaacctgggtacaacgacgttctgtggtcctctaacatacgcttcaatttatgggcctccttttcactttcacagtcctccttggcgtcctacaacatctgaccaagatcatcgcagcgtcgttattgtcagcatccctgtccacctcgcccgtttgatttccttcaaatccagcgtactgagcccagtccggaatgttctcgtcttccacttcatcttcttccatctcaaccccttgctcaccgtgggatgtccaacaattatagcttggcatgaaccccgactaaaacaagtggaaatgagtagtcctgcatacagaatactccttctagttcttacacttattgcatagacaacaaataaaacccttatgcttgttagcttcggccactctcaaaaaataatgcaccctgtcgataaactatttggaccaccggtcagcgtacatccattgccgatccacctacatgaaatgaaaaaaagtcatacataaataaatattcataaaataatgacagccatacaataatgatcaaacaattaaaaactctttcaatagtcatacaataatgacatatcattattcatacaataattataaaataatccaacaaacaattcttatttattatttttgaatttttaaactaatattaatgttgtacttcttttaattttcaatttagtttgttttctatttttcaagattaattttcattatattttaaactatgagaataaaacttttttaagtaaacaaacaaaattcctatatattcttcttccccacacaatttgtttctctcatcaacttacgacaaagttttggagacaaaaaatgtgtgaaacatagctccaaaagtaatataacaacaaaaaacattggaggatgaagttactaaccttttagatacctccgatttgtatataatcaccaaaaaaattcacaagaaattttggcatgacctcccctcttttttggagaaaatttgaagcttgctcgggctggaggaggaagaagacacatataaagagggagataattagtcccggatgatgttatcatccagggctaaaaatcgccgagatctttagtccccgggggcctgacaaggcctaacatctttagaaccgagactaaagatgatcttaccaactgggattaaagatcatatatgcccgctgtagccaccaaccgggactaaagatgatctttagtcccggtttttagtggaaccgggaatattgtgaatttcggctgaccgaccaaagatggtttctccaccagtgctatgataagatctcttgtagtgacggcttgtttggttattagagaggcagtttgagacatacggcatacagtttcatactgtgtgcgtgccaagttggcaattggatcctagtagcagcaaattttgaaacactcaacccaacccaatccttcttctcttaatcttctcttcctactcttgtgtttgtgtgtgtgtgtgtaagaggctagtagagttagctagcctaaatttttttgcacgttgcagctactagctgtgctgctggcttgtcgtcctctgcttgaactttaaagagagagctaatagatcggtgatccgcttgggtttctggtgatcatatgcaacatggactagctacttggatttgttcaaaggatctgcttcttggatgctgtctgggcacgtcgccatgcatgcgaattttgcggatggagtcaaaagctgcatgcacggagctgatttaattaagggcatgttcagattgtagtcaaaataaaccttaccaagtttttggcaatgccaaaattttggcaggatttcttatgtattaaccaaatttggcaacaactaaacgtagatatttttttggtaactttggcaaaaaatgatttggttgaaaatgacatcaaagtgaacaggccctaattaacttgttgacagctactccctccattccaaaatataaggcataaccacccttaactcaaagatcaagaaataattattatcatcttatagtttgaatcatgctaataaatataatgcatgcatccaataggattagataacatgagagtaaaggatttaaaaaagtaataacttaatgaagaagatgtcatagttaattgcatgcttgcatacatgccttatattatggaacatctaagaaaagtggttgtgccttatattatggaatagagggagtagtacctaattaagcatgtgtgttaatttattattaactagtaatctgcccgtgctaacgctgcggcgacatttagaaatacaaattaagatcgatggatatagctattatgttgttaattaaattgccacatgcataaaataacatagttattatcctggttcaaatggagtcattagtgacaacataccatggtaaaagcaaaagtaattaaactttggaacttggcaccttgaaccatcaaatccttgtctaccatgctgtctccctgtcaccccccccccccttaattctaaattaaatggatgagagaaagagattaatatagtttagtgtgatagtgccaacacatggaaaatttagagcttctagttctctccttctacatctctcttaaatgtcggaccaagttcttatggggcccactcatcatacaaccatagccaacacatcatctgctcttctctcatttaaatcttcttttatttctcaaaaggtgagagaaaggtttaaattgaatttccacccaaaatgccactctaccactccaagccttctaggaaacatctatatatgggcctatttgtcgtccaaatacctgcaaacaaccttggtgaatcatctctttatcctaaattatattttcaaagagagaaagaaagagagagagggagttaaagtccaatttacacccaaacttcaccatacctctcatcttctcataggaaacatctaaatggggccactagacagccactcatacttggttgagtgaagtacaagtgggatcacagcctcaaaccactgccaactcctttaaatcgtttctacccctcatgttgacaactagctctcactttccaccttcacttttaccattcactactacaaccaagatttttgtgtgagggctaaaacgatttttgcgagcgggtaggcggcccgcacgcacctaggggtctaggaaaatgatgatttttgcgtgcgggtggcgcacccccacgggaaaacaaaaatccgaaataacataattttttttaaaaaaaacgaaaccctagaatccggcggcgggcttccgcccgatagccatagtgccgcctgcctcccgccggcctccgcgccacccaccgtcggatccgcgctcccctccggctgcaacgccgccgacgcccctcccctccgccggatctagggagggaaggaaggggagaggaggggagctggatcccacgcggggagaaggcggctggctgccggatccatgcggggacgaccgccaccactggattcttgcgttgacggccaccaccgttggatccgtgtagggactaccaccgcccgccggatcccgcgccctccaccgcagccacatggaggaggccggcgcgctcctactcccaccaccgccgcgccgctgctgtcgccgcgtgccgccgctgctgccgccatcgggaggagaggagaggagagtggagagaggagaggagaggcgtgagagagagagtactgagaagagaagctctgcgtggaaattttaaagtggaaaaagggatagaggggaggggacaggagagaaagagggg

SEQ ID NO: 43739 - DNA, 3833 bp, Oryza sativa
tgtgggtgggggcctagagcggccatcccgctcccccctccccccctcgtcggccctgactacatgggccttaacaggccacatggcatcttatcatgatttctgggcttgatagtgacgaagatggacgtcatagactgtatgacgacagaaggatcatcacaatattaatgacgaaaagataagcattctttatagaacgccattagagacgcatgataggttgtcacgcccggaatttctatccaaaattccaaatgcttacatgtgtgtaaaccctcgtcctggaatcagccgaggcacacaataacaaattgataatagagcacaattattactctaattaataagcgaataaaatgtcattacagaggtagatagttcctctcaatcaataaagatctaagcagcggaaaataaaagaaacagcgcaggcgactcctctccacaggcaacttgaccaaggctacgcctaatcatccacactatcagcatcactgtagaactcctcctctgatgaatgattgcaaggtgagtatatgatatactcagcaagccacgcaacaattaagcaagtgcacaggataacaaaggatggcatagtatagtctcaattgcttaaatagcatgtaacaattatttcagaatttaataaaatagttaaataataattaaacaatattgatccaacgctatacaacataccctgttgcataggcccaaccattctgaacaaccagtcccgactgcacagttctatctccaaaccaggaattaaccattccaaaccaggagctatcaagttattaacagcatcatttagtatggtgagaggtgtgagactaatcacgaaagacattgttagacccgcccataaccgtgggcacggctattctaatagtttaaactctggccagaggtgtaccactgtacccacaaagacacaacctcaacatcatgtcaaccatgcgtcgcgatacttgacaagtacccgaatagagattgtgacaataccctctatataatacaattcaaagcagtgcaccgttcccggatcataatcacccccttataaacaaggtatggactccccagcgacccccgtgggcttatctccgccacttcatactctggtgctctactatgaaccatactatatagaaagtaaagccgttgcccacgctggcttgtggttgacacggtaaatgtttcacaaccgaaaatcgtgtgctcacaacccatcaaaaccatatgctcacaacccaccattatcaggttttagttggcaaattaattacttaaccaatcatgattaaccatcatgagctatcattaagccatcattaaataatagtgaagcataagttatcccaatagtgtgctaatgtttctaagcatggctaagcaattatgtctaatatctagctgaaccaatatataaagctcaactagttaagttataataacccaaggtatcaaggaatagagtaatcaagaacaaaagggctataacaaggcaataggttaattccacccaatgacattcgaaaataaatgcaatagttgaatagaaacaatagctttaaacgggatcaacatactcaaagggttgtttgggatctgtgtgacttgccttgctggccttggaactcttcaaagtcttctcctgcaaattcggactctccgggaacgtcggactctaaagagaaaagagcaaaatcaccaaaacagcacataaacaagcctgaacagtacatgtggatatttttaacatgtagatctcaattttagaaaaatttagagacttgaaccaactaaatgcgagctaagatgaattagttatgaattttcatagattaaatcggattaaatcatttatatagattttaattgaattatgacgtaataatgaattatttttaaaaaggaaaaagggattattgcgtcagcggctcgggttcacggtggaccgggtgcacggcggtggtttacggaaacgaacggctgagatcgatctatccaaaacggaccaagatctaacggtctacgaccggtctacggtggacggcgtcgatgatatcagcagtgacgtcatcaccgacggcggctcggcctcgcgtgctcgccggcgaacgacggcgcgacggcgcgaatgaaggacacctacgggttgcgggcgacacggcgaactcaccggtgaccaaagcagcggcggaaggtcaacggacggcgacggcgacgaggaagaagcggtggtcaccttcagctcgacgacgacggcggggctccggcgatctacagcgacggcggagaggcggacgaggtcggcgacgatttgacgatcacaacggcggctttcccgagcgacgacgacgaccggaaggacggcggcgcacggctggacgaacggcggcgacggcggcgctagactacacgacgctagggctctaccggcgacaagagacttaggcgagggtggcggcgggtagaggagacaccgggggtccttttatagcggctagggggtggcggcgaaggtccacagcgaccggcggcagcgatggaaagtctagggttcggggagagagacgaatccgatttgagttcgaatccatggatttccgaacgattttagccgatgattccaaaagagaaaaggtagaggggatctcggggatcatttcccctctatcaatttcaccggatcgggaaagacacgatcgaatttggaagggcagcggcgcggctcggctagggttcggccgggcgacggcgcgaggaagacgacgagtctgacaggtgggtcccacctatcagcgggcgagggcgcgcgcgcagacggtgctcggctgcgggccgacctaggccgggagagagagaggggtttgggccgactttcggcccaaagccaaaagaggatttaaaaaacctttttcaatttaaattattcatgaaatgcaattccattgattaaaaatacttccttgcctcaaataaatcccagaaaaatctaggaactatagaattaagcgaagtatttaataaaattttatctggcccaattttatattgaaatttattatttaaaaatagatcttctcttctaggcttttaatatcaattctaataattccaattaaacaacaatttatatatttcggatttttagggtgtgacataggtgacgaatgatatttgtcacacgaacgttagatttcacaacatgacttaaaattcaattttcatgacgtaaattagcatcagctacactggtggagaaaccctttttcctcccggttcgtaacccccctttagtcccggttatccaaccgggactacgaatccgggactaaagatcgctatccttagtcctgggtgaaataacctggactaaagatcgatctaccaatttttttcttatttgcatggccctattgctgcatggtttagggtttatgttacaatacatatatatgcattatatatatctatatatatatatatatatatatatatctatatatatatatatatatatatgatggctctttcatacgcccaggtgtatgtacacccttttattaatggatgatccattagcattcaaattagctatgaaaaaaattaataatattaatttccaaatgactgcatgcatgtggcatagctgcacaccggattgggtgcagatttgaacaagattgttggcatgcatttgctttcaaatttgataacgtaccttagatatccccaccttttctagtatgccacagtatatactgttttttaagccccagtatatatactctttgaagtgatgagcagtactatat

SEQ ID NO: 43740 - DNA, 1088 bp, Oryza sativa
  unsure (1)..(1088): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcctataaatagcagcagcaccttacattcaagaatcacctctcaacacacaactaagaaacatagctaggtaaccagggaaggtagcatcagcagcaggaggcaatggagggaaagaggactaccacttcgatggtgatcatgtgcctggtcatcttgagcctcactgtcgactccgccaccgcggcacagtgcggctgctgcatatcctctcgggcaaaagcatgttgttttggttgtattgctgctggtggctccgactcaatctgcaagaacacttgttgtttcccatgtattctggccgattctggtaaattcactgaagtcactcttttaaatgcacttcttatatgtagatacagactttgtagcatatcgtggactaatacatatgtgtggccttccatgcattttcatcaatatagtttgttgacttcacttcccatctgacaacttcaggcatatatcttgcaacatgaagacaatttatgctctacttccactacaaaattaattaactaatgcgctaatgtgatttccatattttaatttcacagttgttgctaagatggacgaaatgggagttcttgctaagatggaaggacaagcctaaaacaacctactcgcattgctaccagtcttaatgcctttcataagaatatgttgttttgcttcaagttatggccaagttatgttaatgtttatctccaataaattgttgaccatatggagcgatctatagtcgatccatctgttggtcccaactatttgtatgtcgtgcatatgtgcgctcacaagcatatttaatttctcttgctacttttaataaggccatagcactatccaatgtgtcatctgttggtctctgaccttagcaatttaatgcaacatgattattattatttgtgtgtgca

SEQ ID NO: 43741 - DNA, 4552 bp, Oryza sativa
tattgttctttaattaattcaaggccaaaaatccgacaatcaagttgggacaagaaagtatagcgcctagacaaagcatctgcaatcgcattatctttccctttcttgtgtttgataacataaggaaaagattcaatgaattcaacccattttgcatgtctacgattcaaattattttgagagcgaagatatttaagcgattcgtgatcggagtgaataacaatttttttaggccacaaataatgacgccacgtctctaaggaacgtacaagagcatacaattccttatcatacgtggaataattcaaaacatgtcggatcccaaaactaatgatttggaaaccgacatgtttaactgtatcaagccctggatcagtagattgatataggttcaacaatctggatcttcattgcatacatttagtcaagactccaaaggagatatctttatataaaataataggacatttacaagtttgtggctaactattacagcagaagctatacgatgactcaactctgccgttttactatagaattaaaccatctaactatgctagacttgaagattaggtttaaagggaactaacttatgtgattgaactcccagcatcaacaagaactccaaatagactctgaaaaagaggggttgaagtaagggtgagtacaacgtactcagcaagctattatattattcaacaatgaatgcatgagaggtaatatccgtgtagagctaggtttacttgcagaaggctgagaataaagagggagaaagcctgcaacgtatttgatgcaatagtatttaataaaatctggaattgagtttctaaccaaagtaccatatgagtcccgatcctcaaatccgtcagttcggctattcgaatagattcaaggatattcatactgcagtagatgtacgctttacccgcagtccatgacttgccactaatcattagcttagtcatggcccattattaggttattaacaattgtggcacctgttccatgaactctagtccccatgcgctatgactgtaacgttatcagcagcgagaggagttctggcattcccacgtcatctcaaccaggttttcataaatttacacacacatcgcgcgataatcaagatatttacctgcgcctcggtaaatatcacatttgcccttcgcggcatatatttgcctccttcgcgaggacttacataagaaccactgtacagaggtaccacattgttaattaacataatatctaggtctgtccccattgtagaagctgcggtcgtactcgttcgtttgacataagtacttggtaaacttatatcgaccgagacagtactagccacccggaaatcaaccaaatcttgcgtactgtcccaatctaagttcattatattttatgcaatctaacttggcagggctaagcaaaagctagcatatctggtttgctatatgtttaggttatgcattgtaaatcatgaatggctaatgcatgtgtaacatacccgaaattttaggacttaaaatttcttgtcaaaatagttagaggttaatttctccaattttgagagccaaaaatttctgttttaatttaggtgatgaccaacttaaaccattgcatgattaaaatttgagaacaaaataaaaccttttcattcccaacattagactagaaatatcatcaagcatacatgtacataatgcatgcctaggcttgagttctttgtgcatttggagttttggtcttgcattccataataggtcccatgagcataatctaaaagaattatttcactaaacaaacctatagttaatcttgggtgataacatgtggacttaatattaaactcaaatatcatcttctcagtctaaaagaaatttaatgtaatccctataataatattagatgcaattatgaagtgggaatacatatacaaacaaaggtcatcctaattctctaaaatattttgtgcaagataaaatcatggaaaaatttatgtgtacagtgattagcacaaacttatcctctgtaattttggtaacatgttaacactcaagttgatatctcaaattaatcagttaaagcagacaactaaaagaaatcaaattaaatttaatcggctaaaaccatatttcatccaaaagtacatttaactgcacataagtgaacatggaaaataatttattcaaatactagattagttatcatgaataaatgtaatttttctagaattttcttctctgtttaagcctcctaaaaattcaatctagctttctaatagcccatctttgtttaatttctgtgagcagtccacccattatttttgagtgcaaccaaataaaatggaatctaggtgtaatcatctacctccagtaaaatcaacactagataatttggtccacacattaagttatgaagctacaaagttagaggagaaaataattccgaaaaaaatgatataaaactcaagtttacccagaatcttacccaaccctctcaccctagcctagtttgccacgacttggtcccacctggcagcctctccagctcgcccttcctctgtcccacatcctcagccgaccaagaaacacagagagggagagatcgagagccgaccgagtcctggacgcgtcgacgcgtggtgacgacgtgtcgacgccttcaagtcactgagtcatgcctccatctcctctagaccgagtcgcccaactccacacatcactttgaagctgaagaagccgagggagaggtcctcagcctctccgtcatcctcaacctcgccgccggtcgtagtgacgacgaccttcgccatctccgtttgagtcaaggtcacctccatctctttcgcgttcccatctctccacacaatgccgagcatttcctcttttgacctaaacccctctcgtgcagtgcatcgccgggaacgcaagccacgtcgacaacgccctggagcacgcaccggagcgccgccgcttcaaccatcgtcgtcgtcgtccggccattctcattcacctcagagaaagctgctgcgccattgtcattgcctcaacctcctcttcaaaacgcctcaagaaccccagccggaaacatcaagaacacggagaacacatccttttcttcaccggcgccaatctaggatcgcctccgccgtcatcgtcgtttaccgctgcctcggtgagccattgttcgattccttgcgcatacaccatctccttgacctcacaaccctcgtgcatgcttgcttgaagcagctcattgtcccgttcgagccgtcgtcgttcacccgaggaggagcgccgtcgccgagccgttccacaagtcaccgctgccgccaagacctcgacaaccctagctcgacccacggtgagcatcctgaagtctagaagactacatgcatgcatccttttcgttcgtaatcgacttccatgcacacatgcactttcaccccaaaaccaccgccgctcacactcgccatcggcgctactccgatgtcctctaaccaggaaaactagaggaatggaatcgcgagagctttctcttcattttatcttttgacctcaacctcaaacgagccaccgtttgccgccggcgagctccagatcgagctcagccatggctagctctgctctgcctagagcagagggatgacttccgtgaattagattaagtgcagggatctgtttacaattgtagaaacacactgacatatgggcctaggactgcgggttgattcctagaaacctcaagggcctttgtgcatattggtccctcacagccatgtggacccatcctttaaaatctgaagaataattaggaaaatgcccaaacaaatatgtttagcagaaaaatgcacaaagttgtaaaatctatataaaatcaaatatagctcattttgaagtgattccagtttctgtagattcttgaagttatgaactttattccaggaatataaaacttgacactcactgtacaaataatgtctctaagatttatctaagataagtcatgcataaaacatgtacaaacttataaaatacatagaaaattcatttcaactcattttgaaacaaaatcaaattctacagattcatcattcatcatcatacagtctctgattaagtgaaataaaagtaattacttactttgcatcaaaagcctctaaaactattatctttaaaatgactagttttagataagcaaaactttagaaattcatgtagaacccaatttagcttcaatttgaataaacttaagttatgtaggatcactaacacatgtatttccaagttatgaaataatattatatacttactgtgtagtaaaagtctctaaatattcatataaggatttactaacatagagcagcctttaatttgtaaaacttgtagaaaattcatttttagtccaaatgaaatgaacaaagtttctatagaaccagcaaatagttagcttcaacatagtaaaataaaatttggcaccttttgtagagaacatagatcaaaaccttaacttagtgaaataagaatttaaacacatagtgttgtttaagtaatac

SEQ ID NO: 43742 - DNA, 7812 bp, Oryza sativa
ttgcctgtggagtggagtcgccccgctgcagaagtcaagcttccgagtctagctcgttttttcttttccgctgcatttgtaatcttttatatttttgtaagacgtggatctgtatgtcaacaactgtcgtttgtgtaccctggctggtcctagacagggatttaatgcacattcagcttaaaaattctggttcgtgaatttctgggcgtgacacgtaacgatagatgacagtgggatgacaacggttgaccttaacaaggttcgatactcggacgaaccttttgtccttgccaatgatgtaacgcaagttttttatgtgaaggacatatctagcaaaggaaagaagggcaaagggcctgatgagccgaagtgccacatggttctcccaggcaaaagaaaaatcatcggagttgaggacaagactgacgaggattatgatcagtgttatgggcaaccccctttcacggtgacggttgaccctatcatcctcctatcaaacgaagacaccccttactcacgtagcgatcacaaggaaggaacaattgtgaggcggaagtacgtgcggtcaaccgtcatcgccgatatactgccataattgttgtgtacacgatgtaaaatattttagatgtattgaatatccatataaatcaattgttgtatggcatatgttaattatgtatgattattagaatttttaaaattttaaatcatgcatatgctacttatatatgataattagaatttttaaaagttttaaatcatgcatatgcttattatatatgattattagaatttttaacaattttaaatcattcatgtggtatttacatatgattattagaatttttaacaattttaaatcatgcatgtggtatttacatatgattattagaatttttaacaattttaaattatgcatatgctagttatatatgattattagaatttttaacaattttaaatcatgcatgtggtatttacatatgataattagaatttttaacaattttaaatcatgcatatgctaattagatatgattattagaatttttaacaattttaaatcatgcatatgcttatccacttaatatatttttaaggttttgtcattaattttgtgacgtgaaatcattatttactattttagaaacccatacataatgaaattaaatatgtagtgctattatctttagtccaggttcttaaccctaaccgggttaaaaaagatttggcaatcgcgggaaaaaatcaactaggactaaagatccgatatgctcgaggcgcacttgtcttctccaccagcacttagaagtttttctccgatctcggcttctccttcaccgccactgcctagggcatcccacgcgccgacgccactgtcgtctctcaccgtcgtctcgctgtcgtcgtcgtcgccgccgccgccttctcgatctctctctctccaaaccgccgccgcctcgtcgtcgtcgtcgttgcgacaccgccgtgccacgccgatgccgaccccgactccgcctcccgccgatgccaaccccgacgtcgacccggccggcactgtcgacgacgtacgccaaccccgtcgacgccgaccccgcgatgcgccgtcactgccaacaacgccgccgccactgccgcgccttgccatgccgccgcccccgctgcggcacgccaccgccgctccttttcggtgccgccccatcaatgccgaatgggaacgaacgcgaacggaagtgaacggacgtgaacgaatgcgaacgaacgcgaacgaacgtgaacgaaacgtgtgaacgaacgcgaacgagacgtgtacgaacgagaaaattaaacgattattagacttagcatatatgattatatacttgaaaacgtgaacgaaaaatatatgttcctttgcatttcggctaatacattttttttgcatgttgcagaaaatatgtcgtcgtcgtccctcaagccgaagtggtagctagccctcggaggaatttgcgcaggcaagtgatgtaaagatatgattatctagagttaccacatatgattattagacatagcatatattaattattagagttttaatataagattattagagttttaatatacgaaacttagactgaacatatatgattattagagttctaatatatgattattagagtatcaatatatgattattagacttagcatatatgattattagacttatcatatatgattattagagttttaatataagattattagagttttaatatacgaaacatagacttagcatatatgattatttgatttctaatatatgattattaaagtattaatatatggctattaaagtattaatatatgcctattaaagtattaatatatgaaaatgcccccaagaagaagtaccatcaccacctgggtcaggcggctatagcgtcgcagtgccaaagtggaggagatggaagcaagcttgattgagaggggtatcgaaccggtcaccgctaaatggccggatcgatcgaagttctggtactatgctcacggtggaacgcttaaccccgttgttgtcttccgtgaattagattaagtgcagggatccgtttacaattgtagaaacacactgacatatgggcctaggactgcgggttgattcctagaaacctcaagggcctttgtgcatattggtccctcacagccacgtggacccatcctttaaaatctgaagaaaaattaggaaaatgcccaaacaattatatgtttagcagaaaaatgcacaaagttgtaaaatctatataaaatcaaatatagctcattttgaagtgattctagttgctgtagattcttgaagttatgaactttattccaggaatataaaacttgacactcactgtacaaataatgtctctaaaatttatctaagataggtcatacataaaacatgtacaaacttataaaatacatagaaaattcatcacaactcattttgaaacaaaatcaaattctacagattcatcatcatacagtctctgattaggtgaaataaaagtaattacttactttgcatcaaatgcctctaaaactattatctctataatgattagttttagataagctaaactttagaaattcatgtagaacccaatttagcttcaatttgagtaaacttaagttctgtaggatcactaaacatgtatttctaagttatgaaataagattatatacttactgtgtagtaaaagtctctaaatattcatataaggatttactaacatagagcagcctttaatttgtaaaacttgtagaaaatttatttttagtccaaatgaaatgaacaaagtttctatagaaccagcaaatagttatcttcaacatggtaaaataaaatttggaaccttttgtagagaacatagatcgaaaccttaacttagtgaaataagaatttaaacacatagttgtttaagtaatacataaacatgtataagtatatatatacactttaggtctaattaaacctaaataaaaacttgattgaccagtgaagccatagttccatcctcatccactaaaacttagaagaacttggctcatataacaatttctaggttaatataatatattgctagtttagattagagcatctctagtttataaaatatgaaccatactagtaaagaccataaacatgtgaactaaaaatgttttagataaccaaattattccttttattcaacttaaacaggaagtagcatgttctgaacctataactcaaaagtcatgaacatataaaacactatacaccaataacacgttataacttgtaaaatgcataaagaattcattataaatccaaaaattgtgaaaccaaatgtgttagtattagaaaacacatctccacacccctgtgaagtctaatctagtaaaaatcactttacaaaagtatttcataacactacctaagactatactactataaaccgataaaacttctaaaaagttcataactccctaatggaataagttaaaataaaaattctttcacctaaattcattttagatcagtaccaacccactgtgcataaatcatgcattttagagcattttggattttcagctctttcggtgtttaattgcatatcgtgtccttttatctagataattgcataatcggtgaaggagtggattaggtgctaacaattctctgatcaaggcaagttttctcctcccatcctttgaacacattgaatcccatgatttgaggaatgaaaatatttgtttgcaaagttgcatgtgaacttagattatatcggtatttgaaattgggttaaggtagttatgacctatttgctgcataccccaccttgaataattgatcctcttgctgtttgaacccctagaaatggttagagtacactctttgtgctcaaatgggtttatatatgctctatgtgcaactactttgcttagccatgcttagaaatatgcaaatgctcattccatttataattaaaatgtggttttgatacttgaaccttcgctagaataaaatgaatatgatgggtatttgcgaactaaaatgtgtaaaatgtgattttacacttgggcagcaagtggtgtgcatacagtgttagttgcataccgatagggggagtgtttgcccaagtccataaggaccgaacttgtgtcacccatttaaagttattcgtacatccatatgtgctagtatgggatggcctaagctgattaatctatttaggactagccttgcattctggtaggccggtgtgtatgagttcgtataattcagaggagcttcctatttaccccgacgtggtagtttaggtgactaagcgtgtccaatacaacggtattgtgccacgtggtgggttcccgtcgtgtccgccaccacggtgttaagtttaaggcgtgggcccgccacttaacggttctaggtatattccaagtatgcctaggatggaggaacacgtatcgtgctggtgcaaggctagattctaagtagtgtaaaggcttcgttatgacctctagatcacattcaacatgaagagtgtgatggagtcttgcaaactcaaaacaaactagagagttcatatcatgtgggtaaagctgtacaaactctgcagagttctttaaactaatcgattagccgtgctcacggtcatgagcgctttggtgatgtgtcatgagtatagactatgttttaaaaatgtgatcatgtgacattggtttgaaattgataaatgtgttgagttgtgtgtgtggtgatacattatgacttattgttaaatatggcaataagagattgattatgatggaattatgaagaagttaataatgaaactcaaaacttgtctttgttaattgaagcatcaactcttttacaaaagaattgcgaaacaaaacttgctttatgctgaaaatgaactacatattgtcttcctttgatatatgccttacatgtagtatagtaggattgacttgtgcttgccagtacattaacttgtttaatgtactgactcttgctgttgatataaccttttgtttgcaggtttagtcttagtctttgagtgatgcgggttccgattgcttcttctaggatgagaacttaatggggtaaacccctagtcggtgtgcttgtgattgggtagtcaagcttccgctgttctctaataagtctatttggccggttggcctatgtaattattaagttgttgtaagtcttaagtttctttcatcttagttgtgtttgctatgtgtaatcatgcttaagatgaaagtgtgaatctagtgcacatcctgggaactagattcacatgagtatgagttaggaatatttgagaggttgtagatctttagctatttttatcaagtctcctgaatgtgtaacacatctggtcgccgccttcgagtggtttgacgggcacatctcaggctgaagttgactggcaggctaagggctcagcaatgtctccaatattcctctctcgaggcgtcggatgtttcattatgcttgtttgatgacttgaattattcacttcatctcaaatataatggaaggtccggagagcctacgacacttagtcttgggagacaaatagccacactaaaggcaatacagccgaggaatggcaaccttactcacaaggacaaatagtcattaaaaaattatgacagcactaaccatatctaatttcagttcaccaaacttacatttaaatttaggcagtattacggagatctaaatcaacaaacaacaaaccatacttcattgtcaaaacaaatggccttctatgtactttacaaattctcacaagatcatatttgcaatttttcctaaactaattaaccaagagaaaatatgtagtggaggattccacatataatttcacagcataagtacataatacaatatggtataatacacatatgcacagtactttgaaatatgcataccagaacatatgctttagttcactccattcattcttgcattcttgcacattcaacatcaatcagatctaccaagcattcttgtacattcaaccacaagcagatctaccaatgaatcactaacttatgtagcaatgggggaaatcggaggagaattaaaaccattcctcgtcagacgacggaaggacaggaggcggcggaagattcaccggctgcacaccacggcacgcgaatccctgaggtgtgggcatcgcatctatcagcaccaacgacatcggcagaggcaggggtggactggggctctttcgtagaccgatgtaaactagacttgttggcttcgttttagggaggggacggaaaagagataaactttacccggctggcctttgggcctgcgtggagagggataggagtttgcttggtttcagccaaaagataggaagaggattttaaataggttgcatatgcatgctttgtctaaagaaaattcctaaaaataaatgaagcaacaataaatcccaccaaaattctcataaatactaaacaacaccctaagcttccagcaattttagtttgaatttatcacatcaattgataacccaaataaatctttcaacacagctaaaaatctggaaacagcataccaattagcctagtttgcaccttcaccaaaattaaaccataactcctctagcaaaatctcaaggtcagaatgttaaacatactttatcatctggtgcaatggcttagtctaattcgaaatgtaaccacatgaaatgagagccataaattacgtaaactttggaacttggcaccttgaaccatcaaatccttgtctaccttgccgtctcccccctaattctaaattaaatgtatgagagaaagagagtaatatagtttagtgtgatagtgccaacacatggaaaatttagagcttctagttctctccttctacatctctcttaaatgtgggaccaagtccttgtggggcccactcatcatacaaccatagccaacacatcatctgctcttctctcatttaaatcttcttttatttctcaaaaggtgagagaagggtttaaattgaatttccacccaaaatgccactctaccactccaagccttctaggaaacatctatatatgggcctatttgtcgtccaaatacctacaaacaaccttggtgaatcatctctttgatcctaaattatattttcaaagagagaaagaaagagagagagggaattaaagtccaatttacacccaaacttcaccatacctctcatcttctcataggaaacatctacatggggccactagacagccactcatgctaggttgagtgaagtacaagtgggatcat

SEQ ID NO: 43743 - DNA, 11110 bp, Oryza sativa
cgaattcgagctcggtaccccgatctcgatcagggaggaggagactcgcgtgttggcggtggcaacggaggtagccgggcgggtagcggcggcgtccctgcgagcagcggaggcgctgtggtgccggtcagaggcgactggacccgtgcctggccatgggcagcagtgcggtagtgcctcggcgctggtccgacattgaggcggagcgaggaggcgaggtcgctggtccggcggtggaccgtcgtgaggagaggaggcgcagagcgaggatgcgggcggggagagaggcgcggagcgaccaggcggaggagtcatcgcaccggggatttgcgcgtcgcagttaccgcgtcgggccgtgggggcgaaatcgctggtgggatgagatcgggccaaatcgctggtggatatagatctacggtgtacagcggacggctcagattggatgagagggtggatggacggatgggataagagtggttgatttcacttgtaggattgctaggggtgaactcctcctttttatattagtacagatgaatcctccaaagagattaattgcatattgccagttcctcctgacctattatatgcatgtaagtgctctctggtgcggtgcaacgacgagcaagagtgcgtacgtttatagtagaactgagggggtgcgccttatatacgccggacgagcaaagagtgcgtacgtttgtagtgacgtctccaattttagtgtctatggtagtgaaatattcgacgtttgacacctcaaaccggagaaaaactggagctgtgaaatgttttcttttttttatatgcgtggagctctgaaatattgatagttttgtttttttctattaaaaaagccaagaagagttgacgacttatcggtaggcgctcctcgatggagggagatgagcttaaaaagtttcagtaaatggacccatgcagtggaaatgcggagtggagtggagcagtaataaaatataaaatgccacgcgcagggcatctcgaccacgacaggactctccttgagatcttcgaacagtgtgtgcttgctagctgaactgcagcagtggaacagtaataaaatttaaaacggatgtgcagtgttcacagaggacgagtgtgctctgtgttctctgcttgtgaatagatatggcgatctctgcttgtgaatagatattgcgagtactatagtacgctacaaacacaactaagttaccttatgaaggactactcaatagtacacttaaaacattgttactcgttgccttttacatcgatttttccgtgccatcctcttaaaaggaccgcacgtgaaaatgagccgattttcccagaagcgacgagttgccgcctgcacggaatctaaaagggtccctgtagtagtgattaatctagccaactcgccactgtgaacctcatctatttctcacagtgttccactatgcaaaccaccaaaaactacctcggaatctccaagaacttccacttactcttttcacccgaaggagtttcatccatcgcacatattctctggtgagcttcaccgcactccaaccatgggaacgtgaagttccttctctacctaatcaatccattttctttgtttctattttggcatagatcgaacagttggtgatatgctcgtcggcgttcccggtgtccatagcgccgccatcgccccacttcgtcattcccgtcgactcgaaccatctccggccgagccattgcgccaacgacgtcgcctacgtcccaggaaaaagacgcccaaatatgatcaagccaatacgcagccgcgaacgccatcagtcgccgttgccctcctattgcctctgcttccctagccgccaagtcaccgacatgtgggccccggctatttagccacttcattaggcgtaaggactttcattagtagaaatttaaatcttgtaaggttctttttgtaaaattgctttgtatgccatgtgggcctatggacctaaacgcagttcacctaatgcccatggacctttttgtatagggtttagggtaagtcctaaaccctacttagagattactatttcatgcattcattacttgatataatagcttgatgagtatgttgtactcaccattgctttaaccctctctttgagaatcaatttggagtttttgctgaagccgtgagtttaaacatataaattagtttcattccaacttagttcccaagtatagattagatagatggtttgattctatagcaaaacattagagttggctcatcctatagcttctacagtaatagatagccacaatcttgtaaataccctattattttatgtaaagaaatcacctttggagccttgatcaaatgtatgcgatgaagattcagattgttgaacctgtatcaatctactgatctagggcttgatacagtttaaacatgtcggttaccgaatctataattttgggacctgacatggtgtgtgggtgggggcctagagcggccatcccgctcccccctcccacccgagccggccctgactacatgggccttaacaggccacatggcatcttatcatgatttcttggcttgatggtgacgaaaatggacgtcatagactgtatgacgacagaaggatcatcactagattaatgacgaaaagataagcattctttatagaacgccattagagatgcatgataggtgattcgtcacacgaacgttagatttcacaacatgacttaaaattcaattttcatgacgtaaattagcgtcacctagactggtggagaaaccctttttccacccggttcgtaacccccctttagtcccggttatccaaccgggactacgaatccgggactaaagatcgctatctttagtcccgggtgaaataacctggactaaagatcgatctttaatccggtcagccacgttgccagctaagccatcttagtcccggttggtgtaagatcgatctaccaatttttttcttatttgcatggccctattgctgcatggtttagggtttatgttacaatacatatatatgcattttatatatatatatacatatatatatatatgtatatatatatataggacggctctttcgtacacccaggtgtatgtacacccttttattaatggatgatccattagcattcaaattaactgtgaaaaaaattaataatattaatttccaaatgactgcatgcaagtggcatagctgcacaccggattgggtgcagacttgaacaagatcgttggcatgcatttgctttcaaatttgataacgtaccttagatatccccaccttttctagtatgcaacagtatatactgttttttaagccgcagtatatatactctttgaagtgatgagcagtactatatactagttttttttgtgtattagcagtacctaataaggagtaccttatatttttgttgtagcagtgaatacatctttttttaattagcagccgaatatacttactccagaactaatgagtatatatatactgattatgtctttttattggtacgtgcagtatatactactgcaacgagcgaatgagtacatactgttctttctcggaatgagtatatactgattttttttttggaacgagtatatatactgacttttctcggagtggtatatacttatttcttctccaatcggtatgaacagctactcggagtggtatatacttatttcttctacaatcggtatgaactgctctttggtcagtgtatatatactacattcctcattgaaggagtatatactgcttctttttttatcagtatatacatttgttattaattgagtatatactgtatgcactacttgttctgtcagtatactgcatatactaattgtcatgtttggtcggtatactgcatcgtcctcgctaaaggaggttatactgcctttttgtttgatcggtaaatactacgtatactactttttttcactcagtatataaataagtatgtaccagtatttcttagataagtcgtatatttgctatccatggaagctggatgcatatgcttttcagttgaatagaataattaatatgcttttcacgtgcaaattcagaagtatgcctgaatcactggcaaagtatcggctgttgcattatgaataaacctaaattaatgaaataccctagaagggcactgaattctgaatggacattaccagaccaaagaaaaagatcaacgcagactatcggaaactaagaacaaaacataacgggatcacccctcgatgtggctcatcgaagaatctctgcatccccgcagacatatctcggttaacatcgatgggatcacgccgaccgcacgccggagagaggtggacaagaatgtgtcttcctggattaacaccgttagctaggaatcacgggttcgatgccgacgacgatgctgttgccgcacggccacacatgctggactgttctgtcatcagcaccatctacgtccacgatacatgcatctcgcatttgcatgcaccaaacaaattcgatctgcatgcatgcattatcgatttgcaacctagaaaaagcaaatcaagaaaatcggaagaaggaaggacttgcctgcagcatagtcgatgttccagttccggacgacgctcagcgtcgtcttgatcgtagcatgggcctgcatcgatgccgtcgccgtacggccacactgacttgcccgaagatcaatggcgtcgttgtctggtcacagctcttcggccagccagtcgcctgcggatagtcatactgaaggcattggtaatggaagacgccggcgtagacatcagcagacgccgtgaccttcgaatagccgatgggtcgcgccgtcgtcgccttcgaatcgccgatcgcgataacctgcagatcgatctatcgattctgtttacaaccacccacgagattttaatacgagctattcaaaagggttctggttagtacggaataattcagattatgaggatttttttcgtaactagaaatcaaaacgggctcggtatatggatccgcttgctgatttgatcggtggtgttcgctgatggacggtggatggaaccgggagtacctactcctgggagtatagaatcattatatatatatatatatatattatatcctactaccgggagtagctactcctgcatcatctgctatacgtgctttcaagatttgtgcagctttctgctaattcgaatttgtcattagcgggttaattaacccgttaaaatatgccgatcgctattttcgtgggatacaaacttttgaatgcattatgcacgtcagatgtttgcattatctgcctgacggccgcatatatatatgatctgctcgtccacgcatgtatttcgcatctatagcatatcatcaaccacaactaaaatgaacagatgatgttctgctggcacactgcgtgtggtaattacgtactgtccaactatagccttgtgaacaagataattaaattgagcagaagatgttctgttctttctctctatatatacctattcaaagaataataaaaaaaggcagcacatattctgctacctttcatggatgggaagaagatattctttttgaatgaagcagaacatgcagttttctagtttctgctcccggttcacattctgcccattttctaggttctgcattttgaagttctggaggagcagaacgtatccatgctggtattcaattacacaatcagaacttgatatggggaccagaacaaaaatgttctgctcttgtttctgctggggccttgtcgaaactagatttcggcaatagtaaaagggggtggctatcaagctagaaaagtgtatgggtttggagacaaaggatttatacaggttcaggccttcttattcaagaagtaataccctactcctgtccggggatggatccgccgagtgtattattgattgtatgattgggagaaaatcaacctatgccccaagaggcacccggaccctccttatatatgggaaggagtccgtgttacaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcctcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaaaataaggaatatggtgcatcgaatagatgcacctaattaggtgtagcccccaactatgtgattagttaacaaactaaacatatagttgagaacaaaataatagcacaatcatgcatcatatgacagaagcatatgcggcgcctaaagaggcattctagccgactgctttttagtcataataaaaagaatccgagtggttaacactctaaaaggttcacgaatgaacacacttgacaggcatccgaataaaaaactctaaagattacccaccaaacattataaaaattatggtaatgaataagtctaatagcctaagctatgactatccatcataatgaaaacaggcatatgtggtgtaaaatccgagtaaataaactcataaaggatttaccaaccgcctaaggaaaaatgactataatatataatcagcctaagccataatattggtcaataaaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcttaaaaagttgagtaactgcggtataaaaggattttaaggtattgagcacttgatcacgcgcactttggcctaagcgaaaagtgcctgagtccctaaaagaacgtgacaggccacacctgaaaattcgcattgtaataattccgaagaattatatgaccgcgtaaaaaaagattttatcagcattgggcaacactattgtgcgcataagttgccaaagcaaaaaatgcctaagtccctaaggagcacaatgggccacgctgttaaaagtattgggctgaggtactgttcaagcctaagcccattcgcacctccgatacccttaacaaaaaatcacgtgatccaagcgccacttcgtcttccccgccagaactctcgccattttccccacttcctgctacagtacagagctgcgccggcaaactagggttcaccattccactcgaatccaccttcgaaaagttcattaaaatccttcctgtgatccaccgcctcaattcctcacctctcccaagccatccctcgaatcaaatcagcgcattcaggtaaaatcgatggcgaaagagaaagaaagcttcgaaggccaatgggcaccatccgacgtgacggaggagaatctgaaggagatggtggcgcacggtgttctccctgccaaggagatcattgggtggcgaccagcgtgcggtgaggtttttccgtcccccgacacacatgaggttgtagttttttcccatttcttctatggcggcttcgctcttccgacctcaaaatttttccgcgggatattaaacttctatggaatcagcttgcatcacctaaacccaaattccatagtccatatcgccaatttcatccatgtttgtgaagccttcttaggaattaaaccccacttcgctctgttccgccgaatcttttttctcaagccccaaccgaacaagaataagccatgtgtagtcggaggggcaggatttcagttgaggggaaccctgagtcagaagtatttctctatgcccttcaagacctcaaacaaaggatggcatgcaaactggttttatattcagaaccctgagcctgctcttcccgagtactcttgtcttcctccggtgtaccaagatacttggaactctcttccgatcggagatgaagctgctcaagccttggagttgatggaccgcatgctaaaactcaaagaacaaggtttacaaggagagcagattactcggcatttcatcaaatgccgattggcaccaattaaagaaagatcccgcacagcattcgagtttgacggcaagcatgatcccaatcgtgaagaaccagactctctggactttaaaatcatgaaggagagaatgtataaaatcttctcaaatgctattgtcgtcagctactcacatcaactgccagttgtgccatataacgcattcaatccgcctccgcaggtatgtatctgaaatcttcaacctatgaccaaaatagtatcttgtcttcatgttgagttaactaaccatggaggcatcttattcaggaatatgtactgataaaatctgatcccccaatcactcagcgccggtctcctcgccagcacaccgttcagggaggtggaggaccaacaatcagaccagattcgcaacctcaaacctccaatccaactggacagacaggttctcgcaagagaaaactggtgccaaatgacgacgaaggcgacgagaaatctggggacaaaggctcgcctaataaactcccgaagcgtaccatgcccaggaaaaaactggctggccgtccaatgccaaagattagaacatcttctaggtataaacctcttggtaccattttatttcggcatgctcctctcatgaaaataatactgaatattgaaagaacattttgcaggaaaccatctgacatagacccaactggaaaagatcctgatccggctgccacagagccaaatttatccaaagatgctgagccgactgccgaaagccggccgattgccgaaagccagccgactgccgaaagccagccgactggtgcccatgcttcggatgacaaggcccatccgagtgaccagccgccgactggaaaccagtcggcagcaactgaaactgtaacaacccaagagcccccgactggaaaccagtcggatgtaagtctaaatcaagagattcctgaagctgaagcgcaggcgacaacttctcaaggaccaaaggctggtaatgactcgatgattgggtctccaaataaagaacaaggatcacctcacgctcagctaggaacatcctcaggtaactcatcttctcaagtgataccgatttaaataactccagtttatttgcctaatgtcttggaaatacatcaggaccaccgggcgatggcgaagaagaaattccccgcataaaggcggctgatgattctcgtcctcctatcttgctcaaatggtgggatgagaactcacaggttgccggcatcgtcataaaccgtcaaaaagaagatgaggaagtgtgccagctgaagaaggcgcttggagaaactactcgcattgtgaatgtaaatatttcaggcgactgcctttgatgactttgttttctttttagctgaactaaaccatgaaccatcatgcagagaatccatcttcgtaatgaagccaagaccgcaactttggagaagctggttcctcatttgggaactcttgaagcagttagggaccagctacacgaggccaaggagctcgccaaaaagacggaaaaagaattaagggagcaaattgctcagctccaggattcaaacttcgagctgagtggttcgtcaaaaggtaatcttctagacctgtcccattaatctatgctgtcataactatatcctcaaccatttggatttcgaacagcgcaagccaccaggatggttcaaatggagaaacaaattgaagccttgaaaaaagacaaagtagaactggctgcgcaaagggattcggccttgaaggaggttgaaggtactgccagctagcaatctggacgtctctcttttaaatgcagcagattcttatcataaatgtgttttgtagatcgtaaaatcaaatctcaagctcagtttgacgtcctggttagtaagatcaagaggcttgaaggagcaagagatgaagtcgccaatgtcgctataccactcgtccaagctatgttcctcaataacagtggtccgagtgcactcgacgcaaccgaaattttcgacaagctgagagttgctccggatgtatatttcaagaacatcaagaaagctggaagtatgggagctggcatggcattagcgatgaccaaatccttgtacccgaggattgaaattgacgccattgatggatatgcagacgggacaagcgaagaggctgctcttgataaaatcaacaatgctcaaaacgcggctgacaggattgcaagtgacgttgtagagcaattccgcaacaacgaccttcagccgagtaacaataactctgatgatgaaaggactgattctgactgagcataaatgtaccaaatgaaggctcaatttgtacaatactggtgtatttatgctgtgcttgataactctagccaagtctttgatttcttaaaagcttttatcaagctctgttgagcctaaaacccaaagaagctattaaaaactttcagtcctcgcaaactaagtagaaaaatcgaacaaggcaatgaaaaaccaagtaggcaaattgaattgataaaaaatcacactctattattatgatgatagcccccgactgacaacttcgaggagaaaacttgatgttgacagtcaagacagggaagtacaatgataagcctaagcgtagaaacgacgaagatgttcaatgttccaagagttgtcgacgagagtaccgtcttcgcgcttgagtcgataggaacctggccgggtgacttcagagatgataaatggcccctcccatagaggagataacttgtgccgatcccgtgtagtttgaattttccgcaaaaccagatcgccgactaaaaaggcgcgggatcgaacattgcgattatgataacgtcgcagcccttgtaagtatcgagccgactgaatcaaagccgcttcgcggacttcttccaatcggtgcaagtcatccactcggtcctcttcgtagcgttcttcacggaaatttcgaaagc

SEQ ID NO: 43744 - DNA, 6100 bp, Oryza sativa
tcagggaacgttccgacccgacagatagaaggacgagctgtcactcgccctgcagattcccgagcatccaggacgaacacgagggaaaggcgtggttccttgaaatattggattcaagaaggacatccacatgtacaggagtcggatgaggagcaagagagataccgaggcaaagattgcagatcttgattatagggtatcgagctacgagctcagcatgcaagagaaggtggcaaggaaagtggatgaacgcatggccgcacatcggtgccacgatccccagccgtacattcctcatgtaataatcagcccctgaggcaatcgtagcagctgtgcctctgtcacacccagaaattcacgaaccaaaatttctaagctgaatgtgcattaaacgacaattgttgacatacagatccacgtcttacaaaaatataaaagtttacaaatgcagcggaaaagaaagaaaaaaaacgagctaagcctgaagacttgacttctgcagcgggcgactccattccacaggcatccttgacggcagcgacgaaaccaacttcttcgagacatcttcaactgaaaagaacttcaactctagggtgggggaaaagagagcaagactgagtactacccactgtactcaacaagtcataccagaagagaaggtatgatgcaggatatatccaaggaggctaaaggttcttttgcataaagctagcatttaaaagcggtagttgaaagcagtaacacagttgtagcaattaatcaatattaaccaatcactgtccaacgctataccacgttgcaacaggcccaaccaaccacctgaactacaccagttcattagctaactaggggtgagactaatcacggtgaatctggtcgaccgcccataaccgcgggcacggctattcgaatagttttactctgatcagaggtgtacaactgtacccacaagacacagccacacgacacgttcccatgcgccgacatgccaccacgacatactggaaagaggccgtgacagaacccttcgcataaccccctctaaccgatcgcaccacaccttagggttcgcccccgtccccagcaggcaacgggcagcccccctttcgtgccgcggtgaatccggaagccgataaaccggacaccccggccgacccaactccatcactcccaccctcgcctgggtacgtcggctagaggaaagctacactacaagcccagccgttgcccacgctggcttgtggtaagtacggtaagttcttccagggcatcccgcgaaccagtccttaattgccatgggcacaactagcaaaaccatgcacccacagcccaccatgtagtgtattttaattaaccaacaccattgcggtggcactaatccaaagctatgccaataatcaaagtctatgcttgaatgtaattccccttttgtgtactagttgaactaagcatggctaagcatttcctaagccaacatctaatcattttgataccccagttatcaatgacataaggtaaacaatatatggctgagtagcaggacccatcccacatgacattgtaaaacaatgcaacatttaatagaaatgcgggacatttataaattgggtacaatatgatcaatcgtaatgcatgacttgccttgctctcgtactgatggaaccacagcaatgtcttcgaggaaccacggatcgacgaaacggccgaaatctacgcgacaaacaaagcacacaagcaaaacaagctataagtctactgaaacaggaaacaaaaccatttttaatggattctatgcatttgtatgaatttactgagacttgaatggacttaatcggagctcagatgaattagttatgatttttagaagattctctgtgtttattactataaaagaaaagccttaatgagttttattgcgcaataaaggatcccagggctgaagttatccgggaggggcggcgccgacaagcgggcccaacgggtcagtgacacaagaggaggaggaggtgacctggcgggtgggtcccaccaggcagtggctcaggggaaggggtggcaccggccggtctcggctcggcttcaagccggccggcccccatggcgagcggcgatgacgcggacgggaggcgggaaacaacggcggtgaccggcgcaaaggcggcggtgcacatgggagagaggggaaaagggaggagaggggatcatcagcggcgagcacggcggccggcccgaaggatgaaggcggcggcgatgacccgacgagcggaggggcagacgggcggcggttgcacctacggaggaaaatggagaggagttaggggttgggaggaagcccacggcggctagcgtggccagccggagatgggaagggcggcgaaactcaccggtgcacggagagagaggcgttccggcagcgggattggatggggatgcggcggccgaggtagctttggcggcggagaagctaacggcggcggtggctctagcggtggcggcgtgcggccggagcacggcggcgagcggcggcgctagaggagatcggcgcgggtgcggtagagggcgtgcgagagcgcggtgaaaaggggaaaagggagagggggatgcggggaagctttataggggctcgggaggggcggacacggccgggaaacccccccgattcggccggcgacgtgggggggagagagagagagagacggattcaaaaccgaatcccgccctctcgggccgcgcgcgcggggcgggaaggcgtggggaagggggcggcgacgtgggcttgacgacgtggggcgagtggaggaggtggggcaccggcggtgcgggcggttggagctgcggctccaacgaccggaggtaggagacgaccgacaggtgggccccacctgtcagcgcccgaaggagagaggagggagggaggacttcggggaagggaggagaagcgggctggtgtgggaaggaatggaccgacggcccaagaaaaggaaaaaggagggaaaagaaaagataaaaaggaaaaaggattttcccagggatttaatattgcactttgcttattttaattggttaaaattatttctaaggctctgaaaattctactaaaattcctgttagcatattttgacatgtagaatccaagaaaaattccacatgccgattctgattattatttgcatttattagtttagggattcaactctaggttaaattaaacaatttcttcggacgatttattttatgaatttttaagcaaggaggggaactttagggcgtgacagcctcaacggggcaggtaggatcacagagcatggactccatgcaaactcaggatgaaaccacttgccccgttgatgagatcacgtagcggacaccatgtgagctacatatttccttcaagaacttatcagtcaaggtatgctcatagttttatgatttttgacttgtacattccgcaagttgctgcttcggttgattactaatagataacctctcatcacgtgaaggtggcatcaggaatggccatcccaactgacccttcagggacttaccactgcaggccgattccagcaggatactcgagggtcgaagttgagctggtggaagacgcttacgaggacctcgagttggactaccctggaggagacggtgagacgcatctacgagactcaagccacgccattatactatggcgcaagcggtacatcatccaccctgggcgacaagcagcgtctcgtgcaccatctcctccggctccgccatctcctccgctacctcctcctgcaccatctcctctggctcctccgtcacctcctcctgtaccatctcctccggctcctccggctcctccgcctcctccacctccaccatgtccgcctgcacctcccaagacaaggtctcgtcaagctccaccgcctgcccgcacaagggcaacgaagaaggcaaaagttgacgccaccaaaaacaaggagccgctgtacaattgcagtcaagaggagcttgacgcttatgtggcagcaaaagtgaagaggcaattcaagcctcggagtcttgaaaagaagatacctattgacccgagcgtgaagaacttcttcaagaaaatgtccacaacaaacaaggaggccttaaagctatcggactatgaccgaacacttaagaaagcctattacaagaagtccaaaccagttcctcagcttggagaacaacctaaccaagaggtcgagccgttggtgtcggcaaagaaattggcataacataattcatttctgacaccggtctaactgtggaacagttgattagaggcgcaccaatcccgaagacggaagtggcatacaagtttgaactcggtaaaccgcttgtcacgcctgagcagctgcagtccctaccgacacagatgtacaaattccatgaatggtacatggaaatgaacgccaagggtagagagatgttcggagcgaggataagaaactccgacttcttgcaaggagaaaatgttctctggatccatttcaaggatgtcttcgaactataccatctgaacgccctgaacgtctctcttctgagcgcatggattttgtaagtatcgttgagttcgatttgtttcgttcaataattagctccttgcatatatgtaaacaataataatttccttttatcgttgtagaatgaagattcaaaagacccgacggcggggggtttgcgatactgggttcatcgaccctcagaaaatcaacgtcgaaatgatcgacaagtacgagaaagacacagaggacaatctcgtccatctcctgacgcagcagcatttcaagacgttcatagtactgccgtacaacacagagtgagtttttactatcgttcgaacaaacttcgttcccatacatataacatgtacattttcatatatcatctcacgcatgttgcagattccactgggtcctgttacttttcgacttggatgcatgcagagtcaatgtgtatgactcaatgaataaagagaagacttttgacaaggttttccaacttatagataggtaatataatgccatctattccaaagccgcatggatttttcctattgctattatgcggatctcggataataaataatcatagcttgcaactgcatgtagggcttgggatcggttccgtcaattgttccgcgggacttggaaagaaaaacttggacggagctttaattttccaatcagtacatgcatgctccgaaattatattgaattgaatctctaattacagttaatataagtgtatattaaatctcttgtcctttcttatgtagtgtgcaaagcgggaccagggaactaacttgtgcggctactacgtatacgagtatgcccactgcctatcaacccaaatctacaccacacgagagctcgatgtacgtatatataaaccattcaaaatttcattgcgtatcgatttgttgtttattaatttcatatattcatatgtcattatttttcgaatgatagcgtattcacatgagggacaatctctcacacaaggattttatcacggctgttcaagtccttaatcccaagggtgaattctactacgacggatcgacaattcataacgtcggtccttcttcttttgacataacgcccgcgtcgaagtcgtagctaaatagtgagcaaatgaattgtactatacatgcatgtatatgtttatagatgtacacatttactttagtgtaaatatatattttggtaatatatatgcacataaaatgttaagtgctttaaattatacatgtgtaatatatgtatttatacatatgcatatatatatatatatatatatatatatatatatatatatatatatatatatatatatatatatgtatcccatatatatatgtgcgtaatatatatgtaatatatatagggtaagacaattctacacccggggtatagaataactattctatacccccctccctcttaagggccacacccacctccccctcctttccaaggcttaaaaaccacctctcacctcggtcaaacgctggtcaaagccccctcccgccggtcaaagctcagccaaaaccacctactaactcccctcaccacccaccttttct

SEQ ID NO: 43745 - DNA, 5643 bp, Oryza sativa
atagtagtgattcatgaagttccttctctacttgatcgatccattttctttgtttcttttttggcatagatcgaacacttggtggtgcgctcgtcggcgttcccggtgtccagagcgccaccatcgtcccactttgtcattcccgtcaacttgaatcatctccggctgtaccattgcgccactgacatcgcctaggtcccagcagaacgacgcccacatatgatgaagccaatacgccgccacgaacgctgttggtcgccgttgctctcctgctgcctctgcttctcttgccgccgagtcactgacatgtgggcccggctgtttagccacttcattaggtgctaaggactttaattagtagaaatttaaatcttgtaaggttctttttgtaaaattgctttgtttgccatgtgggtttatggacctaaatgcaattcacctaatgcccagggacctttttgtatagggtttagggcttaccctaaaacatgaaattactatttcatgcactcattacttgagattttgccgaagccaggagtttaatcatataaattagtttcattccaacttagttcccaactctagattagatagatggtttaattctatagcaaaacattagagttggctcatcctatagcttctatagtaatagttagccacaatcttgtaaatacccaattattttatgtaaagaaatttccattggagccttaatcaaatgtatgcgatgaagattcagattgttgaacctgtatcaatctactgatccaggggttgattgtcacgcccggaatttctatccaaaattccaaacgcttacatgtgcgttaaaccctcatccaggaatcagccgaggcacacaataacaaatgataatagagtactatcaaatatctaattaatgtgtgcaaaataaattattacagaggtggatagttcctctcaaagaataaagttctacgcagcggaaaaaaaacaaaagactaaacatctttggcgactccactccacaagcaactcgacccgaacaaagcctaatcctcctgatcatcaccttcattgaagcactcctcctctgaagaatgaaaattgcaagaatgagcatatgatatactcaacaagccacacagcaaatatgcaaatgcacaggataacaaaggatggcataattaagctcattcgcataaacagcatttaataaacatttgagagaatagtaaaacagttaagtaattaagcaatattaaataaacactatacaacacacccatgttgcataggcccaaccttatctgaacaaccaacccctaggtgtacaaatcaaacctccaaactaggaaatataccattccaaaccaggagtcaatttagttatcacagtattttcattaatactgagtaatatgagactaatcacgaaaaatattgttagacccacccataaccgctggcatggctattcgaatagttttactctgatcagagatgtaccactgtacccacaagacacaactctacaacatgacacaactccacaagacacaactccacaacatgtcacaacatgtcaccacaaaaaggaatgtgtagcaccggaatcaaaaagcacagttgcgggtatagagttagtaggaaacgtacccaaaaccacatcaggtgtattctgggcttctgcggctgcaacatgattaacacgagccttcggtgctggagcattggagttgttctgaacaggagcattcttcacacgccgaggcttgggacacttatcagcataatgtcctggatcaccacaattgaagcacacccctggcttgcttccctgttccttcctgacaggatgattctgagttggagctgctacaggacgagtgaccatattacgattatcgttgctgcgattaccagtgttgttgttgtagaactggcgttgagggcgagcaactgaagaggatcctccctgtgggtatggtgcagcttgaggtcccaaagcaatgtgcggcctctggctactaccctgttgtgccttgaaatgagcagccctacgctttttctgttccatcctattatacttgtcttcttggcgaatcgccttgtccatcaactgctggaaatcccagtaatccatagccatcaatgcataagacaactcatcattcaatccctctaaaaacttctcctgatgttcttcatcagtgcgacatcttctggggcataacgagctaagcaattaaagtcatggaggtactctgtgacagaacgggatccctggttgagtgctctgaactctctcttcttaagggccacaacacctgatggtatgtgtgtcttcttgaaagcagcagcaaactcccgccaagtgataggctgtccctcggctctgtttagacgaaactggtcccaccacttagcagcaggaccatgcaactgatgtgaagcaaaggaaaccttctcctgctcagtgcactgaatcaaatctaacttcttttccacagcatgcagccaatcacctgcctctactaggttagtggtgcttgagaaggtaggtggtctcacacgtagaaaatctgccaacttgttctacggaggtggtggttgattgttgttatttgcctgttggttctgcgcttgctgcactaacagattaatcaactcggtttgctgggccaaaacttgggcaagtgtgggatctccttcattgtgaccatttccacttccacttccacttccagtgcgggtgttcaccatctgaagaaaagcatgggcaaaaggaaagaacgacagagagatacccttagaacggagaactttaattaatttaaattctatattgctcttaactgtgtatgattacatttaaattgaattaacactatctcaccagctaacttactctctgacaagcaaaagaactaaactcatgtagttacatcccaccattgatgtaagcaacatgctaaacccacacacggacaagcaatcttaagctagcaaagtaacacagcgaactacagcaacggtctaactagacaactactctcgccttgcgtcagaatgaagagatggatcttcctcctctggagtagctggctctctttcttctaggtcttcctcttcttcctcatcacttaagacatggatgacaggtttagcatgatcaggcacagcgtctcccaccacaccagtcttcgaagctaactggagacgaggtggtggacgggttctcttccttgcggtgaggcgtagcttgggtgctggcggtggtgcttctcccttaagctcagctagttccttctgcagacggtacaccttgctctccaacttacaaatcctgccacggttccagttttccctatcatgagctgctttctcccgctccacgcctactgcatccatggcgctaagcatatacacggcgtgcatcacagtggcactaccttcaccttcgggacagttgtaagttccatagtcttgaccatgaggcttgtgtgggtgatactggaaagctgatgactctaactcctcatcaaagcgatgacgtagctctccaatggccaccaaggctgcttcctgacaagcatggctgtactttcttcccccagcttcaaactttatcgacggaaggtcttcacgatcactagtcaacgtcacgcgaacacgacacttctcctcattggggtcatagggaatctggcaatactcgggggcaacctcgtaacctacttcaaatgccatcattctcagctccctgacgaatcctagcacctcgatcaagtttttcggcggatggggcggcatataaaggaacattgaaaggaaggaattaatgcatatttttaagttagctgcacaaactagacttaattaaattggacccaaagaaaaagaaaataaaagaaaaggagcaaacatgactcaatttttttttctttttggaacataaatcaaccttgaacagagacaaataacttttgacaaatgaataaattaaaactaaaatatttaggatctaccaggagcacggtacagagtcaccattaacagggatgagtagtactgatgccatcttgattgaatcgataccataatagatgtacagtgccgactaaccaatgaaattcagaaaattatactatttaataccctaaacagtaaagttctttttctttcaaaataaaagaacaaatttctgttttgctaaattagaatttaataaattttgtacataaccttgcatgtggtgccaacttaattaatttataagagaatagagaagagcagttctattttccaaaataatttgaaggaaacttaaggtttaccatttggcttgtcctaaggtcaaggtggctctgataccaacttgtcacgcccggaatttctatccaaaattccaaacgcttacatgtgcgtcaaaccctcgtccaggaatcatccgaggcacacaataacaaattgataatagagtactatcaaataattaattaatatgcgcaaaataaattattacagaggtggatagttcctctcaaagaataaagttctacgcagcggaaaaaaaacaaaagactaaacatctttggcgactccactccacaagcaactcgacccgaacaaagcctaatcctcctgatcatcaccttcactgaagcactcctcctctgaagaatgaaaaatggcagaatgagcatatgatatactcgacaagccacacagcaaatatgcaaatgcacagaataacaaaggatggcataattaagctcattggcataaaaagcatttaataaacatttgaaagagaatagtaaaacagttatgtaattaagcaatattaaataaacactatacaacacacccatgttgcataggcccaaccttaatttgaccaaccaacccctaggtgtacaaatcaaacctccaaactaggaaatataccattccaaaccaagagtcaatttagttatcacagtattttcattaatactgagtaatgtgagactaatcacgaaaaacattgttagacccacccataaccgcgggcacggctattcgaatagttttactctgatcagatatgtaccactgtacccacaagacacaactccacaacatgtcagcatgcgcctcagtaccaccacggtaccttggaaaggaactatgacaatacctctcacacaacacaactcaccacattgcaccgttcctgatcataatctccccctcataaccaggggcaatggactccctcgcgacccccacggacttctcgccgcttcacagtctggcaccccgtaatgaatcatgctatacaaaaggtaaagccgttgcccacgctggcttgtggttggcacggtaaatgtttcacaacagtagctcgtgaaacggtccttaattgttatgagcacgaccatcaaaaccatgtactcacaacccactttaatcaggtttatgtatcaattaattatcataacacgattaaccatcgtgagctaccactaaatataaccataagtaatatccttatatgattaaccccattaatgagctaatgtttctaagcatggctaagcaattatacctatatagcacctagctaaaccaaaccaatatataaggtccaagctattcaatttatta

SEQ ID NO: 43746 - DNA, 10718 bp, Oryza sativa
atcttgattttagatgaatttagcaacttgaaccactcgaatccgagttacgatgatttagttatgaatttccgaagtttaatcgattttcaacgaatagaaaaaactaataaaaaggatttatgacgtcatcgatgacatcatcgccggccatggtacggctccacgcgaccaccggcgatagagagctcggttgggctatccggggacacctacgagaagaggacgacgacgcgaactcatcggtgcaagaaactacgacggacgacgatgtacggcgaccggcgatgaggacgaacggcagcgcggctcgggtcgacgacggcggcggcattccagcggcttgcgacgacggcgaaggggtggccgaggtactcctccaccgtgcgaacccggcggcggcgacgctagcggcggtgtggcgcgactggatagtcgccggcgacggcggtggcttgagctacgcggcggcagcgctacgagcaacggcgggactcgggacttggggcaaatggaagaggacgactaggggatgctttatataggcttggattagagagatcggactccaaccgagaggaatcgagctgggaaaaactagggttagttttttttaccaggaaaactgccagggctttgcccaacagtgtaattttataaataaagaaaatatttacaaggttacaaatattacatgcggttcacacagagatactataaggtttgtacccaattaaaaacagtttgctttaaaggttcattcattatgcacatatgcagaagaacttctttgacgaaaagagatctccatgcctgaaaagagggttggatgttctgaaatatgaagccatttctttgtttccagatgtgccaagctgccaaaaagaaaatttccaggaaacccttgtgagcaaatttgattcttgctagagagatcatttggaaaaactccaaattgttattccactcaattcctaggtattgccaacacctgatgctgaaagggcataaaaagaagaggtgcagtcttgtctctctgcagttcgcattgcacaaaacacatgtgagatcatcttctttggtacaatgtcttctatccagcatatctcttgtattaagtctatcacagaacattagccaggcaaagaccttgatcttcatgacacattttgttttccatagccaaatcatgtgtctggggggttgcaatgcagaataatttcttagcagtgtacttatctgagcgccagataaaattccaagcatcccccatccctgattgtaagttcaaggtgtccagaaccccctgaagttgcaagaattctgaataagcctcatccgagagggatagagcaaaagaatcttctaggggtagctggtagacatggccttgactgaatcagacttatacaaagtcacagcaaagagattggggtagctggtgcacttaaaatcatcattccatagatcattccagaaaagggcagttcttcctgtcctgatttcacattttgctatccccctgaatatgtctgcaagagttgtgatgtccctccaccaaaaagaacccttattcatcgtcaggtgtggaactttagaaacatagtatgattgtgagattaatttcacccatggtaaatcagcaccattatagaacttgatcatatgctttaggagaagggctgtgttttgaactctcagattgatcactcctaagcctcctttctccttaggcatgcacaccctatcccaggacgctagagatttccttgtcgaagaagggttattacctctccacaggcaattcttacgagctgtgtcaatgaccttgatgactgtaactggtagctgtagtgaggacatgtaataggttgggatagaggacaggactgagttgatcaaagttaatcttcctccttgcggtaaaaaaattgagcttgccgtcagcctcctttcaaccctgtctaccaatgtagcaaatcaaccactctaggcctggtggttcctaaaggtagccccaaataagtgaatggaagagaaccgatcttatatcccaagacgccagataataagatagctttgtcttgagacatattaagtggatacaggcttgatttattatagtttaccttgaggcctgtggattgagcaaacatatttaaaatagccttgaaacagaagacttctttctgagatacttttaacaagatcaaagtgtcatcagcatactgaatgattgggaaaccatcctcactgctttcattaattggttttgacaaaagtccttgatgaaaagctttattgattattctttgcaacagctctgcccccaagacaaaaagcagaggtgagagaggatccccctgtctgactcctcttctgcatttgaaagtattccctggcaccccatttaataacacagcagtagaagcagtagagaaaaccatctgtacccactcaatccattttggagaaaaacccatatgttgcataactgagaaaattgcagaatgctcaatacattggtgaatatattcaaaagaccaggtaagacaatcctgtatggtttttcctttgatgaaaccatattggttatcactcaccagtgtaagaattaccccttgaagtctatcagctagcaatttagttaagattttaagactgatacccgtaagggaaataggtctgaaatcattaacagtctctggggaggttttctttgggaccagggttatgaaggaggtattaaggatttccaaatcaacatttccgtcagtcgataatagtcctgagctatgataggccaacactttttcatgaaaaatccattgaaaccatctggccctggtgctttgtcagctggaataatagagatgagactatctacttcttgagttgaaaacatgtcaaccaagctactcaagtctatatgtctgccaaaaagggagtccaagtcaaaagccatctgtggggaattagatacactcaacctattctgaaagctgcgatgaaacaatgaagccttctgctcatggagatgtagaatctgtccatcatgatcaagcacctatgagatagtgtttattcttaacctttctatggctattgactgaaagaattttgtattttcctcccccaacatcatccatctactagtacacctctttttccaatagatcttcctgaattccaatagtttcaaaatctataccttaactatttctctgaaattccactcatagactgatagcattctgttttcttcaactaagtcaagaaagtccactactttgttccaattttttagcaatcccatcaactttgacagattcttactccaggcaaggagctttttcctaagcactttcaatttgaaagaaatgcaaactagggttagtttggagagataaactcaaaacgaattcgatttggttgatccgggcaaaattgatctccgaaactctaggggaaaaggaggagatgatttcccctcaagcaatcggactcgggggcgaccggttgaggaggaatcggaggagaggctgcggcgctcgggctcagctcggcccggccggaggtaggggatgaccccgacatgagggccccatatgtcgacggctagaggagaggaggggcggctcagcttggattgggccggcgtgggccgcacggctacgcgcgagggagagtgatgttgggccggaaacggcccaacgggctaggggaggattttaaagactttttcaattaaaataattcgtgaaatgatgtttcatttattaaaaatacttcccttgctcaaataattcccagaaaaatctagaaaatagataaacaagcaaagtatttaataaaattttatctagctcaattttatgttgaaatttttcctagattattagagtttaacttgtaggttttaaaataatttctaaaaatgcattgaaaactgaattattaaattaggctattttcagggcgtgacattgatatagtttaaacatgtatgttaccgaatctttaattttaggacccgacaaggtgtgtgggtgggggcccctgcgatttgggagcctagagcggctgtaccgctcccccccccacaccaagcttgccctgactacatgggccttgaaaggccacatggcatcttatgacgatttctgggcttgatggcgacgaaaatggacgtcatagactctatgacgacagaaggatcgtcactagattagtaacaaaaagataagctttctttatagaacgccattagagacgcatgataggtaacgaatgatattcgtcacacgaatgtcatagatttcacaacatggtgaatcatctatatatgggcctatttgtcgtctaaatacctgcaaacaaccttggtgaatcatctctttgatcgtaaattatattttcaaagagacaaagaaagagagagagagggagttaaagtccaatcttgtcacaccctgaaaatcccaaatatataaattgttgtttaattagaattattagaaataattttaaaagcctagaagagaagatctaattttaaataaaaaattccaatataaaagtgggccagataaaattttattaaatacttctcttgattctatagttcctagatttttcagggatttatttgagccaaggaactatttttaataaatggaattgcatttcatgaataatttaaattgaaaaagttttaaaaatcctccttttggctttgggccgaaagttggcccaaaaccctttctctctctccctcagcccagtcggcccagtcagcccgcagccacccgcgcgcgcgccctcgcccgctgacaggtggggcccacctgtcaggcttcccgagccgcgccgccgtctccttccaaattcgatcgcgtctttccttctccggtcgaatcaatagaggggaaatgatctccgggacctcctctaccttttctcttttggaatcatcgtctaattttgtttggaaagcgccagattcgatctcgaatcggattcctctctctctcccgccgaaccctaatttttccatcgccgtcgccggcagccatgggcctccaccgccgcccctagcccctttataagaacccccgagacctcctctccacgctgccaccctcgccttagctcgcgccgcctgtagcgccgcctccgcgttcaaccgtgcgccgccgtcgccgccgcgagttcagccgagcaccgccgtcgctccagtcgtcgtcgtcgctcgggaaggacaccgtcgggatcaccaggtcatcgccgaggatcgccggaagaccgccgtcgtcgtcaagccgaccgtcgccgccgcttcttcctcgtcgtcgtcgtcgtccggtcgccgtccgccgccgttcgtgcctcggtaaggatcgccgcgtcacccgctacgtgtagatgtcctccgtttgcgccgccgcgccgtcgttcgccggtgagcatccgtgtccgagccgccgccggtgatgacatcaccgctgatgtcagcgctgacgctagcggtggaccgccggtagatcgataagatctcggccgttcgttttggatagaatatatctcggccgttcgtttccgtagaccgccgccgtgcacccggtccatcgatgcacccgagccgctgacgcaataatccctttttccttttcaaaaataattcattattgcgtcataattcaattaaaatctatataaatgatttaatccgatttaaactttgaaaattcataactaattcatcttagctcggatttagttggttcaagtctctaattttttctaaaattgagatctacgtgttaaaaatatccgcatgtactgttcatgcttgtttatgtgctgttttggtgattttgctcttttctctttagattccgacgttcccggagagtccgaatttgcaggagaagactttgaagagttccaaggccagcaaggcaagtcacacagatcccaaacaaccctttgagcatgttgatcccgtttaaagctattgtttctattcaactatctacctctgtaatgacattatattcacttattaattagagttataattgtactctattatcaatttgttattgtgtgcctcagttgattcctggacgagggtttacacacatgtaagcgtttggaattttggataaaaattccgggcgtgacaagttggtatcagagccacctagaccctaggttatgccaaatggttaccgatagaagccctctaaaaatattggaaaagtagaactgttctcctctctttctcttttaattaaaccaaactaatggcacatgcagtttatagtctcttttaatggttctcattcaaaatttatttatgattcctgtgttgttagtactgtacatctattactgtactaatggcccatttaccagcaaaagtttcacaacattgatttatttaatcttgctgcaatgaaataagcttagcatgttgattttataactttcttttattttatttcttttgaaactcgttattaaaaagtgcaaaatttctaatcatgttttcaactgtttcaacttatcttgcaagattggtttactttatttatttaccttttactttgattttctaactttaatttaatccaaaaacttgtgctattaattggataaatgtcttaactctgtcctttcacttgtctttagatgccgcgctacaagcctgagtacttgtttggcactaagggatttgtccaggagttgcgtacgatgtcctttgccataggatttgggactgctcctttgtatgcccagattcctcatgatcgtgatgaagagaagtgccgtgtcaaagtcaccttgaacagtaatcgtgaagatatcccatcggtgatgttcgaggctggttggggaagctacattcatgcttgtcaggaggtggcaaggatcaccataggagagctccgcgaaagctacaatgatcggttggccaacactaagtatcgctaccatcctcgccaaccccagggaagcgatcgtggcagctaccttgaacctgcagggattgagaatgatgctaccacaaggcatttggttgagatgctgtgggccatggatgagacccgcgctgagattgtgatagcagctcaagatcgtgaagacaggaatcgcggcaagatctgcaagctggaggacaaggtggatcatttggagaaggaactagccgcattgacgggagaagcaccaccgaaaaaggccagggtttgtcttaccgcaaggaagagagctctattcgttcctcgctaccagttggcgccaaaggttcgtgtggtggaaaaagaagctaccccagccccagcggatcctccggtcgtcaacgtaagtgatgatgatgaagaagaatccaagcgcacccatttaaaggtcgagtggggagctactcaagatgatggggacgcgccgaacgagccttcaatcaactccgatgcccggaagacctagaacgccttgtcaagccgttgccttagatcgttgtgttagtttgcttgtttaagtttggttgtgtgtgtgggtcttgcatgtgatttacatcattggtgggatgtaaatgcatgcgtttgtttgctttcgagtgattaggtagttggtgagttaagtggtgtgagagtcttcagttttgtaataatgaaactcagttaagatcaataaaagtcaagctagtaaaaaaaaattaatttcctgtcctaagtagttttttcccctgtttctctttttgtgctcctgtctatgccagatggtgaatactcgcagcactgggaatggccccaacaacaacaacaacaacaatggagagaatcccacgcttgcccaagtcctggctcaataggcacagcttatgaatatgatgatgcagcaactccagaaccagcagaaccagggaaataaccatgcacctccccagaacaagctagcagaatttcttcgtgtgaggccgcccactttttctagcactaccaatcctgttgaagctggtgattggctgcacgccatagagaagaagttggacctgcttcagtgcactgatcaagagaaagtctcctttgcttcacatcagctgcatggccctgcctctgagtggtgggatcacttccgtctcaacaggactactgctaaacctatctcttggctagagttcaccgctgcttttcggaagacgcacaaaccatcgggagtggtgtctcttaagaagaaggagttcagagagctcactcagggatctcgctctgtcaccgaatacttgcatgagtttaatcgccgggctcgctatgctccggaagatgtatgcactgatgaagagcgtcaagagaagtttctggaaggactgaatgatgagctttcttacccattaatgactggggattatcatgatttccagaagttggtgggtaaggctattcgccaggaggacaagtacaaccgtatggagcagaagaaacgcaggattgctcacttcaaagctcagcaggggaatagtcagaggccgcgtcttgcttagggacctcagtcagtacccagggaggttcttcgtctgttgttcgtccgcagcgtcagttcttcaacaacaatgctggcaacaacaaccgcaatcaagctccacgtccggtggcaactccgacacagcatcagcttgccaagagggagcaagggaacaagctcggagtgtgcttcaactgtggtgaaccaggacattattctgactagtgtccgaagccccgccgcgtgaaggttgtccctgcccagaacaactcctccgcaccagcgacaaaggctcgtgtcaaccatgttgctactgcagaagcccaaggtgctccagatgtgattttgggtacattccctgttaattcagttcctgcaacagtgcttttcgattctggtgctacacattcctttttatctatgagttttgcaggaaatcatgggatggaagtagaagatcttagacgtcctttgatggttagtactccgagtaaccaagcactctcatcgcaacgtagcccctctgtcagaatagagattcaaggagtaccatttctggccaaccttattctgttagaatccaaagaccttgatgtcatcctagggatggactggttagccagatataaaggtgtgatagactgtgccaatagaaaagtaactctcaccagcaatgacggtgaagttgtaactgttcatgcattgtcctctgaacctctaaggtcaagtctgaaccaaataacgttggaagagattcccatagtacgggagtacccggatgatttacctggtatgccgcctaaaagagatatagaattcagaatagatctggtaccaggaacaactctgatccataagagaccttatagaatggcagccaatgaattaacagaagtcaagaggcaagtagatgatttgctttagaaaggatacatcagaccaagttcgtctccatggggagctccagtcatctttgtggaaaagaaggaccatacccagaggatgtgtgtggattatcgtgcactaaatgatgtgaccatcaagaataagtacccgctgcccagaattgatgatttgtttgatcaacttaaaggtgccaccgttttctccaagatcaatcttcgatcagggtatcaccagttaaggattaaaaaggaagatatacctaagaaggcttttaccactcggtatgggttatttgaatgtactgttatgtcttttggacttactagtgctcccgctttcttcatgaacttgatgaataaggtgtttatggaatacctagacaagttcgtgctggtctttattgatgacattcttatctactcctgaaccaaagaagagcatgaagaacatcttcgccttgcactagagaagctacgagaacatcaattgtatgccaagtttagcaaatgtgagttttggttgtctgaagtaaagttccttggtcacgtcatctcagccggaggagttgccgttgatcctagcaatgtggaatccgtaaccaactggaaacaaccaaagacagtttcagagattcgcagtttcctgggtctcgcaggttattaccggaggtttatagaaaatttctccaagattgctaagcccatgacacgactgcttcagaaagacatgaagtgcaagtggtcagaagagtgcgagcagagttttcaagagttgaaaagtcacctaatatcagcacccattttgattttgcctgatctaaagaagggtttctaagtgtattgcgatgcatctaagcttgggttaggttgtgttctgatgcaagatgggaaggtggttgcctatgcatctcgtcagttacgtccgcatgagaagaactaccctactcatgatcttgagttagctgcagtggtacatgcgttgaagatttggcgtcattatcttttcggtactcgtatagaggtgtacaaggatcacaagaatttgaagtatatctttacccagccggatctaaacatgagacaacggagatggttggaactgattaaggattatgacatgggaattcattatcaccccagaaaggctaatgttgtagcagatgctctcagcaggaaaggctactgcaatgctacggaaggacgacagttgccatgggaaatatgcaaggaatttgaatgattgaatctgggaattgtcagtagaggtttcgttgcagccttaaaagc

SEQ ID NO: 43747 - DNA, 8264 bp, Oryza sativa
cgaaagtgtcgtacgccgctcttgtgggatcaaaccggtgagcgtcaagtatttgggacagacatattgcgagaggcagaagaaaaagtgaagattatccaagaaaggttgcgcgttgctcagtcacgtcagaagagctatgccgacaatcgtcgcagagatttgactttcgaaggagattatgtgtaccttcgggttacgccgttacgaggtgttcatcgtttccagaccaaagggaaattggcaccgcgtttcgtgggaccttttaagatcgtaagtcgaagaggtgaagtagcttatcagctagagttgcctccgtcaatggcgggaatacacgacgtgttccacgtgtcacagttgaagaaatgtttgcgtgtacctacggaggaagcagatccggaacatatagagcttcaagaagatttaacctatgttgagaagccagtcagaatcttggaagtaagtgagaggaataccaggaatcgcgttatacggttctgtaaggttcagtggagcaatcattcagaagaagaagccacttgggagcgagaagatgaattaaagtcagctcaccctcatctcttcgccggttcttctgaatctcgaggacgagattcccaagttaaggggggcatatatgtcacgccctaaaaattgcctaatttaaaaatacattgtttaagtcatttttagaaattaaattaaaagcctacaagctaaacccaaattatctaggaaaattttcaacataaaaatgagctagataaaattttattaaatactttgcttattcctctatttttaagaattttctgggaattatttgagcaagggaagtatttttaataactgaaacaacatttcacgatttattttaattgaaaaagttctaaaacccctcctttaagttgttgggccatttttgccccaacatttcttcttcccgcgctgccaagccggcccaaagccggccgagctggcccaccagcccaccgagccgccagcccctctcccctcacatggaggctgacaggtgggacccacctgtcggtggtgtctcccacctccagccggccggctgtgcaagccgagcccgagccgagcacgagcatcgccgtgccacctccaatcccaccccaaaccggccccgattcttccggatttttgaggggtttttatcctctcattctcctctatctatccccccaaaaatcggagcaaatcgttgagtattttatcagaatcgaactcgttttcgagtttatctccaaaaccgagtttttgatttcccaagtcgatttcttgcgggaggagtccgatctcttcaatccaaggctataaataggaccccctagtccttctctttcgtttgccccaactcccgtcctctcccgtgcctcctagccgccgcgccgccgccgctaagcttgccgccgccgccggccatctccggcgccgccgcccagccgttgccgccgtcgccgccgcttgccgccaccgcctttaggtgcgtgggagcgaggagaagctcggccgcctcttccccgcagccgccggccgccgtagcccgccgcccccgtgcaagccgagccgccgccgccgccccttcgtcgccggccgccgtcgtgcgtcgttcggcgtgtaggtgagcaccgtcgggttcgtctcgtcgccctctacgtgtccatgtgctccaaattcgcagccgactgctctagctccggcgaggttgccatcctagccggccaccattgatgatgtcatcatgacatcatcggtttttctttttcccgattttctaatagattaaatcttcggaaaatcataactaaataaccgtagatccgtttcaggtggttcaagttgctaaatttttctaaaatcaagatctacatgttaaaaatatccacatgtactgtttatgcttgtttttgtactgttttgttgatttttgtttaattgctttagtttccgacgtttcggaggagagcgtttccgttgaggatggttccgaagcgtttgcggaagcccaaggcaagtcgcacagatcccaagcaaccctttgagcatgttgaacccgtttaaagctattattttatttcaactatgcattgttttcgaatgtcatcgggtggtgaaccttttccaattaattaatggcctacgatgactttattttcctatgggttataatttgattagcatgaaccttatatattggattggttcagctaaatgctatatgtaagtttgcttagccatgcttagaaacattagctaactaaaggggttaaatatagattataatatactatattattattattaattatggttatatttaatggtagctcacgatggttaatcgtgtgaggttaattaatggataattaaaacttggttaaggtgggttgtgagcatatggttttgatggttgtgctcatgacaattaaggaccggtttgcgagctactgttgtgaaacatttaccgtgccaaccacaagccagcgtgggcaacggctttatcttttgtatagcatgattcattatagtgtgacagactgtgaaacggcgagaagtccatgggggtcgctggggagtccattgcctctggttttgagggggagattatgatccaggaacggtgcactgtggtgagttgtgttgtgcgaggggtaatgtcacagttcctttccgaggtaccgtggtggtactaaggcgcatggtaacatgttgtgggattgtgtcttgtgggtacatgggtacacctctgatcagagtttaatctattcgaatagccgtacccgcggttatgggtgagttgagcaatgtttttcgtgattagtctcacattattcattactggtaattgtgttaattaatgtgattcctggtttggaggtttaatttgttcaaccggggttggttgttcaaatgaggttgggcctatgcaacacgggtgtgttctatggtgtttatttaatattgattaattatacaactgttttactattctcttaagtatttattaaatgatgtttatgcaaatgaggtatattatgccatcctttgttattctgtgcacttgcatatttgctgtgtgacttgttgagtatgtcatatgctcattcttacaatattcaatcatcagaagaggagtgcttcagtgaaggtgatgatctggaggattgagcttcttcctggttatgatgcctgtggagtggagtcgccatagctgttccgtagtttgctttagttttttttctgctgcgtagaatgttattctttgagaggaactatccacctctgtaatatttttttatttgcgaatattaaatagttgattatttgtactctattatcaatttgttattgtgtgcctcggctgattcctggacgagggtttaacacacatgtaagcgtttggaattttggatagaaattccgggcgtgacaagttggtatcagagccaccttgaccttaggacaagccaaatggtaaacctcaagtagccttcaaaatattttgggaaattagaactgctcttctctattctcttacaaattaattaagttggcagcacatgcaaggttatgcacaaaatttatttaacttaattccttttcttttgaaagcaaaacgttgttcttctcaaaatgtttcttatttcgctttattaaacttcattgattagtcggcactgtacatttattatggtatcgattcaatcatgttagcacaagtactactcatcccttttaatgatgatactgtaccatgcttatagtaggtcctaaatattctggttttattttatttatttgtcaaaaattatttgtccctgtttaaaaagttaaattctaaaaatatatatataatagcttagtatgtgtcttttcttttatttttcttcctctttggtcaaatcagttaagtctagatggtgcagctaacttaaaaatatgcattaattcctcccttctatgtttctttagatgccgccccattcaccgagaaatttgatcaaggtgttaggattcgtcagggagctgaggttgatggcttttgaggtaggctatgaagttgctcctgagtatcgccggatttcccatgaccccaacgaggagaagtgtcgtgttcgtgtgacgttggctagtgatcgtgaagactttccgtcccttaagttcgaagctggaggaagatcgtatagccatgcttgccaggaagcagctttggtggccattggagatttgcgtcaacgcttttaagaagagttggattcatcagctttccagtatcatcctcacaagcctcatggtcaagattatggaacttacacctatcctgatggtgaggagagtgccactctgatgcaggcggtgcatatgcttagttctatgtatgcagtaagtgtggagcgagacaaagccgctcatgacagggaaaactggaatcgaggcaagatttgcaagttggagagtaaggtgtaccgtctacagaaggaattagctgagcttaaaggagagacgccgccgccaacacccaagcttcacctcaccgcaaggaagagaacctgtccaccacctcgtctccagttagcttcgaagcttcgcgtgatgggagatgctgtgccagatcgtgctgaacctgtcatccacgtcttaagtgatgaggaagaagaggaatacccagaagaaagagtgccagctactccagaggaagaagatccatcgcttcgttccgacgcaaggcgggattagtcgcttagttagatcgttgccgtagttcgctgtgttagattgcttgtttaagtttgcttgtgagtgtgtgggttttagttgttgcttacatcattggtgggatgtaacagcatgagtctagttcttttgcttgtcagagtgtaagatagttggtgagatagtgttaatgcaatttaaatgtaatcatacacagttaagagcaatatagaatttaaattaattaaataactccgttctaagggtgtctctctgtcgttctttcctgtgtttgtgcttatcttcagatggtgaacacgcgcactggaagtggaagtggagctgctaacaatggaggagattccacgctagctcagattttggcccaacaaacacaactgatcaatctgttagtgcagcaggcacagaatcagcaggcaaacaaccagaaccagaatcaacccccacctccccaaaacaagttggcagatttcttacgtgtgagaccccctaccttctcaagcaccaccaatccagtagaagcaggagattggttgcatgcggtggagaagaagttggatttgatccagtgtactgagcaggagagtttcttttgcttcgcatcagctgcatggtcccgctgctgaatggtgggatcactttcgccaagccagggctgaaggagaacctatcacttggcaggaattcacggccgctttcaagaacacgcacataatgacaggtgttgtagctctgaagaagagagaatttagagcgctcaaccagggatctcgttcggtcactgagtacctccatgatttcaatcgtttagctcgctatgctccaaaatatgttcgcaccgatgaagaacgtcaggagaagtttttggagggactgaatgatgagttgtcttatgctttgatgtctacggatttccgggatttccagcagttagtggacaaggctattcgtcaggaagacaagtacaatcgaatagagcagaagaagcgcagggctgcccaatttaaggctcaacagggcagtaaccagaggtcgcgtctcgttacgggacctcaagctacatcataccctcaaggaggatcttcgtcagttgctcgccctcaacgccagttctacaacaacaatactggtaatcgtggcaatgacaaccgcaacgtggtcgctcgtcctgcagcaactccagctaagaaccagcctgtcaggaaggaacagggaagcaagccaggggtgtgcttcaattgtggtgatccagggcactatgctgataagtgtcctaagcctcggcgtgtgaagaacgctccagccccgaacaactctaatactccagcaccgaaggcacgtgttaatcatgttgtagcggcagaagctcagaatgcaccagatgtggttttgggtacgtttcctgttaattctatacccgcatctgtgctttttgattccggtgctacacattcctttttgtctaaaagttttgcgagcaatcatgggatggaagttattagtcttgggagacctttactagttaataccccaggcaatcaagtatcttcgacacagtattgcccttccgctactatagaaatagaagaagttcctttcccatcctctgctggaatccaaagatctagatgttatcttagggatggattggttatctcgtcacagaggagttatagattgtgccaaccgaaaggtgaccttaacctgtagcgatggggaaaccgtttctttctttgtgtcctctcctaaatctcatggtgtgaccttaaaccaagtcgctctacaagaaatcccagtagtacaagactactcagatgtgtttcccgaggatttgccaggtatgccacctaagagagacatagagttccggatagacttggtccctggaaccaaccctatccataagagaccttacagaatggcagctaatgagttagctgagataaagaggcaggtggatgatttgcttcagaaaggatatatcaggcccagtacttcgccgtggggagcaccagtcatctttgtggagaagaaagatcatactcagagagtgtgtgtggattatcgagcgttgaatgaggttactatcaagaataagtaccctctacccagaattgatgacttgtttgatcaactggaaggtgctacagttttctccaagatagatctccgttccggataccatcaacttcgaatccgtgaggaagatatatcaaagaccgcctttacaacccggtatggtttgttcgaatgtaccgttatgtcatttggactcactaatgcccggcctttttcatgaatctgatgaacaaggtgtttatggaatatctggataagtttgtcgtggtgtttattgatgacattcttatttactccaagacaaaagaagaacatgaagagcatcttcgtctagctttagagaaactacgtgagcatcagctctatgccaagttcagtaaatgtgaattttggttgtctgaagtgaagtttcttggtcatgtcatctcatccggaggagtggcagtagatccaagcaatgtggagtcagtgttaaattggaagcaacccaagacggtttcagaaattcgtagtttccttggacttgcggggtactaccgcaggtttattgagaacttctcaaagatcgccagaccaatgactcgtctgcttcagaaggatgtgaagtataagtggacagaagattgcgagcaaagtttccaagaactgaagaaaaggctagtgactgcgcctgtgttaattctgcctgattcaaggaaaggttttcatgtgtattgtgatgcatcccgactcggtttgggttgtgttttgatgcaagaaggaatggtggttgcctatgcatctaagcaattacgtcctcatgagaataactacccgacgcatgacctagagttggcagctgtagtgcatgcattgaagatttggcgtcattatcttttcggtaaccgtacagagatgtatacggatcataaaagtttgaagtacattttcactcaacctgatttgaacatgcgtcagtgaagatggttagagttgattaaagattatgatatggaaatccattatcacccgggtaaagcaaatgttgtagccgatgccctcagcaggaaaagctattgtaatatgtcagaaggtcgacatctaccttgggagttatgccaagaatttgaaaagctgaatttggggatagtcagcaaaggttttgtggctgctttagaagctcaacctaccttgtttgatcaagttagagaagctcaagggaatgatcctgacatccaagaaatcaaaaagaacatgagaagaggaaaagccatcggttatgtagaagatgagcaaggaactgtgtggttaggagaaagaatttgggtacctgataacaaggagttgaaggataccatcgtgaaagaagctcatgaaactttgtattccattcaccctagaagcactaagatgtaccaagacctaaagcaacaattctggtgggctag

SEQ ID NO: 43748 - DNA, 957 bp, Oryza sativa
ttatactccattgaccctggtagtactaagatgtaccaggatctcaaggaaagattttggtgggcaagtatgaagcgtgagatcgcagaatatgtagcggtatgtgacgtttgtcagcgagtcaaggcagaacatcagaaacccgcaggtttgctgcagcctttgaagataccagaatggaagtgggaggaaatcggtatggatttcatcaccggtctacccaaaacatcgtcgggccatgactctatttgggtgatagtcgactgacttaccaaagtggctcatttcatcccggtaaggaccacctattccggaagttgtttagcggaattatatatggccaggattgtgtgtttgcatggggttcctaagaagatcgtgtcagatagaggtagcaagtttacttcgaaattctggaataagctccaggaggagatgggttccaagctgaattttagtaccgcttattatccgcagacagatggacagaccgaaagggtaaatcagattttggaagacatgttgagagcttgtgctttagacttcggtggaagttgggataagaatttgccttacgcagaattctcgtacaacaacagttatcaagctagtctccagatggctccttacgaagcactgtatggtcggaagtgccgcactcaccggtgcaagaaactacgacggacgacgacgtacgtcggccggcgacaagctccgacaacggcaccggcttggctcgacgtcgacggcggcgctgcggcggcttgcgacggtggcgaaggggcggccgaggtgatcctcctccgcgcgaacccgacggtggcgacggaaggcggcggcaacggctacaacggcggcgcggcgtggcttaaaggcattatctacggcagcggctagggctacgcgccggcgacgctacgggcaacgatagagctcgggacttgaggggaaacatag

SEQ ID NO: 43749 - DNA, 742 bp, Oryza sativa
tacatagactttgactatgagcatagttttggattggtgccactgaaatggtgttagttaattgaaatacactgaatggtggcctgtgggtgtatggttttgctggtcgcacccatggcaattaaggaccggttcacgggaaaccctaggagacttaccgtgcttaccacaagcgggagtgggtaactgcttgatctgaagtatagctcgaccctttcctagtcaccggtggcgagggtgggcgtgatggagttgggtcggccggggtgtctggttgtccagctgccggattcaccgcggcgcaagaggggaccgcccactgccttttgaggggtgggggtgaaaccttagcatggtgtggatggttaggggagggttatgcggagggtcttgtcacgattttcccctttgcagtatcatggtgatacttcggggcatggcgacatgtgtggaatcgtgtcttgtgggtacagttgtacacctctatccagagtaaaactattcgaatagccatgcccacggtaatgggcgatcaaccagatttaccgtgattagtctcaccctagtttagcttaatgaactggtgtagttcaggtggttggttgggcctgttgcaacgtggtgtagtgttggatagtgattggttaatattgattaattactacaactgttttactgctttcaactactgctttgaaatgtctgctttatgcaaaagtacatttagcctcctttggatata

SEQ ID NO: 43750 - DNA, 30977 bp, Oryza sativa
ccccagctcgagtaccagcatggtggtgcctatctgcttcacgaatccccttttcttccgacggattaaggttccatctcaagctcctccgtcctctgcccctcctccacacggcgccctttcttgtaattagttcaagtgttgctgcttgcgttgcaacgagttgtagagttgcttgcgtatatatcaacttttcctgtagaaaaacatcccagttattaatttactcgttattattggatactagttgagtttattggatactcggtattaatttactcgttattatttacatcccagtttttcctgaagaaaaacgagttgtagagttgcttgcgtatttttctcgttattattggatactagttgagtttatgattttttttttgcatttactaattttccatggcaattcctgtccaacgttaacttggatgggagctctccttgtcgacaatttggacaatccttatcaggagtaggttttttttaaaatataaaaaagaacaaaagttgattttagtgaacagcattacgtatattcctataaatacaattgcagcttgtatacaattatacaattgtgttgatcaatcatgaacatcttgatctggacattctacaattgaatatggtactccttccatccaaaaatatcccaaaatataagagatcatatgattgttttaagtattaaatgagcctcattagattagattcactttgaaatatgttgttattgttttcaaacttacaatagttgacttaggataaatctagaatctcttatattttttgacaaagagagtgtaaatctagtatctcttgtattcagcacggtgggagcaatttctagataaagataacgacttctttttccttaagcttcttctaaccataataaataggtgatcataatttttgtattaggaagaaaattgacagttttggcttgctttcgaatctccagcactgcagcgcacaagtaccccttcgagaattcaggggccattgtacaggcaggtaccgctaaatagatttaagtcaattttccaaaaggaaaaggagaaaatttagtaggtcagtactggacagcggtcgatatagctgataactggataagtgtcattccaccagcaggccgctagtttttctcaagcggaaaacaagggcaaaacatcccaacgaggacatgagagcacgaccttcaccaagatacccaactggctttcttaatcggcgacaatacggaagctttgcaattatccccttataataggctttaaaaatgcaagaaatatatgatgattattgctaataagatacacagattacgtaatctatccaactagccatagaatattgtaagcgtgtgatttcacaattctctcccttcttcagtcactaatatttgatattctgagtacgaagacaacttatatgatgaaaagagaatacatgctgtccaaatttcttcatcttttacatggttaacatttacaggtcaggtggattccgatgaaggcaaatgaaatagtagctgataagctagtgcaacaagatatgatctgagggctaaaaaaataaaaatatacttgtcataacaacactcatgtttgttaccaccgagatgccctaacatatttgctttgcaaaacctctctctctctggaagaggcaatcataactaatgtactttgtttctaactgtttgaactaaataaaagtcatgagttctaaaaaacgagagaaacagaccaaagcaaaagcaaaaaaggaggtggcaagctattgagaatcttgaaagccacatgcctgcaaaacggatagatgggcttcccaactttgaagatgctcgagtgaacctagcttttttagaggagtgaacctagctaggtattactgaacagataattgcaaaaaaagttgatcacatgtagttctattactatcttttagacaacactcagacgaggttattaagaatgaattgagtgcatccaatctgcttacaaggccgtctgaacttccaggaggagtgcaatccaataataagccagtacaatccccaaataacattgctgcattgacaggggactgaatgatgaaaattctagatcatgagaaacatgacctgctggtgaatggaaatggggtatccccagttcgaaaaatgccatattggtgacgcaccatatgctgttacgatctgcccatgttaaggtgatacagtgatgacctccacatcctgcatgctagaattcctgacagaatactggaatgtccatccgtggcatgccccagcatgcactcctttcttgttaattgcaaatacagcaccaacaaagtccgggtacttgcgggcaattcttaatatagcatccatggcagcatcccgaggctccatccctcgtcgcatgctctctactacctgataactatagcaaatataagaagattacatggagcatgaggccatcagtaaactcagcctatcaataaaaatactaacgccagactacatgatgcaagggctaatctttagaatggatggggaatattgttatagttgaatgtcaatgatatcatcatcccctaggatgcaaatatcaatataataatatagagaacaaaagatggttgggtatctctcttacatttaaaaagaaaaaaaacttgctaggaagaaacttatagaggtgcttataaacttgtaaggaaaaaaagtctattttactccctcaaactatttcattggatcattccaacctaggtaagcaatgataaaaaaatctaaaaaaaaaatattgagatgtaagttgtgatgcatctcccatcatcctacagtactaaattccagtgcgaaatacaacttttacagggagaaacaaaaaagagaaatacccttggggagttaagtgctcccgggaaatactggaggagtaaaatggacttttatccttctaagaaaaaagtcaaaaatactaatttatttttccattaccacggaaggaagcgcatcataatatcaccatcaccagttgctccacatgcaccaacttcatcatcagcatatgcagaagatcctggtattggtccatcacctaccctggaaccaaatgatcagacaatgctcagtgatacctaccaagagatgaaacagcaattccataatgattaaaaaccatgtctagctatcaaatccattttgagagtcaagatgtcacgaaaaaaaaagtagacctgttaatcacatatataaaccccatcattaacaaggcaatgaaatttctgaccatacattagcattttattagttttttatgcagacatgcagaagattaacaacaacattcaccagtgactttacatatacaaatacagcataaaaatactaagaaaaatatatttcacggtcggaattgtgagtcttgtcattaaccatggaaaattgaattagatgatgaaaatagattatgccagagtacacaaattaaagtgacatgaaaccactcaaacgtgagaaaaatataaccttaaataaaaataaaaggctccatgatagatggtaacatgaaaacaccaaaagcgcaaaaatgctcaccttcctggaattttgaatgtagcaccattggtcgatgtgccagccgctatgcgacccatcttgacaaagtcactgttgttagtttccgatgaaaagaaagtcaatttattttggatgggctatatgcctatataccttgtcaatcacagccatagagattgtatcatggttgtggcgattaacgatttttagacgggagttcattggctccagtaaattattaggttcaaataatccttgacaaatgtccccctgagtccgctctagcacacgtttggcagaggccttagactcccctgatggtacatcaatagcattgtacgggccacagctaccagcaggaacaacatttttccagaagttaggttgacaatggttctgtctccaaattgtccattttccgatagactccggtgagctcagatcagctggccccacaagtcccattgaaatcgcaaaggatgttgccttctctccaacaagaagagtatgttcagtatggtccataaccaactttgccgctctgattccatcctttacatatctcatggcagcgacagctccgatttccattgtggtctgccaattttcttaagcaaaacaaatgcaacacattatacaccaagaatgctgcaacagaaactgcagaatgctcagtgggctgtggcatgagtatgtaaaaaagctgttaccccatccatgatgagagcatctaatgtagtttcaccattctcatctgggcttccacctgggccaactgcatgaaatgtaaaccatttaaaaccagtactatagttgcttcatgaagctaactgaaagtagtcaagtttttgaactgaataaggtccaagggattcaaccaaaataggttttgcaagatctatattattgggtttaaagcactgcacagtaagacaaactagaaattattattagaaacagaggaggcaaaccccaattcgatattcttattcaaaagtgaaacaagaaatacaatgtattttctgtgtattatatttcagtgcaaataattatgtgcaacataataggaactgctgataatgtcatcttcacgagttcatgatgaaagacaggaaaaagattgtaaaaggtgcttttgtagttcggtaagcgcgatgcaaatatgttatatcgtgtttcaatcaaaactacacatattctgcctgctgcctgaaaatagttgttcatcagaattgtttttttttattactctcgtcaaacatcacttatctaatggaagccaggggtgaaattcctccaagtggaaacgaaactcttcttgaagtttgttatcgcagtttttgacccaaccaaccagattagtgtatcagcactgagcacattgcatcaccactgttcccaattaaactcagtgaactactacaatcaatcccacaccccaggttgaatacaactgacctgtgccatcacagcggagcacctcgcaggcggagcagccggcgacgacggcatccacggccgaacaacctgcgccgccactggctgacaccacctcccaggccgccctgaccgcctcccggaaaggccaggtgctcaccaccaccggaaaaatccctcccccttcctccgcgcctccgccgtcatcagccaccgcctagtcaaatccccccctccccccaaaccccccattaaatccatcacatccccaatccaaacatcacggaaccaacctaaatcgaatcaacactcaccaagcaccagctgaaccgtagcagtaggaaccctaggagaagaagccgcgcgtagctcctccgtgaccttcccatggaaagctgcgatttcgcggcggggtttggttgttctacggtggcgtgagtcccttcgagctcacccacatgtcagtggcctggcttggtcctcctcttccacatgggtcccacatgtcggtgaggtttcgtggttgtttaggttgttgtttcactcgctctggctccgaggcgctccccccccaaataccctagcggcggcggagatggaggaaggcggcggcggggaggaggcggagaggtggccgtggtgggcgggggcgagcgcggcgcaggtggcggcgggcgtggcgtggttccggcggggcaggggcggcgcggcgttcgcgatgccgttcaaggcgttcgccatcgccaccctcttcgtcggcgccggcgccaccgccgtcaccgccggagttctcgcggcgggcgtcggatcggtaagacgaatcctccaaaaaaaaaaaaaatctcacagatcgcaccatgtgactactggttttgcactaatgtgttccgtgactccgcgtaaacgcaggtggacgagatgaagggcgtgggcgcgagcatccggaggtggatgggagctcctccacgacgccgagtggagggaggaggagacccatgaccagcacaacgctagtgcgtgttcaattgtatcgatagatcccaggcattgtatgtgctctagaaatcctcagttttttgcttcacatcgtctaaggcccaaatgtgaaatgttcgtctgtttgaactggaattggaaaagaaaaaagcaataatcgcctcgatacttcgttgcaaatgctcacagcgaaagctttgtttgctcttgtgaacttgcctgtcaaaaatttgaatactccttgtctttggacttttggagcattactgatctgacggtggcagcggcagcgagcgaaacgacggtttcaaggagagagcgcctcccctcccttgtgcacgacaggaaattcgcccactactccactagtgatcccgcgaatggctcggattagagggcgcgcgcgacggagaaccggagatatccgttattttctttcttattatccctttttcttttcttttacgcgattcggtatccgttatttcctttctaattatctgttttttatttttacgtgattcttcttgtactagcaaaatgcccgtgcttcgtgcttcgctacgggtataatgaaagttaaatgctataaatacacagttaacatatatgttataatattccaacatagataaattgtttaatgcattgttaatgataatcaggactgataagaaacaactattgcatattgatatatttatattgtcataacacacgctctcaacttttgcatggcaagcgtctgatataatttctaaaatcgaacacggactcgcgtggagacagatcgtttcacggctcatgcgtgaacgatagatggtgcgaactctaatatatcgtcttttgcagatgacgaaaagaaaataataattatgtttaatttttgaattaaaaactggttcattaattatgtttaattttcgaattaaaaactggttcattacaagatttcagaatcactaaaaatcagttgaagaaagaggtgtaaaacttttgattttttaaccatcggatgtgcatggtccgtgctagtggcacttaatatctgttgaagaaagaggtgtaaaacttttttgatttttaaccatcggatgtgtatggtctgtgctagtggcggagagaaaaaataaatatatgttgaagaaagaggtgcaaaacttttttgtttttttaaccatcggatatatatggtccgtgcgagtggcggagagaaaaaaatacgcgcaaataggatttgagacatgggacacaaagtagacttattccgagtaataataagtacaaaagttttttgatagggtaatctggcctaggagaggcaaaacttttttgattttttaaccatgggatgtgcatggtctgtgctagtggcggagagaaaaagattgcgcggaaataggatttgagatgtgggacgcaaagtagacttattccgagtgggtaatctggcttaggagaggcaaaacttttttgattttttaaccatcggatgtgcatggtccgtgctagtggcggagagaaaaaaaattacgcgaaaataggatttgagatgtgggacgtaaagtagacttattctgagtaataataagtacaaaaatttttgatatggtaatctggcctaggagaggctcatagagcgtgcaaataataatagtttattttttaaccatacagcgtggcaaaacttttttgattttttaaccatacagcgtgcaaataataataggcgtaaaggaggggacggtgggaattgaaccctggtggcagatttcctttcctaaccatgtgggcaagctgttacttttgcttggaggttacatgaaagaacacatattctatatcagctgcgattttttactagattggaaaatgtctgatcggactattaagcggattaaaatatattttagtaacgggatcaggatgatggacgaaaaaatatgaggaaaccttatgtatttttttattagatatggatacgtaacaaacgtgtccgttcttcactaactttttttcccttttttaacgtgattctcatggtacgcatgaagcttttttctttcttttccaatttttattaatttccttttcttcgttagtcttttctatagttttattaaaggaaactttttatataaattatttatgtggaaactttctacacatagattttgtgtatataaactttctacatatagactttatatatataaactttctatataaaaagtctaaatgtaaataatttatatacataaagtctatatctaaaaagtttccacgaaaatatttaatataaaaaattttctacatataaactttatagattagaatttatatatatgcaactaaacgtttagtttataaatttctatataaataaaaaattgtttatcaactacgcatatttttggaaatgaatagaatccaatatccaaacaaacctcgtaacataaaaagcataaagtatacgtggattttctttaactgaaaatcagtgctaacaattactaaaggcataattatagacgtataattaggtctgaagaatgatggaatgctatatcggttcgtgagattccctcctggtgaacattcgtggggtagacccaccgcacgaaggcacggatccgaattggcgagcggacagagggaagtcactgatatgtgggccctttttccaagcggatagtggaacgccacttatatgtgggccctctatttgagtccataggggaaagtcttttctacacctcagtgccgcatcacccaagctactagacttaggattgctttgtgatgcgtgcacaagtactccctttgggctgataatacttgccattttaaataagagtgaggtcaagatccgcagcgaggggttgtggggcgtcgagggtactcacatgccggcctcgtcaggaggtcccacccccgagcatcaactaagaatgagatctgtgtaggacaaagagcctgtcggacggggcggcgcggctatatcattggacatccccattccatccgcgggtgctaccgtacactcttggccgactgcacggggatgacctgccgcggtccactccgcgtgcgacgttgacgccatcaccgccgggcgcgcagcggtgaatgcttgtgtggacaaggtgcagattgtgtggtcgggacggtggaggaggggtatcgagcagccgagaagggattatgtccagcgtctataacaaccatacttacggaggtgcgaaaacgatagaaatacaacacaaagcgtgaaaacgatagatggcacgcggcctagctaggtgcaaaaaaaaaaccgcgtccagcggacagggccgtggatcttggggatgactaattggcgcgtataagccatttcaccaagtctcgcgcacgaggtgcaaggcagctatgggttcaatcttctgttacgcgtttctcgttccacatgacaaaaaaaactcccgtgcatatttccttttttccggcaaaaaagttctctatgcacgtttttttttctttttttctgttttaaactaaggtttgaatttttttaaacttagattcgaaaactttcaagtacagatttgaaagtataaatttatatttgaaaacttttaacttagatttgaaaattttcaagtaaagattgaaaaattttaactcagatttaaaaacttttcaacttagatttaaaaactttcagctcggattaaaaaaattcaattgaagatttgaaactttcaactcaaaattaaaaaatttcaagccgagatttgaaaacttaactcgggtttgaaaactttcaactcaaattaaaaactgtcacctcaaaattcaaattattcaaatttgaatacttttgtctcaaaatttgaaaacattcagcttcaatttaaaaaactttcaattgaaattggaggcaaaagatccaatttataaaatatatcttcaaacttttagaaaaacaggaaattgtgttttgtgaaaaaaaaaggaaggttatcttagtaggtcatgttctttggaaacaaattacttaatcacaattttttccccgcgcgcgtgcggcagtttcacctaaaaaaaaagaaaaaaaaaagaaagcacgttcgagccgcgcgcgagggtatagcccagaaacgcgcgctgcctggactcccggagcgtacgcgctagaattctcggtggaaccggacccggcgttcgtgggggctggtggtggcgaggcggttagtcgtgccgccgcgaatcaaacccgaccgtccgatccctccacgacggctctcagtcgcgccactacgccggttgcaggaaccccacactgagagttgaagcacgaagcattgtcgtcgtcgtccccgctctcgcataagaacaccactccctcccaccactccctccctccctccctcccctgtggctgggcttttgcgttcgcgagcgcgcgtggggcggcggttgtgagggcaatggcgagagcacctggtggcgttcgccgaaggagcgggaggaggggcgcgggcggcggcggcgccggaggcggaggcgaggcgctgcggaagggcccgtggatggcggaggaggacgaggttctgctggagcacgtccgcacccacggccccatggactggagctccattcgatccaaaggcctcttgccgcgcaccggcaagtcctgccgcctccgctgggtgaacaagctcaggccaaacctcaagaggtaagcgcgaatccccccctctcttttttcgatcttctcccttccccggttcgatcagttctctcgcctccttgatttttttttctggtcaagttcttcgtgcatttgcaagttagagcggcacggcaattgcagtgttcctggttgttctcacttctcaccggcaatggcaccactggttttacggatagagagtaacattagttctgttaaaactttagaagtgtttgcttcctctaacctagcgtccagccatgcgactcgtgtttaattttctttgttactgcttcactactctggatatttgtgtgggtttcgaaacaaattaagtataggaagtaaatgtttcgtccttacatgcttaaattgaactggccagatgaatttttgcttgtaaacccactactccatgataatgtgttagtaaactctatatctgcggtctgtgcaatctttgatcgcacttgcactgaattgtgtctctgtaatgttcctatctgcttatctttgatcaaactagtcgatggaaatgttcatgtataacccaccttttcgagttctttttccctcctttaaaaagcggttgcaagtttactgccgaggaagagagggtggtgatcgagttgcaggcgcagttcgggaacaagtgggcgaggatcgcgacctacttgcagggcaggacggacaacgacgtgaagaatttctggagcactcggcagaagcggctcgccaggctcctccgcgggcctctccctgctgcacggcccaacaagcacaacagcggcaagggcaaagcgccctcgtcatcttctctcgactcccaaacagccacggtaatgcatgcctttcactgaaccgctgatgaatcatcatcaacgttacgaatttactgcgctcgctccactgtgaatttgagtttcttgatggaaacttgcactgatgacactgtacttaatttcttgcagttccaccagagctcggcctccctggatcaagcttcattggagggcaactccctcggctggcaatgccgcgaggctgcaccgttcatgggatatgatcaggcatgctccgggttcttcgctttcgaggggccactgccgctgcagctactaccacccgccgacggcgaggcgagctcgtccaatgcagctcagtcggcgccaccaccgctgctgttcgaccagcctccgtaccctctgatcaacttccctggatggccggagagatacgtcgacgtcggccacgggttcgtggacgccggcgccatggatggcctcgcctaccaggagctgcttccgatggtgcagtcggttccgatgatcatgccgttctttggcatggagtgcgcgcatgacgccgtcaagcacggggcctttgacgacctcccgccgaacatgttcgacgacgctgttgatcagcccccaccgccgccgccgccgccgccgccgccatcgccatcgccatcgccgtcgcgcgacgacgtgttgtgaactttgcgggttggtttgctcgatggagagtgacgcagtttgcgtgattcttttctggttgccaatttggatatctttgtgcctgtgacagcttacagcatagcctacttatactgaaccttctaacgtgtcggattaatgtgacaatgtttctaagtgtggatgcagaatgtaaggtgtatatataagtcgtactaccaagttaacaacgatggcgcgtgaccgcttgctaattgttatgcagtacgtactactatagattataggacactaattcagtgaactacttagcgatcatcactgctatttcacatgtaacaagttacacgtggaatattgtcgaacttattttattttttataaaaatattttgttaaaaaattgctataaattgtattggcgaagagcagttttggcctaaaagatataaagaatgcaaaaactattgacaaatgtagacgttaccagttttttctactaccatgttttaattaacaaaccaaatggaagatcatgaaaccaaggcaggcaggcagcagacatccttgcctttcatctgcaccggtttatcctaaagaccagaaaaccaatctaagccacacaatcacttccaccaacggcccagattacctcatcctcacagggggagcacaccaaccggcaagccggcaaggataaaggcccacgaccacaagcttagcaagccctctctcggtcgcgtggcttgagcggtggtgacaccgctcgcctccgtccgcctcgcctccaccgagaggttctctctgccgccgattcaggtacgatcgcttcactacgccccaatctttcatggccgagactctcctaaggaccggttggatcgcgtatgagccccccgtgatttttctggaggggggaaaccgagtgtattttttgcttgttctgcgccgttttcttggctgttctaccgatcttgttggttggattcttcggaggagaggtggagccttgtcctgatttggaggggaggcgaagttttccagggttgtgtaggacacctcgtgggggttcgcggtggctggagaaatattcgtgatcagctctccttaggggatttttttttttaccttagttgtctgctccgctcgaaacacagagttcggtggggatgagactagattttccttcgattttccggatgtttttgagttgggtgccaaatatgttaaaagttcaatgtggtcaggcacttgcgcatgtggtggagtcgtccttctacgattttttgttggttttatatttgttgtaaatgcgtaaaattagctcccattttagtttgtttaacagaactgattacattttatattactagcatattactgatcgttgagtacggagtatatatattaaaattacagtgatccttggcctttttactctctgtttggcatttcggtggctgttcaaaagccatagtttatttcgatgtttgattaaaaattgttactataagcattttaattatagttgtaacagggaaacaaagtcatactaggattagtaaaattcccctattttgagtagactccaatgcacaatatgtcaccgactcaaccactgcagactgacccttagttctacagatttacagggagattatcttgtgatctgtaaacatgtttgggcgtgtaccgaggagtaacaacaccaagtactatgaggttcttggagttcctaaaactgcaagcaaggatgagctaaagaaggcataccggaaggctgccataaaaaaccatcctgacaagggaggggatccagaaaaggtgaggatgtgccagtgtgacatgcaattgtttgaattcagaatctctattttgtttttacatttttatgtgttttacagtttaaagaattatcacaagcgtatgaggttctcactgatcctgagaagagagacatatatgaccaatatggggaggatgctcttaaggatggaatgggaggaggcagtgacttccataatccatttgacatatttgagcagtttttcgggggtggtgcctttgggggtaagcaacatatgtaccctgaaattttccagcaccctcaacatttttttgtttgaactttttttttaaaaaaaaacagaattattcatgctaacttttatggttaacagggagtagctcaagagtacgcagacagagacgtggtgaagatgtggcgcatactttgaaggtgtctttagaagatgtgtataatggatctatgaagaaactatcattatcacgaaatattctgtgcccaaagtgcaaagggtaagcctttgtatgttattgctgcacttcaatttgctaactggaggaaatgatgtactcattatttggcaaaattattacttatcatgctctttcactttagcattatcgatacatatgattccatctagttgaaaataaggtgtaaatagttatcccgaagtgttcactgtaatttctctatattgctagtttaaatccatcaactggtgattgtatttgttttgtattttcgtgcgcacttatttctattatttttgcatgtacttgagatgcagggaaacccagttaaatgtttcggttactggataatcccttaacattatcccattccatttatgttctgtttcaacctatccataaaaaaaatcattaatgagagacctaatgctaacggatacatgcttgtgtcagccaacaatgttagaagatatccttacatttatccacactgcttctattcttgaatcttttattgaattaaaaaaaggtgcaaacgtaattttatagaacctgaaccatccccaaaagtccaaaactagtttaataagggtatcttgcacatttggggaatatgttggactccatgctaaagccaatgtttattatagtcctacatatctatactcctctaaaagaccccaatggtggtggtgagtattgaatttgccaccacccaccaccactgcatgtgggtcccccaaatagtgaggtaggtggacttttgccccttccccaacctcaagccatcaaacagaaaatttttcttttgaagtgaggtaaaaatgatgacaaataatatgactagaagattttacaatgagaataattttattaatttttgaggctgtaaagtgtatggaggagttctcttcatgttgcaatgcaggggcattcagatagtataattatagaataacatatgtagtatgtaaatcctgattaagatggctgtgaattggcctatataatgccaagcttgcaataccgactaccgaatacctagtctaattttgactgcctctgtaaatacgacatctaatgtgcaatgaaagctaacctcccattttataaagaaatagacagtgcacccaatcaaatagacagtgcctattgaaatgcttcatcccagtaaagctttaaaaataagtccagcccagttaaaacacattacacagatcaaatacatctatatggccgatttcaacccaggtttattcaccattctgaggcgtagctagctctatcaccataattagtttagtttatcattcaaaatatatacgaggcaaaattcatgttttttttgtggcccatttcaatccaggtttattcaccattctgaggggccctgtaaaattccttctataaatatagaagaggcaaaggttttgcccttcattcaaaaaaataattagtttatcatgttttttttatctgttttgagtgttgactgtagtgtttcaccttttccatcttactctctgctttcagaaaagggaccaaatctgaggctccagcaacatgctatggttgtcatggtgtaggaatgaggaatataatgcgacagataggactaggcatgattcaacatatgcagactgtctgtcctgaatgcagaggatcaggtatgcaacagttgctccaatttttatgctatatcttgctgcaaaattgtgatttcttaggagcctgctttatgtttgtaatgttctatacttgatcaggtgagatcataagtgacagggataaatgcacaaactgcagagctagcaaagttattcaggagaaaaaggtgcttgaggttcatattgagaagggaatgcaacatggccaaaaaattgtattccaaggtgaagctgatgaagctgtaagtttattttgtccatttatactagtatacatacttgcagccacatattcatccatccttgtgctaatgaatatctgtgcatgcactactttctttatctaatattttgcactgtgtgtttcatgctgttgcagcctgatacagtgacaggagatatagtatttatcttgcaagttaaggtacatccaagatttaagaggaaatatgatgacctgttcattgagcgcacaatctctttaactgaggcattgtgtgggttccaattcatcctcactcatctggacagtaggcagctcctaatcaaggcaaatcctggcgaaattattaaacctggtatctcatccccttaaaatgctagcctttttgtttgccacttcgtaattctgttttttctattcagattctaatcagttgcagacttttttaaagaattaactcaaatattttccaaacaggtcaacacaaggccataaatgatgagggaatgccacaccatggccggcctttcatgaagggccgtctctttgtggaattcaatgttgagttccctgaatctggtgtactctcccgtgaccaatgccgggcacttgagatgatcctaccacctaaacctgggcaccaattatcagatatggacctggatcaatgtgaggaaactaccatgcatgatgtgaacatagaagaggagatgaggcgcaagcagtatcaaaggaagcaggaagcgtacgacgaagatgaggaggaggatgctccaagagtacagtgtgctcaacagtaagaagtgtcactttctggcgcaagtgatgatactccatgtaaactaagtagtttttggtgagactgttcattttagtgtattttgtactagttaaattaaatagtgaatgtctaagttgtgtcgtttgatatataagcttgtgctaacaacataaggctttcttggccttcataagatatactcctacctaggagaaagtggtggatgagcattcgtttctgtttttattggtaatgaacatatttacatgttgtattgactgaaaatggtatgctgaagggtcttcgatgcgtctctgtttgggatgctgagtacagtatgaagcagtcagcaaaagtagctaggaagcgacaagcctttatgcgatactcctaaaagctaatttgtgatttagagctgagaagtccaaagaggcaaggactggccagaattccagaaactagttggtctctctaaagtaaaaccacgttgcaggattcacagtaatttcttactactaaaagctaacagtacagagttctaagtctgcaggtcagcggatcataaagtaaaccgtatttcggcaactgtgatcattgtctgccaatgtaataagtaatgtgaatcatgcaaagggccagaaaaacattgacgaaaatactccattatcctgaatcttgaggccgtgttttgttcttcaaattttctttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagaactttttcatcacatcaagtccttgtttggatccaaactttttcttcaaacttcaactttttcatcagatcaaaactttcctacacataaacttccaactttttcgtcacatcgttccaatttcaaccaaactttcaattttggtgtgaactaaacacagcctgaattagagcattgtctcaggacatcacataagctagtatgtgagataaaagagagaagaaaaagagtaaagtgcacgggcggtccttaaacttgtaggggtgtgtcatctaggtcctaaactctcaaaatacatatccaagtacaagaacttgtcatagtgtgtcatttaggtcccacatcgccccagcccctataggatcctacgtggcactaatgtggcatgccacacggacaagacgtggcatcattttgactaacaaatgaaacccatttatctttttcttcttttcttatattttcctcctcctctttttgttctttcttctccttttttttttcttttcccgagtagaagaaaggaaaaaaaaagaagaatgagaagaaaacgaagaaaaaagaagggaaaaagaagaaaagggcatatcacgaccatatggcatgccaaatcagcgccatataggattctataggggttatgtcgatttgggacctaaatgatacactttgacaagttttgggacctagatgtgcattttaagagtttggggacctatatgacataaccttacaagtttaaagactgcctatgcactttactcgaagaaaaacatagatggagtcatccatgtgcaagggacccctccacacaaactctaaaaaaggaaaaaaaataaagaatgtattggacaaacaaataaaataaaaatattaagattagtgtgctagagttagtgcagttgtgatgtattatccccggctactccaaattagtgacgataattgtcttttctttaaactttctcttactagctgaaattccagctgtgacccacctgtcttaattatcttctccgttaccaagagcagaggctctagtaattcacaatccctgctctttgtggtagctgctaatgctaacgcatcttcctgtcgccgccattagcccccttttttttcaggtagatatgcctgaaactgaaaattctccaagtttcacagccaatctgccataatttccggctcatggtggcggcgcggttcaggatttagctcgccatggtctgtgcctgtgtgccgaactctttgatacggatggattgtgtccggttttcgccaaaccgttgcggccaacttgctgttgaccgcatcatatgaatacaaaggaaagccgccaagtaaaagccgtaatctgccattgccccgtacatgtactactacttccaagttccaccgagagttcaggtgtccagtccaacttgagtgtttagagttgaggcttctactagacacatggtagcatggatcacaatgtaaacaccattctttgcgtgtggacatggtaacttgggggcttgcagttactcattggttcattgcttatttcattgatcaacgtaactaggagttggcgatggtacaatatagtaagctgagtggtcaaggttgaaacgcctcatcattaattggttatgtcaaactacgcacactgcatcatcactggttaaatgcttcattggttatgacaaaattactgctggttgtacggcattgacaccgcccggcgtcttaaattacggtcgttaactacagcctgttgcgttgcacgctcagctggacattggagatgattaatatgcggggagatatcatcgggaggagtagattaggactctgcaggagcatatctatgcatggccggtagcatgcggttactgtactcattgacgtgatggagaattaaccaatacagtaattttccgttagggcagcttgccagcttggtacttagcattaattacctgccgttggcatctagggcagctcgtacctgctactctacactgtagcagcacactgcatatatctgcagtactgcaaaaaagaaagaaaaagttcagactaaacgctgcaattgttaagcttgccttaacgaggagcaataactcaagctcttggtactactaccattcatctgttcttgggctatcgcatttaagctgtactgtgtctcggcgctaggataaccaatgcgagtgtagtttcgtcgccgtgcattaagaactggtactactaatactacccaaatcttacaatgctaaagcacgtacgaattgaagactgcgactctctgcgaggaggactcctccggtcgctgctatacggaagaggttggatacaactttgacgcttgacggtgaattgttacttgcaagcagtagctagctaggggtgtactgctgcctgtatatataagacgacgcttggagagagtcgaccgtctactggccttagtgggcagcagtatgcaacgtatatgtacgtgcacgtacaccgcccgggttcgtcgtagagagagtatatataaatgcgttggacaggtagacacgctctgtaacttagaagtaatgcccttggtgccgggacttttgtaccagggctaccgtctagtactactaggatgatcaatggaggtctcgttagttcactggctaaggttagctcatagtacaggattagggcctgtttggtttctagggacttacttcaagtccctgtcacatcggatgtttagacactaatttagagtattaaacatacactaattacaaaacccattccataaccttggactaattcgcgagacgaatcttttgagtctaattacgtcatgattttgacaatgtgatgctacagtaaacttttgataattatggattaattaggcttaaaaaattcgtctcgcggattagctctcatttataaaaattaatttttttactagtctatgtttaatactccaaattagcgtccaaacatccaatgtgacatgggctaaaaagttttagccccatctaaacacccccttagtactcgtgtactgggactactggtaagatgggatcgcgtttggtgtcgaggacgacgacgtgagaggttttgcgtgccaaaccaccgcgattttgcttgatgagagactcggtggatttttcggcgcgggcgccgcaggcagcggtagctcagatcacgtggctcctcgcgcggctcgcgacccgcgggaaccgcgcgatcgtttgttttttctttccttttcttttctcttctgtcttgtgcccccacagggtcaaagggtcaaatctcgcatctcccgcgcgcgcgcgcgcgagagagagagagagagaacgtgttgcacgatcggcgaagggcgcggctgtgctgtagctgtagctgtagcttgcccgaaagagcaagccctgcagcaagcatttaatcgcgtcgcgttaaccacactacacgtctcggggagcttagtatttccgtgccttgatcctctgaattactactagtattaatcagctgacagccaggccttctcccttagttttacctctgcctgtctcgatcagctcggtgtacgtcctgatcgaatcgtgattgcgtttttactgagagtaaagtatactcgttttctgaagctttctgaaccccatattaatcgtgctgtcgttcgtgcgcacgagcgagtacagaggggcatcatcgtgttgggttacctgggtactagtacttggatgccagcacgtacggctagatatgcgtggaaggaatattaatctgctccctctccggtgcccaggttcttcaatccactgatcctctcagttcacaacggcattcaattcccctccgttctactcggaagacggccggcctctagctagctagtccgtaaactaataagtttctcatacttcctggggtatctcttgcgatccgcacactaggggttccacggagttattgacccttacaatccaactttctggcttggagcagtacgttgataaatgacaaatcctcggaagagagaaagagagcgaggcatgcagacaacggatcgcaattcaatccggatgctacgtgcaagcatacgcgccatgatcgacacgctccccatcaatcacagctgaaatctcgcgagggtggtgtgccacggcctaacatgcatccctttctttcggccgaccgaggagagtagtagcaaaaactcacggggaagtcaagcgcagaaacggcaaaaaaggaggggaaaaaaaaaggaaaactgatgagaaaacgaagccaaagtttggctctggatcgaatcggacccgatcgagacgaccaaacgttcgttgggatttgctcgtgtcgaactccagcgacacgacgcgccatatcttatcgttgcgccgaaccattttgtacccaagcaaacaccacttgctctccgcggctccaccattaggcctaaataatgctactgaagatcttgttaagtaaccggctctgagatagtttatttgggatgagttaatctatatgccctgtgctacgtacagatcgattgacttgcatcaagtagtaatagttaaaagtgttaaacgtgaccagaattagctagaattgcgatcaacgtggtcagtatgtacggtcactgtatatttagctttaaactagttcggcagagaaacgggttttttttgggggaccaggtctagagtactgttagtaggttgtagttatatatatactctgcttaatcccttttaagtttcaacgctaaaagtaaatgccaaagcccagaaccttctcaagcaaattagtagttcaatatagtaccaaaatcaaaatatttgagccatcggcgtcttcgttgattgaaaaaaaaaaggaagagttcaagacttaagccttagcaagagcaaaacgtttttcgaagactgttccgtagtcgtaacatagttctccttttaccttgtttagttaattttttcccctgctatagttaatgaaattggtacaccttatattggttcgttaaaaaaaatctgaatgtttgattttgactcatgtgatgaaacagtaaaagcagtgagagtcgctgtatttgctttatcataatatattttgtattttttttcttgcattctaaacttttctgaaatgtccagattaaaaacaaacaaacttttgttgctttagtttcaactgcctcatgccggccggttgctcaagtgaataaaatgtcaactcttctatacaaatttaagaaaactcatatataattgtaatataatgattattctcgtaacaaaccttgaccatacattatttttgaatcaaactatgagagtcaaactatctttggtcaaaatttgacttattgggatgatatttttgttgttgtttcagggatcgatttcactagctccacctgtttaaaatgcaaaagaacccacctcttgaacaaatcttagtttaggtttggggttccctatgttctaaagctttagatcagaagaggcaaaacaattttttgacttttatctagttaaatttatgtccttttgactttttagttaaattttgattgggtttgattaaattaatttatagaaaaatatagtagaattttcaacataaaagaaacatattatcaaaatatattcaatattagattcaatgagactgattcggtgttttagatattgctaaatttttctctaaacttgtttaaacttaaaaagttttgactagaaaaaaaatcctagcgacttataatatgaaacggaggaaatagcattttaggccgtttcgatttgaagaaaaaacatagtaaggaatttatagaattttattctaaaaaatgttcttccttaaatagccatttgaaataaaatattggataatattgaatcctacaaattcctcattccgtgcatattatataagaaatttaacatgatatccaatctcatgaaaagttttatttgagtctttatttcttcttaaatttcggtattttcccaccatctaactaaacaaacatgttttttcttaatgtttttcaattatctattttacacaagtattattgttaaaatcctatatttttttacgctgaaatcatatattctttattattatttttttaatcctatgtttccaagaagtgctatacgtacaaatggttggaaaatgatggttttatcatccgatggtcctggtttttatcatccaatggtcctgagttctataatgaaactatgaaattaattaatcatctacattaatcaatgaaaaaccttgcgtagaaagggaaacaaaaggctttttaacataccctgccccacctcaagaaagcaaggccgcgcgactatttatagccagaggcactcactcgctcactcgccgcagaccgcacttccatcgatctctctcctcgccacgggccacggccttctcctaacgggagccatggaagcagacgcgagccatacacccaccacctcctcctccgtctccgtctccttctcctcctcgtcgctgtccacttcctcctccacctcctccctcgtcgacaatggcgcgcaagaccggcccaagagctccaagcccaaacacgccgccaagaagcgcaagagagcggccgcggaggaacctgccaatgccgcccacggcgcaggggaggataccagcagctgcagcaccgacgacaacgcggcggcgagcggcaaggcgcaagcgggcggcggcggcggcggcgtctacagcagcagcacctgcaccgccgcctcggcgccgaggagcggcttcaagcacccgtcgtaccgcggcgtgcgccgccggagctgggggaagtgggtgtcggagatccgggagccccgcaagaagtcgcgcatctggctgggtaccttccccaccgcggagatggcggcgcgcgcccacgacgtggccgcgctcgccatcaagggccggaacgcgcacctcaacttcccggacagcgcccacgagctgccccgcccggagtccacctccccggcagacatccaggccgccgccgccaaggctgccgccgaggtgcggtgcgaggaggagtcgtcgccgtcgtcgtcgcccaccgccgagcaacccgaggaggaagccgcctgccctgacacggtgcacgccgacggcggccaggacaatgctctcttcgacctacccgaccttcttctcgacctacgggacgggctctggtggtcgccggtgtggccggcggcactggcggccgaggagtacgacggcggcgacgccgtcgtgctcaatgagccactcttgtgggccgagtagccattttacctttctgggctcatgaataggctacaacgacaactctcaagaaagaaagaaaaaaaagggaaaaatgttattaccgctatatttagtagttactgctattgacaaagtttagtctatgttgtgcttgattaggccatgaagcctgtgtgctttgtgtaccaacaatcaaaaagatctctctactaatagaagttaattaattcgaagcagattttttttcagctgattgaattattgatgtgcataatttatttttttttatggacatgtgggtgtggtgggctgctggccggccgtttggaggtcgttttaatggtgcggtgaaacagcggacaatcagcaaaaatcagaattgagatgtatgtgttgcctgcttgcctcaatgatttcacaatgagtttggcagtaagtgcatggattcttgtgtacatcactcaccaccagagtgcgttctcacacaaattctcaccagattagcccttgctcataacaagtccggatcttgctgctgccacgtcattattacgtaatccctccgtcccaaaaaaaaaaaaaagtcaaaccctgaattttcgtatccaactttgactgtccattttatatgaaatttttttataattcatattttcattgttgttagatgataaaatataattaatattttatgtgtgacttgtctttttaattttttttataattttttcaaataagacggacggtcaaacgttagacacggaaaccaggatttgtcttttttttttgacggagggagtacagctccttcgaacaagtaccgggagttaaataataaactataaaaatgccaactgtgccttcaagctcttctacttccagcctttctttactacacgtactgtgctggtactagtggtactgaactcaatatctcaacagtactagaagagtgaaaagaaaaggagaggaagtagcaaagaaggttccatacagtgtgcacacaatgttcacttgtctctgttggtccgtttgagttcactaatgaaaatttaaatacagatatacaaaataagaaaactattaacatataattaactaagttttatttattttaaatttaagaaatagatttatatgatatttcaaagcaacttctacataagaagtttccacacaaaatacgccgtttagcaatttaaaaattaagataaaaaatctatatcttaattagaaaataacaagggacttgccaatgtaagttatgaaaaataaataaaaccacaagccaatgactagaaggttaggtacagagcactcgcacgccagttaccggttcccacaagagtccaagtccaacgccagtggcgcagcgaaccagttaacctctcctggctcgccatctatacctttccctaattaatcatccaattagtcgcaaattgaggatcttaggtactagtacacgttagctagctagcccaagtgcgagctcgcgtcgagcgcgggacgagcagaggcgaccgtgtcacatgcacaacacatggccagaggagcaaatgcgtttgcaagctgcagcagcagcagcagcaaacgcgagcgagctgtcgaattagcgacgcagcgctgataataatcaaaaccggctaaaccacacgcatgtacgggtacataatgcgtgaaatgatgcctctaggagaggatcctatgacagaaaggggtcttgtcgtcgtcgccgccggcccgaccggaagcgagccgtgccggccgggccggccggcgtgccgatcggagaagggaacgttacggtatgtgaggctgtggtgccgcacgacttcagtcgttcgcttttcttattttaagggtgtaagtggctaacccgtgaacatattcacaatgtacctctatttgctgctggttgagattgcaggcgggcgcggagaggggagcgggcgattcgctggggatttcgcaattttttgcggggatttggacgtgccaatgcgtgtgacagtgtgagctaagcagctaatcggttagcaagcactcaacagaatgttggtgcgaccagccgatcgatcgatctgtttaatgattgattttatgacgcgtacgtgccttaatcaagcatgcccttgattgagatttgctgagtatatatataccacttttccgatagatgtcacctgattttgtcgtggaagtgccaacggaatcagacacgatcgggatgtccttgtggttgggggatacagtgaagttaaaccctggaggttggttcgcaaggactatagttaaaaaatttgtgggcttttgtgttttaagtgcccacaagggtcataaaagaccataaaagaactctaaaatcaattaggactttacggtaatatatattctactataattatcatcagtaaaagtgatctaaattattgatttatgagttccattactacttagaaataactattctactagtctagagaccatcgaataacacctcaaaatcaatagggcacaatagtacgatgaaatggaggttttggtcaagtttaattttaaccagtagttataagaggctgtgcagaaatatctgaagcaaaacagctcacattcatatgtatttgtgaatgtttagttatagtatataatccttgcatacaaatatattgaaaagatggacaatattttcttttggaataagaaaagatgggcaatataacaatcgttctctttatctgaagaattcattctgaatattgttgccagacaatagtagcaatcaatcgactgttgctttgaacactttaaagagaaaagctctggctttgaattagtaaaacttaaaacaaaagctagccagatcacacttaaaagagagatgtaattgaaccgtatgtgaggagaacgatcgattgagaccaccataattggtcaaaagtccttttctattagaatcaaacacacaaaaagtttgtagtttgtaactaattatacagtagggaatacgattgaccagcgtacgtaccgttcttcatgtgacaataatgccctgcagatccccatcagcgtgttagtttcactgaaactaacgcatgtggtctcagctaattaattattcgcattatttcgtctaacaatatgacgcttcgatcagtagaagtgtagctttcgtgaactgagcaccatctagtattatttcttccagccgtctacataagcatcatgctgttctttcaggaaaaagaccacttatatggaagttatgaagcaaatggacgttttaaccactcttttatttcggccgtggagctcatggacgtactaaccactctttacttggctacatatgggcacatcatactcatttgctctggcactttgtgatacgtgttctagaattccttgatttgttatgtaatttctgtcatgtctcctattgtctctgcatccatggctacgtacggctagtcgtcgtcatagcttaagaaaaaaatgtttgggacagggcaggaaggtcaagtcagaactgaagcaaggcccgtatttagctacgtatcgcccttgttcactaaagtgtttgatgatagatatatggagtataagaaaaggcttttactcgtttttagatgtataaaaacatagcgtgttttcggtttcaaattgccgtccaaagaaatgaatcgtcttgaatgcactttctcgtcttatttcgttctttgttcaacagtcgtactcgcgttgtgcattaggtaacatctaaaccgatcatctgggctttcgtgcaaagttgccgtctgtggcatctgcttttaattgaccaaattaacacgatgaattcctactacggttgatgctagctacttatatttaactaagattcagagatttgcttttttttttgaacgaatagagatttgctttgaacgtaaaggtaaagagagagaagaattcttcatatcatcaggtttcactgaagtctgaagatcctcacgctgttttcactcatcatctctgtttagttatctgttctgctttgaccttaatttttctgttttctcgaattgatgcatgccttctcagccaaaaaaaaaaaagttatcctcaagtctataaaatactctcattctggtccattccagtagttacgaaccactagaaattaaagcactcattgcttgtcactatattctagcatggggccaaatgaaaggtgagctcaaatagcgaagattagttttatcccagctttttctccagacgaattttggtgtttggtcgcaacttagcaatccttaataaagttttaagtgtgatcttaggaaacacctgtatccccaattctccaaagcaacgccacgagttcctccccgtaggttttttttatgttcccgcgctggaatctctggtcgtatatatttgattattctgtcagataacattatacacggggtcatcaatagttaagttgaaaattatggggaaagaaagggtactatgggctgcatggctgcattttcttcacaaaaataatgggttattgccagctttgctttgcattatgttctttagtcttctcatcttcttatcccaacaaacactgctttttctgtcccatctgctggttgacaccctttccattagtttcgcccgtttgcattattgatttgtacttaattattgaaacacaatataagcacgcagatccaaagatttggatctgtgaaatatagacgattcccatatgtttgcattttaatattttgcacgaggctaacacctaagtacggagttgccatgtggcttggcattttctggctactttaatcattgctcgatcgtccaaagaaacacattttgcacgaagccaatcgatgcgccgagctcgggaacaatgaataatgaaatctatagtttgtgcagaacttcagtatattgagatcttcagatcagagaagaaacgcgtccttaagctacatatcatggcgtgattttacaccttttttctctctctccgtttgcatgtcattcacatttctttgggagaagaaaagaaatagtgccactttaattgttgtgtcttccacacattgacttagagccacaatatatatacatggatggtgcatcacattgccttcatctccacagacgacagctagctagtcagccaacttgttgatcactccaacttacagtgacaagttgcagcaagaaacgccagtagctcgagtgatcactgatcactagcaagcaatcttggttttcgtcgcgtgctagctcgtcacacacgaatggagcaagagcaagtgatgtcccaggagagcaatagctgcacctgcagcagcagcagcaacgacgcgagctcggccgcctgcagctcgctcaacgcgtcgtcgccgagctccgtggactccgggag

SEQ ID NO: 43751 - DNA, 31765 bp, Oryza sativa
tgcatcgttgagaacggaacattgcagcaggacggcggcactggactagactacacgtatttcaccatgccaaatgctcttctagagttcgggttcacgttgccgccgccgccgccgccgtattattgcggttcgccgtgggatgacgatgctgacgatttcttctttggtgagccactggtgctctgggaacactgaccacaacgccggcacggtgaatgcatgcatgcatggacaatatttccatttttgtcaaagcatgcacggactatgtttattttagatgctttctgtcaatatctaggtcaacttgagagtgttactgaccacttggcttagtctcttccactccgatgaggcgatgatagcatcattagttaaagattggaccaatatgttgatttttgtcacatgtcaataaaattcatatatattgttttactaaatattatactccctccatctacttttgatagacatatttttgataggcatatttcaattcaacaacctatcctcttaatttatttttgatagatatatttcaattcaacaacatattctcttaatgactttctcggatttaatgcatgactctccattcttccacacaagattggctacatgagcatcgagaaaatgtaaatattaatgaatcgtttgtttacgaggaatgactagtagcatgtttaaatggatgataagtagaattaattatccttggtctgtgtatcaagatgaaatatgactatcaaaaatagatggagggaataattgagttggaattgtctatatatgcccggccttacattttctccacacagcctaatagccaatcaatttttggcccggtagccgatgacccagtgtctatcatatactccctcaatctacttttgatagtcatatttctaaatctaaaaaaaattatttttgataagcatatttcaatccaacaacctatcgtcttaatgactttctcgaatttaatacgtgactctccattcttccacacaagattggctacatgggcatcgagaaatgtaaatattaatgaattgtttgattacgaggaatgactagtagcatgtttaaacggatgataagtagaattacctatccttggactgtgtgccaagatgaaatatgactatcaaaagtagatgaagggagtatcatctctctggttgatcctcctttctgtcaaagttcttacttccaaacaaattggggctacattttctttttaatttccatttaagagtttcaatcaattactacccaaccctaacccacttcatcagctagcatcagccatcaattatatccaccatctatgtgcatgttttgcaggactcccttgggatgccctaattagctaaagataaagctaaaatttgaattttcaagcttaattttaatattgactttaaaatatattcaacatatatagttctttttcagtattggtttttaaattaccaaaaacacgtatataaaaaattatcaataaattaatttttattccctaataaaccaaaacggcttattccgtatatggctaactgatgggactcgcaacctcctgaccatcagcaatttatggctccctattttgaacggtaagattcatcaccattaattgcctttcatctcttaaaaactatttgcctcttggccccactggtcaccacatgctcaaccccatcccccacccaaggcctacacttaaactccaataagtcatgcaactgctagagttcaccatatagcttcacactcaaatattgacatccatagtaaggcatactactacataaacgaatttctaatctggtcaaaattgattttcgcaggcggatggatggctcacctgcacctaggtatctgcgaaaatcactatttctgtatgcgggtacagcaattgcatgtggaaattgtgttttcgcatgcaggtacttaagtcgcttgaagctgcccatggatcctcgcgagtaggggcggaaaggctggcggattcgcctgagagtgggaacgggcactggatccaccccttccgtcaccaccaccgacagatccttgcacaccaagggggttgggaggtggagaggaggtgggatccgcgcgggaggtggaagggtgcctgatccgcctctcacatcgccgcagccggtggacccgcgcatgtggagggcggagtgattaggggtagagaggctggcggatccgcgtgaaaggggaagtgagcacaggatccacccctcctgtcaccgccattgacggatccttgtgcactggaggggctgggaggtggagaggtggcgggatctgtgtagaagagggaagggtgcaagatccgcccctcacatcgcctcggccagtggacccgcacgcgtggggggcggagaggcaacgtgatcatccatgccagagggagaggtggcaccggatcggctggagtctgagtttgtcgataacctatgtcctcccgcttgaccctttcccaatctcgcctacgagatacaagctcgtacctccaagctagccagccagatcaacctggagttgccgacaatcttcacctcctgctccgctcttccctccaatctcgcacatttgagcttgttggcgatgtccacctcatgcaaaggtccttccacaagctcaccgactgaatctgagcacgtagcacccttgccgtccaacgccaaaacagtgttgcggatgcgggcaaactaaggagaatgtaaagggtgatggcatcctaatgcaggcggacaagagcggtgacaagttgtatgatgtggtactcttgatagggggtgcgccggggaagattcgaaatacccaccacatccttactatcgaaagattggattttgtttggtatctcataaactgaaaataccacctcaaggatgacatattatcaaatgttttttaattatcttatattattgaaggttttgttgtaacatatcatttggccccgttttgacaatgtgttgtttaatttcataaaacaacgtgctattcttaattaagataattaatcaagccagctcgctctccacaaactagcttagctagcgagccccacactgccagaacactatactcacaagtttgttattccaatttggctatggacgttacacgtccccaaaaataaataaataaacgaagcaatggacacaatcatgcaacgcacaagaaatattctagaattaacgagctaactaccgttctgtctcttcttgtcttcagccgttttacctttaaagtttcttccttgcccaatggctcctttccacatgtatgaccttatatgaaccatcatgagcaatccctacatcaatacggagtattagaccattcccaacccaaaacactatacataattttcataaactctacatcatcaagaaattagtactagacactactcttccaatgcaaacaccactatccatacttaaatttaatgctacttatttcacatgatgtcttggatattgtgtagaaactatgtctcatgcaagacatggttttcttctcttttctcatttattcacttgccacatcatttttcatcctagatggcagcctatttaatgctatggacaccatcttagttattaggttgggaatagccttatactactaagttgtaccatcccggccgggagattggtcatgacatacaaagatcggagacggtaaggtgtagttagtggctgaaaagtttttagtatggttggtaacccatatgcatgtggatgcatgcaatagttagcgcccgcctcatcacctaattaattaaactacaaaaatctacacgccggccggcacacaaatttctcgcgatgaggttagttgagtcgggtcaatattcctggtacctatggcctttccattggtttctagcgcgatttcattacgtcgattaaagaatcggcatgtgagtcttaaaaaagacatgtgcttgggaggttaattagctttagggaccagaagtgtgttggcgacagtttggagcatacgggatcgtaggacgacagcatgcacaatccaagtttttccatgaattcacgcatattattatgagtacatcagtacatcggtgtcgctgtagagacttaagagttaattgtttactgtttaggcggcatctagagtgccgttttgtactggcttgcgggacgccatggaaatggcaccttctgtgctttcatgcatgtgggtatattattgggttaacatgcttgatttgatgcgcacataagtcgatttgtttgccaattattgggcttcaacttgactgcgagaataaacaaacacatgcatggggttagtctgatgtaagtacgttctaattgacggtttttcataattcttaatttactatttctgtgcggccaggggattggagacgtgtgtagaccaaatcgccagcatattttacactcctaaaagtgcaactgtgtgacaagttggggacctgtaaccctgtagatagtagctactacctttgtcccaagatatagaaagttttaagcttggacacgagtattaaaaaaatagataatattaaatggaaaaaatttgtgatgggttgagaaagagaaagttggtggagaatttgaatggtggaagattataattggttgagaagagaatgtaggtgaaaaagttgctatattcagataaattttgaatgctagaattgttatattttggaacggagggagtaggtactctccatgttgctataagtgaatggaatacaggccgagtttagttccaaactttttcttcaaactttcaacttttccatcacattgtttcaatttcaaccaaacttttaattttaatgtgaactaaacacacacacgtttgttacccaaggtagattcagagcaacgtcaaaaagggtaacccagcgaatagcttcgctagttaatgatccttgtcgccatacattgtttactgtactgagtaaagtccgaattaaatgagtctcccctaattcattcctcatctaccctatagttcaacaaatactttcactcattctttcattcgtcactcaacggtccagattatccctaagagatttgacgtccagaatagcatccgccttccctcacccctgcacccccgaaatcgtcgcactttccttccgatcgcgaaatccatctcctccgccagttctctcgcccatcacgcctatgcacgtcgccgcccccgtcgtctcccgacgctcgcgcccctacccgccgtccagacggcatcgcccactccgccgtcgcgcgccgcacaccgcacccgccctcccaccccgccagttgtctcctctactcgccactccgccgttcatcgcccttctcgccggtctcctccgcaccgcccccgatctccaccaggaactccgcgtcgccggtctccttcgtgccgcccccaatctccggctcgtcgaccgtctccgtgcaaccaccgatctctgctttcagaacagtgtcgccccatcctcgatctgattcgccgaaattaaggtacagaaatcatccttctctcctttttttaatccacaatccagtattatatatatttcctctctccccatcagtcgccgctgatttgatcatacggttcttaatataatccagaatcaatcaaaagaaagaaaaccgaaagcatcgttttggtatctaaagaattcatgtttttagataatgataactaaagtatccatgtctatgaacaacgcataactgtctgcacatgtctaaacatctccaaagaacaatatatagtatctggttatttaagattttacacatttcagaaatcaaaccttaaaattcgattttcactggcagtgacagaatatttaagatgatgcaccatctatgtcaattatcagtatagtagagattcattccttgattaatgaaatcaccatcaccatgcatatgttaggacaatccaactgtttctggattcttgacagatttggtcaagatgaacttatgacttcagtaagcttttggctaattatgtaccaagatggttcatttttaagcaaagtgcaataagcttcatgaaacattgcaccaccgtaatcttcctcctgattttcttattttgctgtataggattagggattattgatacaacatccggcaacctccacctcggggggccacaccggcgccgccaaagcccaccctcgacatctccatgccgccaccgacagtcgaggacaacaccagtgacaccacgccgatctcctccgtggccactaccaaccggcactgccacacgcaccgccaccaccacatcgctgcggcatctcccaaccctaactgtcgccgctccgtaggttgccatgcatctacccatgttcgtctcatctccgccgtctgtccccgaagtgtatgaaagcattggtaaaaagaaaagaatataagataaaattttacaattttaaagcatgaatacaaatggaagggtgatttttctgaagtttgaatccttcttacaactggaagtgtaggactacttagggaaaacattttttttctctataaatgcggtgctgcttcatttactttggtattatcggatgattcatttcaggagactgcataatgtttgcataacattcattattccaatgcaaaacaattatgttaatattaaaactcatggtaggtttctggtccaggttagaataccaatttgcaaaccggaaaaaaaacatgaacatgtttataagccatagcccttatccgtacatagaaacttttcttgagatcttctgtgtcacatatttcattacataaaaacaacagaaggtaacctccacctccagtctttcagtattattttgctccatagcgaattagccatctactcatatttgccttgtacttatggataaccatgagatgttcaggtggatcaaaccagaaccatggtttcaagttcagtttctaaacacatcacctcaagttcagtttctaaacctcaagtagcagaaaagttgttttcttatattacagtgtaaattattttctttattgtaggatcagtttccatatgttataaccatgggagctctctcagttcgcccaagttgtttgtctagaagtatgtcactgctttggttcatcaattcttttgtcagttcattgacagtagtactttggatgacaatgagattggcttagaaaattctgcctttgagtaggcagcacataacagatttcccctgcaatgtattagggatcacaaataatcgcgcacgcggtcaccactcggtttcctttcccctccgtcaaatcgccaaccactgcagcctctctcccgcacctcctccagatcgcaaataatgctttattttgtttccgcaacaaataataaaataactcacttttgtaacataatagcgtactatatactgaagtgattatatatacttaattcttgtaaagatttattgtgcccatgcagtatcatattattatattttacgtaaaataaatatatttaatgtacgacatgaattgaattaaagttcaaatgcacatatcatagaaaaaaatttccgctaacatgaaattttaacaattattaaagataaatcgaattgcaccgtagcgtttagcacgggcatattactagtacgatttggtttaaattctggacaaacttcttcttcgatctggattcagcaaatatccctgcattacaggctgaagccagataataatcacgtttcggtctttgaaggcctatatatgaataatatgtggatatgcaagtatttattttgtatactccctccattctttttatttgacactattgaccagtgtaaatttatctttgaccagtaaaaacttttaaattatgatgttttggtgaacacaaatagtataataatcatatttagcatgcaaattacttcgataatacatcatctttttcaatatttataatttgttttgagaaaagatgataagtaaaaaggaatgcagggagtatgtagtttatgcaattataaagaaaatgtagtttatgcatgacaagtggtacaacgtaaagtataatatgtataagtagtttaattaggtgcctattttttgattggaagggaagaaataccacagcatatctttccaagagatctcaagattttgtgcccatttccttatttgagaaccatcaagatcaactgggtgtttagtttacaacgagaatagaagctataattaagtgctggacagtaaaggccacaaaataagacaagccaatttgtgtagcttctctgttttccgttagtttaatctgccaacctcttgtccttccctgctggagtatgttctgtgtgggcctgtggggagctaccagaattaatgatccttaacaagttttatgctctaacacgccattatatattcgccccttgtcccctaaataatttttttctaagcatatacaatttccgtacattaagattcttacaagtaattttacagagtactataatattctaataaagttgatgtagcgcctagattcattgggagtataaactagttacacacgcacgtcatgcaaaaagattttctacgattcttgatctttaaaaacagtagctctacctttgcagagacttgggtatcaatactcaagaggcaagggacccggggtaagggtggtaatgggccagagtccatagatccttttataatctacctcagctcttaaaatacttcctccattttaaaatatagtaacttttagatgatatgacatatcctagtactataaatctagacatacctctatccagatttgttgtactagaatgtgtcacatccagtactagattcatttttattaggacgaagggagtatgtcaagtgacaaaatgtaccataagtaaacattaaaaatttggagatttctcaccctcgggcgcccgattgagaaacaaatcgaaccccctaacactcccctacacgcatgtgcagctagctagtttctcttcttcttctcttattctcttctcctttctttaaatatttttttcttataaactacttattcaatctacgatctactcacactatttatttgttgtaattaaatatttataaatagatgttgcattattatattttgatgaaaaaaaaccgtatgtttcaatccgttaacgctcgaagttgaatacataattgcgacatctttcaatgtatatctttgttgtgttttaaaaaaataaaaatgtttaaatgactatttttttcatcgtgtataatttaatgttgagagaatccattatatgccactgactttgtcacgttctacaatatgccatcgacttttatttaacttctacgatttactatcgccgtccggttagtctccgttagtactgtacaaatttgtcaaaatgaccaaaatacccctgagacaaaaactttcaaaattcggatacaaattctaaaatatcaaattttaaatttttggccaaattttggatgtttacaatcttatatttataatatgatattttgataattttatccaatttttggaagtctttgtcctaggggtattttggttatttggacaaaattgtacaatgctaacggaggctaaccagacggtgatggtaaatcgtagaagttaagcaagagtcgatggcatattatagaacgtgacaaagccagtggtaaatcgtagaggtgtaacaaagtcagtggcatataatggattctctctttaatgtttcacgggtggtcaactgaaatatttgaccgtccgttttttttttacagaaaatcggatgtctaatttggagtttcctcctaaaattaagatacatccaataccttctttaagacctaaaactactctccctttattacttcatgtccaagttctagatgagagatgatcttcgtcgttttcgtttttcaatttttggctagggatccctcgttacgcttattcggggaataagccaaacgatatatttacaaacaaaaaataatttatgaataaaatttttatatatatgttcttaactatataaacgtaaatgttgaaaaataaacttcgataaaaaacaccgaaatcaactttatatttaaagttgaaaattcaatttttagttgataagcataagcgaaaagatgaggctgtgggtctccacataccatgaagtgagagctcatagactttagcgggtatttgtcgagttatgttatgtcgacacatgcccacaaccttatacctccctttccaatctccatcttccactcctcgacctcagtgttgccataattacgctattgtttgatgtgtttccgaaacattttcatggtcttgtatgtctcttcctttcatactatactgttatatgatcatctgctacaaagtactcccttcgtcccttcttaaacacagctataagttttcgtgattgaaaatgctgggtttaccgtcgacatgctgagaaaatcctgctctcgacaaaccaaaagaggaagctatttacacatgtactcgagttagaagatggtggccttgctattccttttgaagctttgagacacggggttaaatcaaaactactccaagtacatggtaccatcattaattgctgggctacccaacaatgttccttgcaagaatcctagaaacagacgtatgggatgaacggttagatacagctggtaaagcgacgatcgttgcagacgggttactcatcagtcatcacagcgtgtaatgcacaagccggagcctagcgagggtagtacagtacgtttgcagaggacacacggctacctgtagcacacatgttacatcatcatcggcgacaggttaactaatgctgtgttcgcatgcacctttttcccgtcccctctctctcgtttttccacgcgcacgcttttcaaactattaaacggtgtattttttaaaaaaagtttgtatacgaaagttgcttaaaaaaatcaaattaatccattttttttaaaataaattagctaatacttaattaatcacgcgttaatggactattctgttttccgtgcgcaggagttgggttcccatctcccccatccgagcaaggataatagtatagctcacctcatcttaaagccaacatatataataatattagctataaggttggctataattttcttctcctctctttatctctcacttatacatttaatgtatttgtcttggagattgtgttaagctagctcttgcatgagagccaacccctttgattttttgttacctctctcctccacataagtttacagtaagcttatagctcactattatacttgctctaagggtgcgttagttccatagacaatgagtgagatagcatatcgttttccacgcgcacactttttaaactattaaacggtgtgttttttgcaaaaaaattctataggaaaattgctttaaaaaatcatattaatccatttttacaatttaaaatagttaatactcaattaatcacatgctaatggctcacctcatttttcatattttcctaatcttctcaatcccctattcctcaaactcaccctaattaattatcataaccaaacggaagcagtgttcgattgatcagtggtacgcctcctcttatgtctcatatggccggtagaattacagcgtgtgaagagcagagaggagaatagtacagtagtacatggtcatatacaggacgcgggaatgaggagacatggagattggaagcgtacgtttgttcttaaatgatagcgttatgggcggggccgtttcgacgttcccgtgtcactgtgatactcgtcgcgtgctcgcgctcgcagcagtccaacagaatgcggactcgcccaatcatggtacggcaacagtgtaggaatatatgtactgtttgacgattatgcaacctgcagtatgtggtggttgtaacttgtagcttagctatttctgcatcaatcagcatagatacggattacggaggaggagagtgtgcgagagccgagagttggtgcgttgctgcctgtgagaccgcgggggcgctcgcgtcgcgtgccatctcatcgtcgagtgacttgtccgttctacgcggagcatctcgttccatctcacttccgtttctatgcgattctacacctgaaaggctgaaatctgtaaccaggccatcggtggaaggagcaggatttttttttttttgtagcaggtcaaccaaaagtcgcccgaagtagttttacgggaagctgtgttttgcgactttgcgtgatgcgcggagcggtgcgtggttgagcccacaccgtccccactttcacaggcccacgagcgtggaaagtcgcggccggcttgcgacacgacacggcccgcgccatgcccaggcaaggcaactcaactctgcgtccaagtccaaagcagcgggccggccacggtcgacgaagcgtggtggcttcgaccgccggcgcgtgcatcgatgatcgatcgatcaacgcacggcatggcctgaacggattggcggcgcccgtgtaaaaacttgggtggggatccggcggcgccatggacttcgccttgtccgacgatatgttcttccttggggtatcgatcgccacgcttcgatgtgcgtatacgtaggttctatggtggaaattaagaaggctcaaggcagtaaggcactgcagacgggggccttgtttagcagtccttgactcaatctaatcataataagcccaccgtattcttgttagcaccatactacaactgaggtcatccgtaataatctactactatctccatcacgaaatataagaaaaaaccacgtctcaacctcttacaatttagagagaacacaatgctatattggaagagtatacgaaaaacgtccagctgtagcttccttctattattagtaggtgaaacagtcttatacttcttcaatgaagttgctcatagttagcttcccatatttaaaaaataaataaaatacaggactctgtagatacgcatagcttatcaacatccactacttaaaaaagtatgtttccaaacaggtaaaacctatttatatgtgcggttgatccacacgtctgttcgaaaatatctaaaaaaatcactattttttcatgcggatgactcacctgcgtgcgagaatccgattttcatgtacgggtgcttatgttgtccaccggatccgcacggggctgtgcggggagggccaccaccaccggatccagcggtggcgacaggacggctgccgcacgccaccggatccagctgtggcgacgggatggctacgacccatgctatcgacacactgccgcttggggctgccgatgccaccgaggggaggttggggagagagagagagagaggaggaggaggaggttgaggagaggttggtagagaggccggccaggagaagaaacggagagaaaatgtgtggggagagagaaaatgagtggggagggattaggggaatgagaggtgggagagaagttgaggagatacggattgaggcttaggctgcgttcgatctctttgttttgagagatatttttgacccacacaaaacgagaaatcccattagcacgtgattaattaaggggtgtttagattcaggggtgtaaagttttggcgtctcacatcggatattatatagggtgtcacatgggatgtttgggcactaataaaaaaataattacagaatccgtcagtataccgcgagaatgaatttattaagcctaattaatccgtcattagcaaatgcttaatgtagcaccacattgtcaaatcatggagcaattaggtttaaaagattcgtctcgcaaaatagtcgcaatatgtgcaattagtttttttaagcctatatataatacttcatgcaggtggttaaacgttcgatgtaatagggtgtaaaattttggggtgggatctaaacatgccataagtattaataattataaacttaaaatgaatttatatgaatttttaaatatattctatatataattttttttaaaaaaatgcattatttaatactacctccgtcccaaaatatagccacttttggctatgaatctagacacacagttgtccagattcatagctaaaaatgtttatattttgggacggatggagtagtttgaaaagcgtgctaacggaaaatgaggaagttgaagattgtagttgagaaatagaactaggccttagtaaaatttgaagttgttgggagggaagagatgagtgtgattagacttgcagacatagctttaagaggcttcgcctgcgtgagatcgtttaagagtctgcatgtgaaaataagcttattttcgtatgtggctctgttaagagacccacttgagaaaactgttttttatacgggtctcttaacaaaccgtacgcgaaaatgcaggtcaacttttgtagaggctattggttactaacttactatccgcctgcaaattgtatggttctcgtaaaaaaaattgtttatatagcagtgatctaccaacaaccagttttgttagtttcccatctgggacaggttataggatatcttgacaaaaaaaaaaacacgaactaccatagggcttgtttccaccaaggatcctcacctagaattgctcaactaaatgaaattttcgcgtgtccctgcggaaaatctgcattataatgctaaaactgagttatgtggatttgtcatttatgtgattatagagtcgtacatgcatgtatctgctggagttttaaatcatgacgtttataactacgaatttagacatagcacggtctagatttaacacacaatttataaaaaaactatagtagtacttttaacacaaaacaaacaaattacaaaaacatatacaatgctagattgagtgaaactaatttgatattttagatgttactatttttctataaacttaatcaaacttggttaagtttgattaagaaagatgttaaaatgacttataagatgaaaatgagtagtagtatttttgttctcttttgcaaatttggtgtttggtggaaaccaacaaaaaaacgtttcttgaacatgttttaatttgttgggaagcattaaactacaaaagaaatatgatagtcatgacgattttctcgagtcctcaacatatatacacataaatggcccacgaaagaatatttgaacttgggtccccttactcaggaaaatgacagggtgaaagcatattctgtctagcttagaatttaaatatgtgatatccaggtaattgaaccatgacaaaatagtaaatctcagtttagagataacacttgcctccacgtttccaaatatctttgcaccacattgctgtgcacaatgcaataaatccatttcacactttttggccgaaaaaaaatccattccacactgacctggatgccataaacctgattaacacgggtagatcggttgcattgaacttatatactccctccgttccataatataagggattataagattttgcttgcaacgtttgaacactcgtcttatttaaaattttttgaaattattatttattttatttgtgacttactttattatctatagtattttaaacacaacttttcgttttttatgttggcaaaaaaaaattaaataaaataagtggtcaaacgttgtaataaaaaactcaaaatctcttatattgtggaacggagggagtagaagaaaattaattccagccgtgtcatactactactaatcatctcaaacagaaaattgaaaaaaaaaacaggaaaaagaggcctggcccacaaaccaggtatggccctttgtttatcttcccgtgccacgtcgccactgcgccacaccataaaaccccattgccctctccactccgctcccctccaagcctccaactactccagtccacacccgcaccaccgcggcagccatggacgactcccacgacctggcctccccgacctcccctgacacggcgtcctcgtcgtcttcgtctacgtcgacatcatcgtcctccgccaccgtcgccccgaagaagcggccgcgcaacgacggccggcacccgacgtaccgcggcgtgcgcatgcggagctgggggaagtgggtgtccgagatcagggagccccgcaagaagtcgcgcatctggctgggcacgttcgccaccgcggagatggccgcgcgcgcgcacgacgtggccgcgctcgccatcaagggccgcaccgcgcacctcaacttcccggacctcgcgcacctgctcccgcgcccggccaccgcggcgcccaaggacgtgcaggcggcggcgctgctcgccgccgccgcagccgacttcccctccgtctccgtcgacgccaatgccaagagccccgacacctgctccgtcgccagcgccgcctcgccgcagccgccaccgccggacgccgaagcggaccctgacagcacgctgttcgacctcccggacctgctcctggacctgagatacgagacgtcctcgagcctctcgtgcggggcgtcgtgggccgtcgatgacgacgtggccggcggcgtcgtgttccgcctcgaggagcccatgctgtgggattactgatcaatgtggctgctcatgggagccagtcatgcttccgtgtattagatcgatcagtggcttgtacatggcggtgcttcttttcttcttctttactctgcttctgctctgttctctttcttcttttctccctttgtattttgttttttttccttccattttttcttcttttctttgccaaatctagcatgcgaggttgtataaagtcagttccttttcctcgccttgcttgatttgggggacaagaatatgtataattaacaagcatcttatcttcgactatcccttttctagcttgttttgtttagtggtaaaaagtgatccagcaagatttgggccaaatggacagtgtgatattcacgcatgacgcatccgatttgcacctttccggtgttttagcagctcgtcaccggccttggaagccacggtaagattcgtccacgccattcaaaatcgtcccagccttccagctccaccttaaccacagcacaacaacaacaacaacaaaaaaacaagaaaagagaagagacgcgctagcgattaatcgattgactcctcccgctcgtcgtcgtcctggacctgcacgactgcactgcacactgccttcagagctgcgccgcgatggcgacgtgtggcgcggcagtgagcgggagcgcataaaggccccgaaagcgacggtttccgcgtaaagacagcggcttcccggctacgccaaagttaatgccgtctcgtcgtcgcacagcccgggccacgcttcgcccgccgtacgtacgtcgtcgctcgcggccacggcggctcgcctgtccgcgccgcgtcagcctggaggaacgtgtgcgtgcgcgtgggtgatgggcgagctccggaagacgccaatgcggccgctcgagaagcctgcgagacggtgcgtgaccagtccgcgctgccggcccgatgattgtctttcgtgcaagagaccatgtgccggcgcgcgaacgatttgatccttgtgggggaaggctggctcggattagacggatggcttggcttgatccgctgggttaactagcctaacctggccgctagtttgcctaccaacaacttgtcccggggttaacatcttaacgagtactcctactctcgtactataccagttagtcctactcccactgcacccaccctgcttttaactcggtccttgtggatggattgcgtgaacaattttcctttaggtccggctgactcgtcgttgccgatggtctgaggcacaaattgaatactcatagctttgcagtgggggcgcattcatgggggaatcgcggtttctgcgatccccaaatcctttgcccaaatcgacgttgtgcacgtaagcctgtcgattttcgtggtgatcaatactcctgctatgcttttataaattccgcggtcaggcaggtgtcggatcctcgtcggaaacgacacttgagttaagcacaagtctccgctgtccaatttcaatctatattggggttaagtatacggattgtatcactattagtatagtactatagaaatactagtcgtagtacgttccagaatcaatcagagtactgcatacatgcattcccgccataactagccagtggagaactggagatacgtgctcggagaatacgtctaaaatcacggcggcacacctacgtcgatcgatccgtgcaaccacttgcaatgagtatccaactgtccgtgcattagcaggagctcttgatttggctcgcattggcatggaaaaggaagattctgtcgagcatggcggcacgacgacaaggcacagagacgcagaccaacatggattgatgcttctctactgctctgctcctcaagcaacagtgatgagaaaaccacatgaaaaaaggtcgcggagaataaagaccgtcgtcgtgcatgccatccatcgctgaatgactgatcgatcggggcaactcaaaaaaaaaaaaagactgatcgatcggggccatatggtgtgtgttgtgctgccactgccaatttccttggagtatcggacacgttacgtgcagcgacgggctaatcttttcccgtcccttttttcgtctcctccccaacgtgcatacggtctcggcctctccgttgttagatcgcgaaccggtttgttaatacggcgagaagggtgtttacgatccctgcgtgcggcgaccaggttcagccgttcaggccgggggggagccaggtgtcccatcccatggcaagttcgtggtaatgaggtccaactggcgagaccagatgcttggggtacaggctggcgagtcgtaccaccaatctggaggcactgtcacgcacgctgacggcagtacggcgctctctcttgctcgccatgggacacagctgcgcatctgctgtgaggactgaagagagagagagagagagagagagagaggaggagctgttggcttcatcttgtcactgtctaggggcatccccttcaagtctctcagctcttgggagctgggtcttttgacggtacgagtagaattggaggatggagcatactagcagcagcccgtttgttgcctggctggtgtacattaggcaggtcttggttggatccaaaaaattttggttaaaaatataaaattaaatgtttagacattaaatgtttagacatatgtatgatttattaaatatgaaaaaaaaatcaattacgcaatttgcatgtaaattacgagacgaattttttaagtctaattacgttataatttgataatgtgatgctacaatagctaaagaactaaacagtgtagcagtagaagtagtaggaatgcatgcataaagtgcatcttcttctagatgcaacccctttcatacttctagtactgactatgtttcggtttcggatcaggatgagcgtgtagttggcatacgcgggggacactacgaaccaaatctttgtgcttgcttgtgcctgattattggtggtatggccatggcataggcatggatatgattgattgcagtttcaccaacaaaagaaaagtcaaagcactcacggagattggagggtgtgttacacttatgtgccgcctagtagtagctcgtaatctaggctagtagcatcccgtactgaagcgaggtcgttggaccatacggaggcagtagaagtagagtactcgtactccacggtagtactactgctccgtccgtcacaaaatataaatatttttagggcctgtttggtttccagagacttattccaagtccatgtcatatcggatgtttggacagtaatttagagtattaaacatacactaattacaaaacacattccatatccttggactaattcacgagacgaatcttttgagtctaattatgtcatgaatttgacaatgtgatgctacagtaaactttttataattatagattaattaggcttaaaaaattcgtctcgcggattagctctcatttatgaaattagtttttttattagtctatgtttaatactccaaattagcgtccaaacatccgatgtgacatgggctaaaaagttttagccccatctaaacacccccttaaactcttacatgatctccgagatactattttaaccaacaatatttataaatataaaattgatgttattagatgttttaaataatatctagtaacatcaattttatatgattgattttttatttttttttgttattagtggtcaaagttaaaaatatttaatttgtcactgtgttaaaaatgtttatattttggaacgaaaagagtagtagtttgagtttggcgttgctcggtcaaaatgaaaattgcctggcgctaaagagcatgagcaacgctgcctggcgctaaagagcatgagcaacagcagcagcgcgtcgccgtgctcttcttccgtacagcaggcatgcgcccgacgcagcacagggattgtgaaaagctgggttgggcggcccggccgcggctggctagcgacacggatggccagagagaggccgcgacgtcgcccgatcgctagtgtacggagaattgatggagtttcatcgacacgcggggggtgcgaaaggctgctgtcgcctgcgcgatggggggcgcaggcggcagacgcaggcggcagctagcgcgcgtccacgcatcggtgtatcgcgcaggcggcagctagcgcgcgtccacgcatcggtgtgcgctccccgccgcgtggccggtggtcaatccgcaccgccccccgccgcgttctcctcctggcgcgtttcaagtttcctcgaccccccctccccccatctgcacatcacggtgcggtttttaattttgatagagtaaattgtacttttggttcaccttttattacccaagttttaatttagaccacccttaaatatattttttaaatttagaccgggtaaatttaccattgttacggtttggactattatgaacaacttttctcgtcatgtctaacttccctttcggcaaacatatgaaccacacatagagaagttcggccgtatactagagctaatgtgtttaacgtcattaattgtacttaaaaaaattgttcgtggtggtccaaatcgtaacaatagcaaatttattcggtctaaaatgaaaagatatgtttaagggtggttcaaagtaaaacttaggtaataaaatgtggtccaaagcgtaattcactctttttgataagagtactgtagtaaggtttggttggatttcgaaaacaagaacatatgctgccgcatacgtataatgctgtttggtctttgactcgtgtttctgttctgatgccaaatgtgatgcactagaatggcctgatgctctcttggtcatcagattgcgttggtcatcagattggtgatggtgggaaaaggcagctactgactacgttccagaatacttgtcattgagtttttgtttataacttttaatctttcgtcttatataaaaaattatagaattattatttattttgtttgtgatttgctttattatcaaaagtattttaagtatatcttctctgtttttatagttatactaatttttcaaataagatgaatgatcaaatattacaagaaaaaagttaaagcgactgctaatttaagacagaggtagtaggaatcaaagggaggagtaaatcaaatcgaatgattcctgtccaactaaccctgatatttttttgcaagacaactagacaagcatttgcatcgagtcaaccagccctgggtaagtagcttgagcaattgaataataaagaagaaaatttaacaaaagcttaaaaaaaccattgacttctgtttagtttctgtttatcctacctaaacttgtgtatttaatccctggaacacaaatcattatcttcttaaaaccgttcgttctctccaagtattctccttccaatcctgcccctgtttgtgtaattggtaacggctggtgcatgcctggttcgaacagtattctgtatctgaatatgaactgtccacatatacacattgcctaaagtcgtactactaacgcttaacctgccaaagatatagtattagtactttttctaacagagatatatggtaccttttggtggcatcattatcgtgccaattaggacacctctcgctgtaattccacagtaatggcgtggcctctctttttatctaacttcgtgcaatataaactactattagtcgatcaatatgacgtgctcgttcgcagaaacaatgcagaaagcccaactggttaaaaagaagcaactgaaaaacgcactggtctcccttgtgctgttgccatgtcgacgccaaattcgccatcacctgaatataattttgtctccagtggaggaggtttcacgggggtgcctgtcacgctgatggccatcggcaaccaaccactggaattgaatatcggatcggcaccctgagagcgacgcgacgagatcttagctagcatgcagcgatcgagccttcgatcgacaccagcttttggccaagaaattctacgtgaaagcggtgctcgtgtagagaagaatatcgcgggcctcctttccgatgccgtcgttgtccccgacgttgattttgcatcacgtccaaatcaattcccacaaatttcatgcgcgtcatgtcggggatgaaccgatcgtcgatcgccgaaatcttgacatgcagtgtgtacgtacagttggaggactgggacttgcagtatatctacagtaccctgcacccaatctgcttcagtctgcacaaatcaagtcatcatgaattgatttagaatttccaaactaaagttggccacatgagacctcccattagcaaccacaagtttatagacgaactagtacattcttattcaaaattttaaaaagaaaactgtgtctttcagatagcaattaatggatagtgcgtctttaaaaaaaaatgacactagtactagtcctaataacattgacgattctaattgccggcttatctacgcatggagtccagctgatccatgatgcctactcccgtttagtcgcgtacaattatacgtataagtatgtaaaacgacaacggttgaggtttgcaggccgccatataagtatgttatccgagggcgttgattccttttaaccaaaacagggcagataggttaacaagtggccaggcaaaagaagtgaaattaaattaagaaatcgttgtgattagcaggacaggtgttcggcggcacgtagaatatttttttactaggatccagatacatacgtccgcatgcagcaggtcgccatcgatcgaccgagcaactcatcaacgtctccattagcatgcagacgcggtgtgctatacttttttgtcatgccatgcacgcacgcacggatcatatgtgtgcatgcatgcaatgcgagggcggcaactgctaccatgagcagttggtttattctcatcactcatcagagtatcagaccgaacataagagtcgtagaagtcacgcgagatactgtgcacgcacgtagacaaatggtgatagctaatggtaatttgataaaagtacagcgccggaatggaagaaacgacggagatgggggacagttaggccgtctatctccatcacggtaagatacgttgtcctttttaccgatcaagagcatatcgacacccagctttaagagacagggaaatgcgtctgcagagtggccacttgttattattaccatctggcaccaacacacacagcttagccatccgctaatcagcgtgactggcttgtttggaaggagatttgcgtggcgcccgtgcacgtgttgcatcgatcgatcgacctaacacagccgcagctgctgttagctagctccagagactgacaggaacgtcttacccaccggaggatttgatgggcagcgactatttagagaagacatggtgaataattaaaagggacagtggacaactgggcgtggagcaaaggcgcgtgcagggattagacaccatgagatttgcccgatcggccaatggtcggggttcatccatgacgttgtacgctggattatacgctcttgcaaaagagcaaaagagaaagggaggcgatatgaaacttcgcgtgaaaagatttgaaagtaccagtagtagtacgtactagggtagatgatgtgagggatatgaagtccattcctgcttcgactgtcgacacttgccgcggcccgcgggtttcgtctggcgattccaagtaggcatgatcacagacagctaagctaagattagaggggtaatccgaatccttgctcacgataaagaaaaatcttactactatgtacgaatagtatgtagtactactttttacctgcctttttgctcttttcactctttgtcaatccttttcacttgaacgtgtatagataaacccacgcatatatagaggtggtcatacatgcacatcagcacaagcaatttacgtggggacattcagacatatgactgtatacatatgaaaaaaaatctctagatccgcataaacaacatgaaaagcaggggacacaaataacaccacaaaagattaaaataaattggaaaaccttagacaggaaccgacggttcagcaatagcaagcaaataaagaacacacgatacaccacagaagtatatcaggcagtgagagtgcggtgcgtaattaaaagctgtcgtattcccatcggtgtggggtttaaactggggctaccggtgttgtcatgtggcggtacaatggattaacacgttgtcatgtactcccgtatgatgctgtctcggatgcccggggcaagcaagggcgatggatctcgggcggatcccttggttcagggcctggaccatacagacgttactacgtgtgctatagctttgtggtcctgaaccccacattccaagcagcaaaacgacgttactatggtctgggttcgtgtacggacaccggacactgctgccgcatattcgcgctgccacatttttctcatgtgttggaacttaattggaaatgccggttaatgtgccttctctctgagtagtactgcaaattccctatgcagccatataattcctgaggtaactcactaactcagatgatcgagaattaggccctgtttttttagtttgggattattataatccagattattaggagtaagctgaaagaaatagacaacttattgaagtagcttattataatctgtagcccaacttattataatctgataacctcatttaggtgagctttttccagaatattggatgaaaaattacccaccataccaccccactccctatttagacttgcaaacccaataatctaggctctaataatctagaaaagaaacaactaaccgcttattttactacagattataacaatctagattactcaataatttagattataataatcccaaactgaaagaaacagagccttaaccgccatgttaaagcgccccactaatttataccgtggcaatgagagagcctgtgaaagatgtaaaaggcaagcagttcactagagaggagcgagacggtccatccggtcgggctgaagcatatgtggcgcgcggtacgcctagccatgtgcccgcccggaaccggaacgatccctcccatgtcctactgcgtaccttcgttgtcggacccagtgtgccggtgggagaaacatgtgcgccgccgcgtacgagcccgagcgcacgatcggttctcggcttcctgccacggcccgagcaagctgccgcacgcgaaatccgccgtgcgatcccccttctccacgagcggcctggtgcacgcatgcgcgtgcaccgtatcgcccgcccgcggggtaccgacgaagccagagtcatcagaccaacaacccacgcgtcctaatttgccacggatccgctcccggctaactgctggcgcgcgtcaccttacgcaatcagctcgcggttgagtccgcgggcgggcgtgagcgagacgtggctcatcacgcgcggcacgcggctgggttcttcttcgccgttttccgggactccctcagtccctctccttgtgatttcgttccggtgaaggaccaggtgggtaggtgaaggtgaggcaaggtggcagcccgcactacagccttcgggcacgaggacgagggcgtctcatcaccgcgtgggtctcgtggacgacggaactgtgcaaactgcaaagcaaatgctctgcgcctctgcctctgctccaacgttctggaaggacaaaccacatgccggatgatgcccccttgtttgttcaacttcaggaagggggtatgccactatggcactatccacgagtcaaatgctcaatttgggtatgtctctgttgttacgatgcgatgattgatcgagtgcagtcaggactcgccccggctttacatgattacaatgcaatgcgactgagtggaaccctccaggtgctgactagctgtacgtcgtagaaggcgcagagaacagtattgacctgaacacatgttacaggtacacacattcatcaacttttccacaaggaatggagcccaaaaagggaaccaggagggggacacttgcatttccagaagtggaggcctcaaagcgtcaaatgcgagtgatgcctagcttccggattgaggcaactttcacgacgtgacccttcacttgagcgtccgttctccgtaacgactactcgtttcagcttgttatcagatgaatcagcgaaggcagattgctaaccaactacggggtactagtattcaacaacatgccacatgagagtcgatggggagagagcgtcacccatgaaagaaagaagagaacggcgataggtagggaaaagaagaggatgcttctgccatctctaccaacctgtctccacggataaagctaagcatcgtccgcgagcttggtgatcagtgtcagctttcatacatgcggagcgtcacgttgccaaaagtcagaagctactatacatcaaaagacaaaatggatgtatcacatcacatgtcgcaaaggttagaggataggagatgttggaaaagagctggtggagattacgcagctctacaattgaatgcaatcaccaatggaattgggggaccgtaaagcgttcctatcccagacaaatgggatttcgcaaatgtcaaactttaagtgaaaggttgaaaattgagtgcacaaatgggatttcgcactgacagctgattcatttctgggtgtgcgctttgtgcttaacagtcacgcctgccaaaaagaggacatatcaaggtttaagcgtacaacgaaccaaacaatcagcataggtttagcttaatagccccaaaacaaaaactaaaattcaggtactcagccgttcaggtaagaccaaacaaactgcatccaactgaaatttcgctattgccaatctcctgaaatgtacaatctggaaaacccgtaagacctacattcttattgtctgctacaacaatggaactacaagctatatatggtacaatgtttcagtatggcgggaagcaccaccccttttgttggatgttttttccccaaaagaacagaatggatatagcaaaagtcagactaatctagcgacttaactactccaggagaatcccgaactatacaagggagcaggaataaacattagcatcacgaatgccagacacctgcaattccatgtagccaaccaaattaggctactacattctgcttatatgtttggttgtacaagctagtacttgtcatatcttcaactcgcatggtcatctaaccatatgaccaagtaatgaccatcaaagtagcttgatctagatgcctgcgataccatcttgaaattaacaacctcatatgtagataggtttcacgtcattagccccaaaactcaagctacatgaaggacatctcctctgtcggttcccaagggacttctgtatgcactgattgcagaagagatggtagcacttggtaatcacaacctgcaattggaatatattagatctgaatatccaatgttgattgctcactgttaaagtgtcttttgacaggttatattgttaaaaggacaggttatattgtcaagagtgtcaaagaacgaaatcaagatcatttacctccttctgcctatcatggcagataccacacttcaatatccccctatactccttgacctcatgacgaagcttttccaggactgctgattcacgtgccttggctctaagagagctagctttccttgacataacctccaaatcatcctctattctcttcttactaaacctggaatgtaactcatctcgttagatcagctattggaaaaaattagcccatagaaatgtaaaatattcttatagagcacctctctttctcaagttctataagcagatcagcgacttccaaacgactgcttccaacattcgcttgtattccatccaatgattgcataagcttttgagcatctctgtgcacatcaaccagctttctttggtaattactcaatgaaacagattgttgccatccatcctcttgaagtttcccaacccgatcagaccacattttaagctgggaatcaggggaaaataatattcagcacctcctggaaggattgtattggattatacaatatttgcgttcaacctacctgatcttctaaggaaacaattttctggttgtacagatccatcaaagagctttcctgctgcaagtttctgcgcaaagaatatgtttccaaatgcaaagcatcttgtgtctgttttgctttaacaccctccataaaaatctgcagtgtagatttcaccaaacaaaaatgttacgactactgaaaaaatagtttactaccagattgattcatcctaaagcttccattcctcaatgggattgaaataccaaatgcagagttagcacatttcttattcaatacatccgaagtaaacaagctttactatcagtaaaatttcaataaaacatcaaactaaaattttggatcaaaacatacacaatcactggaactgtagatttatcaggagttcaggacccttggataggctgcctggattatcaagggcactccaaagagtaaggagctatggtacaaatagcacggctaaaaattttcaatttatctctactattaaaaggcgcagtcgtcctgattttctctggttctttgaccttgaaacaacaccatttacccaaaaaaaaaactgttgatggtcatttagaaaaatgttctaactttcttttcaaaaagatatctaaataaagggcaggcaatactcatccaggaatccacaaggatttttttttggcaaccagtagttgctgtccacaagggtttggaactttggcctattttatgaaattccgcatcaccaacttaacgcaagtaaacagcttttcaatgaagtactgagtctccggaacaatcaaattaacaatataaccaaatctaacatcctatgaatatatcagaaacatgaaagctatttgtgcaaccagatttggtacagtggtaaatgggaactcttataaaactataagcttgggagaggattatctgagataatagctttaaagaaatcattgagtcactaccttggtattatcatcatctctttcaataatctgctgtagcaattgttggttttgtgcctgtatgtcctcatatgcttgcccgatacactggaataggttagtaaaagtttcaaactcaggatgacaatgtttaatatatgtttaaagccatacttgaactgcatgcataaaagatggcacacacctcgacctccactctgtaagcttcacattcttcctgtttagacttcagcatatgggataaactgactagatccctgaacacagtgaacattcagcagtaagcatcaatttcctttagtaaccctaaaagagaagtgacccctacttcaacagttctaagagaaacaatgttcagaagcataattctgtactttctagaagtcccaagcttctgccctgattcagcaatctcagcttctgcagttgctagcctctgctgtgtgattgcttcagcttcattggcagccttaacacgctgctctagcttactttcatcaagagatgatttcagggcatgaacatgagcccattcaaggaattccctatctctggattccattatttccctgccacacacacaaaaaaaggttatttccatcacaaaataaataaacttaagttactggtgatgagtgatgaaatgtcatggccatagtagagtgaccgtgcaatgaattaaatacatgataggtaaacaattaaacacggcattacactgcactctgtcctaagaagtgagatgcatctatctctacaaaatatcacaagtcttagccaaaaaaaaaagttgtgttgagaattatatatgatataaaattgaaatacctggaatcagtggattcacgcttatacatatccgcgaacaacttaagctccttattagtttgcttcagatcagaaatctacagggttttggtttcaatatgtcaaattatcatgggaggacaaattcctgcaatagctaaacaaaacaccttaatgaagagaaaaaataagctgagtctaaacaaacaagataccactgattgaagttgtgttatatcagatcccgcacgggcagatctgcatgatgcttcttcattatcacgttcctataaaacaaaataaacagcctgacacattggcgaatcaatgccataacacttgcgagtcatatgtgcaagccaataacaagcaatttacctttctggacagaatgcgagaaagtgaatggacttctgctcgcaaagaattcaactccaaggaagcctccttgtgtttggtcatttcactctgcatcgcgcccatttcccttggtatcgatgacactaaagctttaaattttgtaataacttgattccgacctgacaagtgcaaacaattccttattacctgctttagcaagacaagtttgaaagttactcttggtaaagtgaatagtaactaccgcaccaggttctcttgaagcctcttcaagtttgagaataagcatgtttttttcatcacatagtttctgaatatccttcttgagatcagcaatgctagactcacaatatgtagaaaccctctcaggaatctcagccagatcaactttcaaattaaattgcctttcttgccacacaaacttatccttatcaacctgaaacatatcaaataggaattcaacaaaagatcaaatgctctagcgagacatttttgctatacaactctggaatccaacaaatccactgaccagtaaccacctgtaatttctctaataatgtctggtagtgatccaattctgcttgtgacttctgaagtcgatcattaacaagctgaaaagcttttgaagaacgaatgctcttgaaatccatcaagatattctggaggagattaaaaacacacacacaaagttagtcatacaggttctgatactaaaaaattctcccatgcaataaatattaagcatgggccttcaaggctaagcaaggatgcattctgtgcttgaccaatcaacaaacctgaaaagttgctattttgttcaaaatttcaattctctcttcatgtaatctcttaatttccaccaaccgctttgaaatcaattcctggttgataattgggtcagatcatacatatcacaggtactccctccgtttcacaatgt

SEQ ID NO: 43752 - DNA, 1652 bp, Oryza sativa
cttacattgtgaaacggagaaagtagtaatttggaactttaaaaatgaacgatggcagttaccgataattccttgtgagtagcttcaagatcctgcatctctctttgtttatctctgaccttatcttcaggcatatttttgtttcctaatgtaggatatgggatgcgagctccttgtgaattatctctttgagctttaagtgctcccagtttgtagttagtttcttccaactcagaagcaggactggccaactcctcttgacaaagtaaaccaaaacatctggttagttttacccaatgtattaggacaacgtatctaggtaaaaaaatgtatagggaaaatatggtacaagtctgaagcgctggcgcagtaaatataagagtactgcaacagtacagcctattatcgcaagaatgctctccagaagattgctggttaatgcgtagggaggatagataggagttgatggcaacatgtttgataattcaagatgtatagcaggtctcaaatgttgcgaaacatgttcctttaaatggcatggatgcttatttgaaagttaaaacaactgtaaagaaacatcagcacaatctctaaacaagataccttttagacgtctatgttcagctctttttcgggcactggaatctctttgattttgataatcctctgctaactgcttgtgcttcaactgaagattacttaatgcttgtacgacattattgaggctggacaacaggttgctactagtactctgtagttgcttactgcggtctacagaacatggatgaaattagtacttcttttgtattagtacaactgaaagctatactctctccgtccaacaaaaaacgaatctagactggatgtgacacattctagtacaacaaatctagacagagatatgtccaaattcgttgtactaggatatgtcacatccaaaactaggttggttttttatgggtcgaagggagtactagttaacagaatatatgaactagaagacgaaccattttctggtaatttagtgagagcagccaaagcacactcctcatttgcttgcaaaagatcacttgatggaaaaaagatatccccaagagcattagctgtggatagatgtaatggaggggcatcacttcccaagtggcaaccaggcaaacaacctgaactttcagttgcaccagattccacaagacttctaagagtgtccctctctatgggtgcacaagtaccatctgaaaagagaaggtttatagttaacctgataggcaactatggaaaagaataggagcggccatcgttaaaatgcatatcaagctcattaacataaataacttataacttattacataatctgaaaagtgcagtttttgcaaccaagcagcattatcttaaacaattgccacaagagcaatggaccacaaagatgaccagatcaaaaggtttttccatagtgataatcatttgctacttaaatactccctccgtcccataatataagggattttgacattttgcttgcactgtttgaccactcatcttattcaaaaaaatttgtgcaaatataaaaaacgaaaagttgtgcttaaagtactttggataataagtcacaaaaaaactaattccaaaaatgtgggtaccgagctcgaattcgc

SEQ ID NO: 43753 - DNA, 20764 bp, Oryza sativa
ttcaggtctgccacaagctgatcaaataaagggattcaggaagaaacattataaagtctgtcttttttggtaaaacatgcccaaaataatagcttacttgttcccaagaactgttgaccaaggaaagtgtctcattatgagtcctctgcttctcttttagcccagcgaatttattttcaagagcacgatactcaaacttgtgggcttctagttgctctgagagcttttggtttttgtatttgagtacagtaaaatcgagctgccaaacaagacaatataagtaggcagtgtgcgaaatcaaaactaaagatatgtgtttggcaacaaagagaaatcactaattcaagcataaaaagaaaagctgaaccaacattcaagtatcttttatttacaacttgaagaagagcagagccaaaacagaacataaacacaaaaggagccgtactgatgatatcaccaacatgataaataggttcatttcatgctacaggacaaaagaaaaaaaaggttttgtgcatggatattccatattggaccaaatacggtaacacatgagtaaacgcataaaaggtatcatccaacatgccattatacccttgacctatccctcccaaaatttaaccaatcttttcccatatttccctcttgtaaaattaaataacaaagtaggcgaataattgccagttgtcaccggtagtaacagcgattaattgtcagttgtcaccagtagtaacttggtgacaaatttcattaatattaatttaacgacccaatttagacctttatctatatcaaaaaacaatagcatatgctatggaaaaataaaaggcgctatgattgtaaataagcattggcacattatggtatcattgccagcaagaaaattaaatttgtccaaagcagcagcggagctagggcccggccaccacgggcaggtgcccgggctccaccgtattagccagtggattaccacttaatgcccctgcttaatctgcttcttttaatagaggctaaatcagctatgcaagcaacaaaggagtcaagacacagcctcacaccaatgtttgctgccatcagcctaaggccaaagctacacagttctccaacagccattatctacttttgacaaaaaaataatacttattaatcctataatctagcccattcgtttaggtttgcccaagctcaagagaacttctagatccgctactagtccaaagttaaccatttcaatatccataaatgtagccacaaaaaactaagatcatttaaaaaactcaaaatacgaaggtttaccaaggaattgccactttctgctatcatgaacacgggaaaacaagaatgcaatgtaagtcaagtaacaatttcacaagtcagcctcccatctatcaccgagtaataattatagaatacatcaattgctctaaagaaccataaacaatcgtgcaatagttgcagaatccgaaacggataatgcatagctcattcctactagtatttttgttttcactctgacaggaggcaatatacatagggcttcttccactaacgaccacaacacagcaagacttgcaattgcatagagctcagcataagtacaaaagcatcaaacacttgtcaagaataaactcatcgatctatactcaaacagtccacaatagatcttttagcggatgtatggattccatgacataacaaaacagctaaaaatcagtcaccatgccaccatctagctatcatacaacaacatatcaaacagtactaccaccataaacatgaactcaaacaaacagtactaacacggtaccaccataaacattaactcaaaacgatacagagctggctcgagatgcgcaaataccttcttatcttcggaggtgggtgcaaccgccagccgcttggcaggagaaacaggggccccgccgccgggcgcgacggagctactgagccgccgcttccggtcgggctcccccgtgctccccataaccctaaccctaacctctcccaggtcctccgattctccacatgcggcgggtgaaaccaaaccccgaaaccacaagggccaaccctcccggccacctaccggtccaatccaccacccaaacccccgccccggcgactcccgaaccctaacacgcggatcaccaaaccaatcgcacccaaaaaaacaatcgcaaaaaaaacaaagagcggatgaaggacggaattggagcgcgggacgagcggatcgcggcggaggcggaattcggctagggttgtaggggggaagggatcggatcagggaggtgtgggcgagaggtgggagttagcggtggttttggcgtgtgcactgtcaaggggggaggaggtgagaaccgtgaggagaaagaagagaagggggggaggagagctaggcgaacggcgcagagaggagagagaatatgcgtgtggggaggcggagtgagttatctcgggcggaggcggctgttcgccccgctgcacggactccgtgcttctgtggacagtggacaccagcgggcatagggttggacctccgtcagtcggccttttaacagccagcccagaatggtgagaacgacaatgttcaatatagattactgtcacaaattatttattttgttatatatatgataaaatattgtttttaaaattaacaggtactccctccgtcccataatataagggattttgacttttttgcttgtactgtttgaccactcgtcttattcaaaaaatttgtgcaaatatagaaaacgaaaagttgtgcttaaagtactttggataataaagtaagtcataaacaaaataaataaattccaaaaatttttgaataagacgaatggttaaacactgcaagtaaaaagtcaaaatctcttatattataggacggagggagtagcgtataagcaagtactggcacctgaacctaggacatgcattatttgatcttcatgataagtctttcatatgaagttctttttatacggtgtgaatccagtgtattacaattttcaatgtaaagctttgattatcagtgccatacaaggtcatattactaagcaatagtaagttgttggttcatgtggttgcaactcttgttaattaactcagatagcttgtttttaagaaaaggttaatatggttattttgaagtagtcttggtctttttcattttaaattttgttttaccatagttgaattggtcatgaatatagagaggttagccaataatctattgcttaatactattagttaaggtttcagtgtttaccacatgacggacatgagcaatactctggtttctacatgtgataatatcggtcgatcataacattaatgtggtaggttggtaacggaaggttaaagcatgataactgtcgagaggcaagatgaaaactaagatgttcagaaatacaaagatacatatatatgaaccatttggtcgaggaaaagtagtcctagagaagcataccacgtggggaacaggggatgaaacatgatggtatgaaaaaaaaaacatgtcctctatgcacacacatgatgtatgtgattgtcgtattggggataaagttggttcaaatgcacaatgcttgttagtaccatattttctacttatttttactcaattacaagtaaaggcggatggtgtatggatacattgagagtatctttttgttcttctaatattgcatgaagggatgttaacgtttagatatattagatcatatgcatggattcaataaaaaaaatacatagtacatattcaagcaagataatactacactatgttatcatgtagtgcacaaaatgaccgatttctcgcatctaaaacatgacaaacatgtaaaaaaaacaaaggttagccaaactaattgcattagatatttagatgggtcttgagcccttgacccattttccgtgtcattgaagtgcaatctatttatgcgttcgcgaaaaaaaacattttccatgtcacaaggtaattgaataatctaaacaatacgttatctaacagtagctgctaaaaagttcaaataatctagttagattttgaaataccttaaccgcatttgtcagctatattaaggccctctttgtttaggcttataaaccaacttataagtcgaaaagtctaagcctaaacaaacaaacagcttttccgtttggcttttttgaagccataagccactctagcactattaagccaaaagctaggttggagaagtttttttggcttatgtgaggtagatatatgactcaactactaaacttaggacattaaatccaccggcttataaatcatataagccaataagctgacttaaaagtctagaccaataagcctaagcctaaacaaagagggcctaacatgcggaaaaggctctatgcacataatttttcgtataaaattgttacaaacattgacatggcatgatgcaaggaaatctggatttccaattactcctatctagtaaatcaagaggttgagaatttcgattgtaataaaaaaattaattatgtccagcaaatgctcttaaaaaataatgaaagttattgacttgtcctaatcaaactaaatttggatttgctaatatctatattgtttttagcatcgaagccgcttttacccaacaaaaagggactatattgcgaagtcaatctaggagtaaagaatttatatgctaatccatcgaaacaaatgttgggattccactaggattgatttgagggatggcaggattttgtgcagcgctagcaggaaaattgtttactatgacccgatggagcataatatttaacatgtgtattcaacagatgaaattttgaatctgttagataaaaggaaaatgcatccatctttagttaaaatgaatacgttccaatggtttgcaatgccaagaggagtaaaaagaaataaatactatagttattcctttctactcctacgtcttatacggagatagtctagtttattatgaacagatgaccaaaatgagaaagttacataagtcttttaaagtccacttcccaataatttttccttatgtaacttactcattatagcttcggtcatttacttcttattaaaaaaaacatggagctacttggttccttattatgatgaatttaaagcatctacgatggctattgttattgatgattgatgaataatgttactcgagtgagagatgctagatggctgacggaaaccactatgctctaggcaagattaaggatttgttcgtctaaccctcatctaaagggattgagatatgaagttattcccctcaaattctcctataatcattttcttgtgaggattaaccgaacaatttatgcggaaattggtttcgagctcaaacatgttttcattgaagtatttttgttatcttttcggtataactctattatatttttcttcttgtgttgtgtcaaaaacatttctgcttgtgtagtggttcttgtggatagatcatgtatgatctttctccggttttgtgtttcttttgtttcggagagctgatctggatagttcactctttcgtttgaatcaagtagtccagtatgagatgtgtgacaatcgtcagactttgaatccggagacagtgtcagacaaaaaaatcgtgttcactggccagcctcttctacccttcttctgatcctctcccgtatagccatttcgtcgaacaccttcccgagccgactgccgccgccgccgccatgctcctcgcgaagccccacctctcctcctcctctttcctcccatccacgcgggtgtctagccccgctccgggtcccaaccacgcaaagcccatcgccgcctctcccgcccctcgacgctgcctccgtctcgccgtcacatccgccgcggcgccggctgcttcgtcggcggaggcggcggcggcgctgagccgcgtggatgtgctctcagaggcgctccccttcatccagcgcttcaaggggaagaccgtggtggtgaagtacggcggcgcggcgatgaagtcgccggagctccaggcttcagtgatccgcgacctggtcctcctctcgtgcgtcggcctccaccccgtgctcgtccacggcggcggccccgagatcaactcctggctgctccgcgtcggcgtcgagccgcagttccggaacggcctccgcgtcactgacgcgctcaccatggaggtcgtcgagatggtgctcgtcggcaaggtcaacaagcacctcgtctccctcatcaacctcgcgggcggaaccgccgtaggtctctgtggcaaggacgctcgcctcctcaccgcgcgcccctccccgaacgcagcggccctcggcttcgtcggcgaggtctcgcgcgtggacgccaccgtcctccacccaatcatcgcctccggtcacatcccggtcatcgccactgtggccgccgacgagaccgggcaggcctacaacatcaacgctgacacggcggccggcgagatcgccgccgcggtcggcgcggagaagctgttgctgctcacagatgtgtctggaattctgcccgaccgtaatgaccccgggagtctggtgaaagagatcgacattgctggggtgcggcagatggtggccgacgggcaggtagctggtgggatgataccgaaggtggaatgctgcgtgcgtgccctcgcacagggcgtgcacactgcaagcatcatcgatgggcgtgtcccgcactcgttgctgctcgagattctcacagatgagggcactggcactatgatcactggctgaggtgattcatcccgtcgtggtattctccggtgcctctcttctcatactgtaatgtaatttgcatttgatatgcctcatgattgcaataagaattgtattcctcacacctgtagctggttgagataggttctgccatccgtttgttctgtgactttgttcgcaatggtgacatttttgtagtttgtgctataaatcgaatcaattcaggttaaactgtactcaagtaaagttgttcttttactgttgtttgggaataacatgggcatgattcaccagcttcaaacctgagtgctgaaagagtatgggtgtagtagtgttaggttcataaatatggaatgtgtgagctgtgagcttgtgactgagataaccaattcaactttagctaacactgtcttttgacccactgatcgtagaaggtttatattaatcaggaataccaacttcaacaaattatgtaccttatccagttgtttgctattagccaatgagagtattttcctccatgcctctactgccctttatcatcttatcccattgttgagatatctgctacatctatcatggaatttttgtgagtcatacagcacttctgatcttagtcaagaaagctccaatgatgaaagaagcaaatgaaaattctttagttttgttcagcctcatcatgtttgtatttaaaatgcacctagtatgcagtgcactatcttaaaaaaataacagattcaaacattcactttcatttgacactatgccagtacttcctctgtctcacaaaaaacaaattagtataggatgtgacacatcctacctgttcctattcgtagtactagaatgtgtcacatcccatactagttttttttatggggtggagggagtataacttccctgtcccgtcgcttcgtctttagatttgaatgtcagcagctcgttaacggtatgacaatcgattgacatttatattttcacttattgttctatttattgtattttgcattattttttattattcatgacttctatgaaatcaacctgcatatgtatatctattgtagcttacatatattttttaagtattgaatattgacatcaaggtcttagtttcctctttttgtcttgatctgttttaatcatatcataaatgcaaaggtaccagcatggtgtggtcaagagtattatagtttgcaaacaagctgtctatttcttatggccaacatagcacactggctatttatatacaatacaatttgctttggtattgcttggagttcggatcattgttcaatcccagtgtccagtcggttactgatggtacacataaaactttgtccaaaacatgcatcgcaatggacaaaatagattctgagttactgtggcattccgcctatggttatttatgtctgaacttggaataatatatcacattcactgttccaaatactttacatgttcatacgtctaaaaattttcgtatcttgattggaatcatggatgctgcatccatactgcttgaacatctttatgtgaagttccaggttcacactcaacttattttgttccaggtttttgtcattctttttggagttggcctggtgtgatatgatagattgaactgtgaaccacaagtgaatggagaaaatgacttgatttggcaccactataccaaggttctagctgtgactcatgaggtttggagaaactgatggcatggagggctggactggtagagctctgggtccttgcagacatcattcctctgttctttccaccaccatggcatggtcagagcaaattccacttgcatctaatggaacggtgccttcttttccgtatttaagtactgtattagtggaaactttcagtctttcattgtgccattcgtcatttctgatctgttgtgtgagagaaattttgagaaaagggaggaaaagctctaccccttcacttggcgttacagaatctattcctcattatgttgtctatttactttttgtgcgatactgatacggtaagcatatcgtagtgctgtttagtgtctgttgagcacttcagccccttagaactgttgtgcttagcactacaatgcttgcggctatataataataagacataccttcagatttaaggggccatttctgtttagcttgatttttttccccaacatgttgttctgttcattcctttcggtcagtgtttgtggtagccatttgtcgttgcaatcagtgtttgtagtaaccattccattagcgaaacactttgctgtcccttaggtgctacagtgtcgagacttgccagtgttcagcatgtatcacgtttttaggactttcagagttcatttagaaatcatactacaaaacgaaaggacgtcctatctgctgcggatgagttgattccgttgtcgaatttgtctgaatcattggctagggatgggctaatattgtctgaatcattcgacaacagccgatggctcttggggactggattgtgacttgggagaagtttcaaactttccatccttttccaagattattatagctacaggttctcagataaaaaaaaaggattactgttactgcaactagccttgtattgttctaacaggcccgtttatatatcttttaaattacgtagagacactgcctcactattattattgtttgtcactgttcgatataaacagtgtagacgcattaccgattattccaatactgcaaacagtccttggattccattccttaaatgccaacgattcctggtccaaaacactccaaaacgaaaccgaaagaaattcagatttaagcaggtcatctccactgcacatactactcaaagagatgcttaattatcaaaagagagtaaccatttccttcttgttaaatagattaatctgatattttagaacaactttcatattgaaaattttcgcacaaaacacaccgtttagcagtttgaaaaatgtgccatcaaaatccaaaacgaacggggcctataactgcatattctccggggaaaaatattgaactggaattagccattgttcaaacaggcccatttatacatctctttcaaattacgtgggcacactgtctcactttgttttgtcattgttcgatataaacagtgacgtattaacgattattccaacactgcacacgatccttggattccactcctaaaatgccaatgattccatttccaaaaccatccaaaacgaaaccaaaagaaacacacacaaccaaatctgtaccactaggcaggtcatctccactgcacatactactcaaataaatgcttaattatcaaaagagaggaccattttttttcttgttaaacaccaatagtactagtaggtttatatttgtagagtactaggtaactcccttcaactatatacttgatttaaagcacgagaaacgagccaacgaccgaaggaggccaagtccaaagatggcaacacaagcgattgcaccgatgcacgccgccgtcgtgcaccgccaccacgttctaccaccccgccgctgcgtgcgccgccgtggcgtcttcgtccgcgcctcggccgccgccgccgccgccgccgccgagacggacacgctgtccgcggccttctgggactacaacctcctcttccggtcgcagcgcgacgagtgcctcgactccatcccgctccgcgtcaccgagggcgcgatcccgcccgacttcccggccggcacctactacctcgccgggccgggcatcttctccgacgaccacggctccaccgtccaccccctcgacggccacggctacctccgctccttccgcttccggcccggcgaccgcaccatccactactccgcgcggtaagtcgcgccgcgcgcatgcagcagcagcaggtttgtcagtgagagcgacagactgacagtgcacgcgtgagtgacgcatgcaggttcgtggagacggcggcgaagagggaggagagccgggacggcgcgtcgtggcggttcacgcaccgggggcccttctccgtgctgcagggcgggaagaaggtgggcaatgtgaaggtgatgaagaacgtggccaacaccagcgtgctgcggtggggcggccggctgctctgcctctgggagggcggccagccgtacgaggttgacccccggacgctcgagaccgtcggcccgttcgacctgctcggcctcgccgccgccgacgacaacaaggcaacgaacgcgtctgcagcacgacggccgtggctgcaggaggccggcctcgacgccgccgcgcgcctgctgcgccctgttcttagcggtgcgtgacactgtaccggagcagcggcctccacttcgatcgattcggaccgaactgatatgacgctggtgcgcgcgtgcgtgcgtgcggtgcaggggtgttcgacatgccgggcaagaggctgctggcgcactacaagatcgacccgcggcgggggcgtctgctgatggtcgcctgcaacgccgaggacatgctcctcccgcgatcccacttcactttctacggtcagctcgccatcgcctcgaccaaccacgcattttccattcgctcctccaaaaaaaaaaatcacattgaacggcgtttccatggcagagttcgacgcccacttcgacctcgtccagaagcgtgagttcgtcgtgccggaccacctcatgatccacgactgggccttcaccgacacccactacatcctcctcggcaacaggatcaagctcgacatccccggtaaggaagagaaaacaaaagaaaacttgtccatggaatgatggaatcgtgcgcgcactggcgtctgatgctgacgtttggtatgcttggttggtgccgtgttcgggcgtaggatcgctgctggcattgacgggcactcacccgatgatcgcggcgctggccgtggacccgagaaggcagtcgacgccggtgtacctgcttccgcgctccccggagaccgaggcgggcggccgcgactggagcgtgccgatcgaggcgccgtcgcagatgtggtccgtgcacgtcggcaacgcgttcgaggaggcgaaccgccggggcggcctcgacgtccggctgcacatgtcaagctgctcctaccagtggttccatttccacaggatgtttggtaaatttcaacgccacaaaaaaaaaaacagtaatccatatttgctcgttcttgcatttgcacattgctggaacacaacgatcatcgagtgatctgcatcacaggttacaattggcaccacaagaagctggacccgtcgttcatgaacgcggcgaagggaaaggagtggctgcctcgcctcgttcaggtggccatcgagctcgacaggacgggagagtgccggaggtgctcagtcaggaggctgtccgatcagcacgccaggccggcggacttcccggcgataaacccaagctacgccaaccagaggaaccggttcgtctacgccggcgccgcgtccggctcccgcagattcctcccgtacttcccgttcgacagcgtggtgaaggtcgacgtctccgatggatcggcgcggtggtggtctaccgacgggcgcaagttcgtcggcgagccggtcttcgtcccgaccggcggcggagaggatggtggctatgttcttcttgtagaggtaagacggagtgcccgttccatcaacatgaagtacgagtgttttgttttttcttaagatttagtacaaatgtttactactgaattaacatcaagacatgtgatgtctctttgcttcttgacagtatgcagtctccaagcacagatgccatctagtggtgctggatgcaaagaagatagggacagagaatgcacttgtggcaaaactagaggtgccaaagaacctcacttttccaatgggattccatggtttctggggagatgaatgagcatagagcaagcatcagatccagtctaactctggagagaaattgtcttgaaaaggcaagaattttgcctcgtgtattgataaaagagagttttgtgataatctgtacatggtggagaggaattatcaggggaaccaaataactactgtacatccagtctcggaatgaaaattcgtctcaccaattcattaaaatcctgaaatactaatgttttaaggcaataattcatagtattcccatagggtaaacatataagacctccactgagaatcttgatgtcttggcaattttaaaatgaaagttcttgaactgacaactaagaatgataccatccatgatcttaacccattcgacaagaatttaaaaggctagaacatatcctgtacacagctaacagaccaccaaatgtgaagtcgacgaatttttggcatcacttaatgcgagccacagtcaccacaatgaagacgaacactgcgagcatgaaggacattctcactgtatcgtcatacaaatcatagtcctcactctgagcttgaaagagcatgttcacaagcttaagtatgctctcaaggaattccttgatctttgcttgggtggtttccatgacccacttcatcactccaggagaagcagaagaacttccattgggatcagcctccttagctgaacgaaagtaccaaccagattaatatcgcttatccaggcccaaattgatcttttattttattattaaaagatgtacttaaaatgctaaagctaaaagccacataccatcctgaaaggacttcctgaattcttgcaccacctcatttttcatcacggcatcccatacagacttatcagttgacaaggccataaccattttctgcatgttgggagatgaatgttaggcaaagaccgaaagaataataggtcatctctggaaaataatatttggtgctaccaaacaaacaagttcatcattgctatacataaataggaactgaatcaaacccacattcacctggacagaagaatctacttgcaataggtggaatgcatccagcacattccgatgttcccttgtcaaaagagcagttgagttaaggacaagcatagcaggttcaatacattcctctgatgcagtgtctggtgtagagtgttctaagctggctaattggtcaatcttaacatcagatggagtagaatcctcaatcttaatatcagatggtgtagaaccttcagaaaaataattaacaaacattccagatggaggaagtcctgagatgggggacaatgcaagtgcttgggcaggtgcatcagaatccaatccaggatggttttcaaataccctgcatgcaacagaaaacagtgtgtgtttttttatataaaatatgtaaaaccagattgcataaaattaatcaactgaagagctgataaggtctatcaataacagaggggataacaaagcaatgacgagcatgtgtatgcagttggagaagtactacaaaaattgcttcttttagcaggataagttgaaaattggagatccaaccgcattgtacggcattccacatctagacggtgcatacacaacgatttcaggaacatacaaacatagcttgaccgtggctataggcataataacttccacgcaacaaatttgtaattaaaggacgattatcaccgataacaaaacatggaaaacctccccccccccctttttatattattatagaagaaaatcaattagcaagtaattaaacaaggcagttccgatcttttctagataatcaaagatcaaaacttgtaaacctaagagcatcaagtagaatcttactcttggatgctagcaacggcggcgcggacttcctggtcggtgggcggggccccgaacgcctccgcgtgctcatccgccgcctcctggacagcgtcgaacgccccagaatccgccccgacggcgtcatcgccctgggcgacgaccacctcccagtcctcatcgccatcaaggcggagcgcgcgggactcccagcacccgacggaggcgatggagcaggccgggggaggcgaggcggcgcgcagggcacgggccccggctcgcgtggcagggcggctcccgctggagatggagacggcgggagacagggcggcgccaccgcggagcgaggaggagccggcgaggcggacgaggtgcttgccgccggccgggttgctcatggcggcggcgccctggtggagcctcgcggacgtctcgccccctctccaagagctctccctcctcctgtacaccacgtggacaaccatggcaggggcctcgccgtcgccggctcgcagctgatgctcctctgcctcccccgccgcggtttgttcctcttcgccttccggcgaggcggcgtacgaagtgggagaaccggcagatttgtttgggttccggaaccaaatcagtattcggtttattattaagatgggtggggtggtttgttaactgatgatatatttccgcaggggaagtgtttgaaagtacaactagtaagttattatctctatctctttctaaatgtaacttgtagcatatagataaataaaagaattaatttttatagggtgtagctatatttatagcgccatatttttcatcaaaaaatagtcggcatgtatttacattgtaagtccctaaattacatatgtaattttagtgtatttacaatgtaagtctcaaaattacatatgtaagtactaaaattacatatgtaaattcaaaaattacatgctaattgcatatgtaagtggggtgtaaatgaggtgtaactactgtgtaagtggctaaaaaaaatcgactgtagcatatggcgccatatttctagcaactccatttttatatctatctttgtgaatgtttaactattaaatgaaataatggacttttcatatctactttgttaattgtacatacgctagtttttattttttttagcaacatatgtagtgacatactaatttttaatatatcacattgtgtttatttttttagcaatatatgtagtgacatagtaatttttaattgtaaatgtgcttttaatatatcacatttgttgattttttgtgtaatatttgaagttctacatttgacacatgcacttgtatttaggctaattattctttaaatggtgacaacgtactcgtagacaagggggtgcccgcgatgtctatgtcaatatcaagatttactagccaaatatttatgagttgcttttatggtaaggtgtgcgtgtgaatgttcacgagggtgaatatgcgcgcattataagtgtctgtgtttatattatattttttaaaaaatatattatttaaatattagttcttatttattttatcattaaatatacttaacattgacttatattttttatattagcaccaaatttttaatgacaccaatgagcaaatgaaaaatcaacggtatcatatatgagagtatatgaataattttatggcttgcctctccacataatatattatcagtaattttttatcttaatgtattgtagaaaaaagtttatatatttctgcaagaattcaactagagaaacttccgcccatcataattgccaaaatattttaaaatataaaaaacgaatctaaagctttttaaaaatgaagggatgtcctctttatttttccttctctcacaaggcatcgtgcaatacagttcgttgtttagatgtctattcggtcttatttactactagtagcgagtatctacgtcattttcgcttttagattagagaatgaagcttatccacgttgcgtttagcattaggttctgcaacaacgcatttacaatgcgtctatgcgctcgtatatattagtctcgatgctttctcactgacacgtggacacaaagaatatagggacgaatatatcatccccgacgtacctgtctaactgatcgtaagaaattaactcatttttgataaataaaaacaactgcgtgccgcccaaggctttggtgttgcttactctaatacttctactttattcgatttaggagtagaaaattttatcctttggtttgacacggttggcatgactgtaatgtatgccgcatttgctacacagcatattgctgcgacttcaggatgtcgagatcgaacatcatatgttaaaggggatttggtcgtatacatctctgtagtccctaaaaaaaaattgaacatctctgttacagaaaacgggttgggttccacgatcactgcgggcggggtgcgtacgcgattttgtggtataccatcacatcattgcaagaagcagtatggataaatagttttgctctgctccactaggattaacgagcctccactcttgatcatcgtattgattttgcgtgtaaccagcagcgtccgccatgagcagtgcttcgccctagatcgtccaagctgtatgctactacctgttggtgctcccagcgtaacgagagctcggagttgacgaattcagagaccaaaaaaagagacgtggggatcacagtatatcagacggcctcacgtcgctttccagatggccgggtctccgaaccgtaacgcgagaggagacatggtgcgcagcgccagatgagagagacggcgaagcaaaccaacccaaaggatgagatttatgttgagcacgagaccatcaagcaacaagcatacgccgatacgcggattgtgcggcgagatctcctaaccaatatgcgcatcgattcgacgggagctcacttgggttttcgttttgttctccccgcgacgtttagttagtttttcaccgtttagtgtcgtggattacgtggtgagaaataccagcgcgtttaaaaacgtgtgcgtcgatataaaagattacatgcgaagtttatgaaaacacttgtttttctttttcttttttcccttttattatgggcttccatcagcagcgtatcgcaagttgcaatttgcaaccggatacttatccatgacgctcgggctggtgaagaccgcggtttttgcgctgcttgtgcttattgttacagaaaaaaaatccaacattgattagattatcaaatggttcgtgagacacacagtagctacgagaaaacagaagaacggtaagacgtcgtttctccaaacaatttgacgatttgataatatgtttcaattatgcgtagcattctcccttgatcaaattccggtgttgctctgctgccagttttttttttcgccggtctgctgctaaattttgcagttctacagtatgcacttctccggttctgcactagtactatcaggtactagtactatctacaaggccattgttgacttctggaccgtctatatgattagcaggagcccatttgacacaaaagtattcggccgattttgttgggcccttctatattttagatcaaaggaagcccattaacaaaagtactacccaaaccatccattagtccatcacaattcactaggatcaaactgcctactatactagattacattgctttctttccttcaaacatccacaaatccacaacctaataaagacacagatcttacacacatactacatgtaactacacgaaaccaaatgcaacaaagattctaacacgacaaacaaagatttttcgtcagggtgacagactgccagaatgatttcatcacacgaccaccgtttgcacgctcccatggcgcgccgactcgttcgtcgccggcgccggcgccggctccggcacggtcgggaagaccagggcttgatgcaccagcgccgccaccgccgcgccgaccatcgggccggcccagtacacggcctggttgctgtagtgcccgctgacaaccgccggcccgaacgagcgcgccgggttcatcgacgcgcccgtgagcgaccccgccgccagcacgcacgcgcccgtcacggccccgaccaccagcgcgcccagcgccgtcgccgcgggccccttcctgccgccgaagcctccaccccgcgggtcgccggcgacgtgcaccgtgtacaccaccatgaacgtgagcaccccctccaggatccccgccccgaacccggtcatctccaccgcgatcctcgtcgtcggcacggcctgtgtgtgcaaacgcgcgttagtctacgcaaagttaaggacatttcgatcggaagtgatcttgcctggccggcggagatgtagtggaggacgaggcaggcgaacgtggagccgagcatctgagacgcccagtagaagatggcgctcgggacggtgatgtggccgccgatggcgtaggcgaacgtcacggcggggttgacgtggccgccggagacgtcggcggcgatgaacaccgcggcgaagagcccgaacgcctgcgcaacggcggtcgccatcagggacgaggcatcggatgtttcatccggcgtgagcatccctggcaacagcgcgcggcaagttcacagagcgaaatcacgtatgagaccaacaaagcagagcaattcgcacgacatgcggaacgtaggttgcagtgaaacgcatgacttacgggcggagatggtggagccgacggcgatgaacacaaagaggaaggtggagaagaactcggcgaagtacgcccggagcgccggcggcgagaagcagcgcttcatgttggcacagatgttcgccattgcaagtttaccctgtgtgtgtgtgtgacactgtgtttacagagcagtgaagaacacgattacacgaattcgcacagttcttcactactcggggtgtcacagactttatatagaagggccatgggtcgcgaccgtagggtgaaacgttgctatacttcgcagcggttgccgccgcgcccgctcccaaactgaaccgtctccacgcgggcacgcccgttgcgcgcgttcgcacaccgcatgttagagaacgtgtacgtgcaaacttcacaacttacaatgaaccgtgcatatatggtacagatcaatcgagcagttttgctacatattcttttgtaggattgaatcacaataactaagccaaccagggaggtgaatgtttggtatacccaaaaaccaaaaacttttagtggaaataaaagttaccctcgaaatcgacggagatcggtttgaccgagattgatctatcggtctgactgagtggatgccgccggtctgaccgatgtagaacgatcggtcaaaccgccgaagtcgcctgccgctcgctgtcgccgccgccggtctgactgccgtgctcccgtcggtctgaccgccgcaatgccgtcggtctgaccaccggtgagttgccggttagaccgccgaaacccggtgaaacacaaatcgaagaactattaaagtagatgacaactttattgcttctctctgtgtttacaaagtgcaccaacagcactccttacaaaaatttcgactaaactcgaaaccctaactaaactatcaactcaattgctctcaaaagcgataccggaaagcctcacgctccccctctatttatacatgaggtaggcagcctaaagccacgaaccaaactcatactaagagtcctaaacaccttaggaaaccatacagtacaagacacaaactttacataaccaattgtaccaaatttggactccttccaaattcgactccgcatcccatacgtacacaatacctccatcgtatgccatatggaatcttcaccaaccacgtgcatcaactctagccttagtatcccgcatgatatctgaccaccacggacatcgtcttaccaccaagccgactcccggtccatcaccgcaaatattctcccgaggcatcgagtcacctacacatgaaacaaataaagaaaccatattctgagaccaagttatcaccaacttgactcattgttagcaaacaacagtattacatacgtatagtatccatctagaagccataaccatgaaacaatcacggatatccaaagaaacaacccgaaaccgaaaccgacacagcgtcggccggtcagaccgcgggccggccggtctgaccgctcgatcaccgctggtctgaccggcatacacagcccggtcagaccggtcacataaaatagcagtgaatccgatcatcacctgaaaattgattatctccaaaaccacttcgatgataatctccaaatatcaaaaccaataatcacagatgccag

SEQ ID NO: 43754 - DNA, 2131 bp, Oryza sativa
tgcaacaaaaagaagataaacccatctataacagaacaagcatgcattaaagtataaccatgaaccaaaaactttacaattaagcttgaatcaacaatcaaaattcataatttcatacgatttataatgcaacatcttaacaagcacatagtttgaagaataaacactaaacacatatacctattgcatttatcactctttctcaaatgtcctttagcacaaaacaaccaagagaattttttaaccttttcttttcttgagcctttttgctcatatttttctttttattctgggtacgtccctgtcgtcaagactgtttccagggatttggcacacattattttgctcacatcgaatacatccttgtcgtcaagactgtttccaaggattcggtattcatttttttcatatttttcttattctctttttcacaatgagcaattaaatctatttgaggaataacaattcaataaagcatatatacaaagcatttatagatcaaaccatatgctagcatcaacattgcatatttgcttaattcaagtatagaatttaagtgtcatgcatcatctcccttaaaagcaaaatctaaatctcatgaaaagactagaatacatacaagctatgctatagacaaataaaccttcaaagtattgctagcatgcacaagaaaataccatatgtataaacaaagctctcatttattaattttttctcattgtcatattattgcttgataaaaccatgaggtacaaactccccctcaaatcatgccaaaagaattcacgaataagcactaactccccctcaaaataacctccaattctccccgaaaatcaagaaaaaaatcaaagcttttgaaaaagacatccaattgccaacgatatcaccaaaattctcaagaattgacatatatccaatagtattaaccaaaactacaacctcaaatactagcatatgaaaaaagctaataaacaagagagtataacaaaaaaaaatatgtcaattcaaaagtaaatagatgttaccttgaaaagcaatcgtcatcttaaaattgaacactcatggggagtatgccgccaaaatatctacgaacaagaagatgtcgaggcctccgtgttggggttagaaataagaaattttggaatctaacactgagtcacacgaccactagaaccagtaggtacatacgcacttacaaaatcagaattagacttaccaaaaaaaacttacatttttgcttcacaaaagtctgagttgaatttcgcacaaaattgcctcgaggccggtctgaccgccgttgtgcctatggtctaaccgggcctggcaaccggtctgaccgccgatttacttgcggtcttgaccgctggccggtctaaccgactggtcagtgtcggtctaaccgtggtcctcgaattaaaacccgatttttgctaacgtcgttttgcaaaagcaatttctctttcctttttctatttatgggcaagtctaaaacaaaaaccaaccaaatgtccatctttttcacaaaaagaacaagtgtacttctcacgacaaatttgtgaagtagatggttttgaaattgatggttttgcaacaacagaaggttttgcattcacaacatttgatttcgaagaagatgcattcaaagaagacatgatgccagcagatttaaacacagtgttcttaggctcagtttcaatcaaaatttcacctctcctagcaacacccaaaacagtaggaggatgtctagcatgatgagcataagaatcaaaacttaaaccacgattgtgtgtgctaaccttagattgatcaagaatcatgttgaggttctttttaccatcagaaaatctttgcaaagaacttttcaaataaaaaacctcctgagtaagaatagcacaatttttgcaagcatccaaaagacctttttgttttctataagttgagcaagaaaacacctcatcttgtttaacaatttcttctatgtgtttaacacggcttaaagcatctttcaacttcatctcattcaaaacacactgtcggtgacatggggccgggggtatcgtgactagaggcttgggtagccgcgatcactcacgtggcccgaccccctcggggggggggggggggtcgg

SEQ ID NO: 43755 - DNA, 9933 bp, Oryza sativa
tatagggcgaattcgagctcggtacccgtgaataagcggacttgcatgcggtacaacgaagggacgatgagtctcttcgctcgtacattcagcggttctgtcaagtccgcaacaccataccatgcatccccgcacacgcggtaatctacgcgttcagggggggcgtgcggcacaaccgcatgctcgaaaagatcgcctccaaggagccccagaccaccgcggagctttttcagctcgcggaccgtgtggctcgcaaggaggaggcctggacctggaactccaccggttccggtgtggcagcttcggccgcccccggatccgccgctcggtcagggcggcgggacaggaggaggaagaagaggtcggcccattccgacgacaagggtcacgtcctcgccgtcgagggcgcttcgcgggccacccgaaaggggaggcctgcgagcgacaaaaagaaggaggccggcgcttccagcagggagcgcccgaccggcaagtggtgcaccgtgcacaacacctccctccacgacctcgcggactgccgcgcggtcaaaagtttggctgagcggatgaggaagtgggaggaggagaggaggcaggagcgccgtgagggcaaggccccggcggctccctccggcaaccggcgaagtgaggccaagcagaaggcccccgccgaggacatcgacgatggcgacgatgacctagggttccaggagcctggggccaccatcgccaccgtcgatgggggagcatgcgctcacgcttctcgtcggagcctcaaggccatgaagcgagagcttctggccgcggcccctacccatgaggcgacgcggcgggcgcggtggtcggaggttgccctcaccttcgaccagaccgaccacccgccgtgcattgcccggggaggacagatcgcgatggtggtttcccccaccgtttgcaacgtgaagttggggcgtgtcctcatagacgggggtgcagccctcaacatcctttcccccgcagcctttgacgccatcaaggccctggggatggtgcttcggtcgtcccagccgattataggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccaggccccggtggccccatctctgtccatggcgacctcaaagtcgcgcttgcttgtatggagcagcgcgcggaccacctcgccgccgcgtccaagcccgagggtggcaacgagaggctcagcacctccgtcccagccgccccgaggcagcggatgatcacgtgcgacgaggtcccggtcaaggaggttgccctgggcgacggcccgtctaagaccacacgaatcggtggtcttctggacggcaaataggaagacgcgctcgtctccttcctgcgggcaaacgccaacgttttcgcctggagaccggcggacatgcccggggtccccagggaggtgattgagcaccgtcttgccgtgcagccgggcgcaaggccggtccggcagaaagtgcggcggtaggccccggaacatcaagccttcatccgcgaggaggtggcgcgacttctggaggccggattcatccgtgaggtcatccatccggagtggctggcgaacccggtcatcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatacaggtcctacttttcaacgtactactcgaatttctttgggtagccaaataggacgtaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgccccccagcaagcttagggatgtgcaatgcgtcaccggctgcatggccgccctaagtcggttcatatcgaggctgggagagaaggcgctacccctatttaagctcctcaaacgctccgggccgtttatctggacggaggaggctgagcgggccttcactcagttgaaggcgtacctcagttctcccccagtcctggtcgccccggagccagatgagccgctgctactttacctggcggcaaccccgcaggtggtcagcgcggcgttggttgtggagcacgacgaggacaaccctcaccccgcgcatccccaccctgtgtcgactcgacccgggagagagcagggaggagaggcccccgagccgaacggcggcccgaggcccccgacggccggagctggccctccgcctgcttgtcagacggtgccaggcgcccccgacccccaggatggccccggggccactgcgggaaggccgcgcctgtcgccctccgaccccgaggtcgtcggcacagaagccgagtgcgccccgcacgacctctcggacgaagagcgccctggagatgcggcccctagcgaagaggatcggccccgccgaaaggtgcagcggcccgtctacttcgttagcgaggccctccgggacgctaagacccgataccctcaggcccagaagatgctttacgctattctgatggcttcgaggaagttgcgccattattttcaggcgcatcgggtcacggtggttacgtcttatcccctcggccaaatcttgcataaccgagagggtactggacgggtggtgaaatgggcaatcgaactctctgagtttgatttgcactttgaaccacgccacgcgatcaagagccaggccctcgccaactttgtggcagagtggaccccggcccctgagcccatctccgtccccgagaccagctcgggcccctcgcagctgcctcccaccgcctactgggtgatgcagttcgacggctccctatctcttcagggcgccggtgcgggggtcacgttaacctcgccaaacggagacgtcctcagatacctggttcgcctcgacttccgggcgaccaataatatggcggagtacgagggactccttgcgggactcagggtggcagctggactggggatccgccgcctcctggtgttaggcgactcccagctggtcgttaaccaggtctgtaaggagtaccggtgctctgacccgcagatagacgcttacgtgcgccaagtgcggcgtatggagcgccaatttgacggaatagagcttcggcacgtgcccagacgggataacgcggtcgccgacgaactctcgaggctcgcttcctcgcgagcccagaccccaccgggcgcctttgaagaaaggcttgcccagccatcggcgcggcccgaccccctagaggagacggacgcgcctgaacggcccccgaggcccgtcggagtccaggcctcgggacccgaggggagcgctcccagctcccttagattgattgcttggatcactgagatctaggcgtacctcacagataagactctacccgaggaccgcgaagggagtgaacgcgtccagcgcatctccaagcgctacgtgctggtggaagggaccctctatcggcgcgcggctaacggagtcctcctgaagtgcattcctcaggaacaaggcgtcgagcttcttgccgatatccatgaaggcgagtgcggagcccactccgcctcacgcaccttggctggcaaggcctttcgccagggtttctattggccgacggctctcaacgatgcggttgacctggtccggcggtgcagggcgtgccagttccacgccaagcaaacccatcagccggcccaggccctgcagaccatacctctttcatggccgtttgctgtctgggggctcgatatcctgggtccgtttaggcgggccccgggcggtttcgagtatctgtatgtcgctgtcgacaagttcactaagtggcccgaggcttacccggtcatcaagatcgataagcacaccgcgcttaaattcatcaggggcattactgctcggtttggggtgcctaatcgtatcattacggataacggcacccagttcactagtgaactcttcggtgactactgcgaagatatgggcatcaagctctgcttcgcctctcccgcccaccccagaagcaatggccaagtggagcgcgccaacgcagaaatcctcaagggcctcaaaaccaaaaccttcaatatcctcaagaagcacggcgactcgtggatcgaggagttaccagcggtgctctgggcgaaccgaaccacgccaagccgagcaaccggggaaacgcctttcttcctcgtctacggcgcggaggcagttctcccattcgagctcaccctgaggtcccctcgggccaccatgtactgcgaggccgatcaagatcagctttgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtactacgccgcgtccaaacgcgtgctggactgagcaaactctcaccaatgtgggagggtccgtatcgagtgatcggcgtcccccggccgggctccgttcggctggccacggccgacggcacagagctgcctaatccgtggaacatcgaacaccttcgtcgcttctacccctagtaggggtcaggtgtcaggtctcgggctcgggccaaccccgcgccctcccaggcgtgcagagttggccgggggctaccacatgcatatccttatcttttttctcttccgtatttcaataaaagcattttcgatttcctaaggactgtgtctgtgccattgtttcctttcgaagaatcttggcttgaattagcacgctcgtgctcgatcctgccctcggtggcccgggccggctaaaatcgccaaacggggcccagaaccgagccgtgccccggggcgtggtgaactccgggggggaatcggcaaaggcccacaatcgggtcatccataatcctcggtcaccacgttcccggcctggccagtctcgacacacggatctccccaggcactagccccgacccgcgccatttgaggctgggacctgggcacgagccctcgttcaagccaagacacagaaggaccgcggcacagaccatcctcatctcatacacacaacaaacagagctgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcatcgctgtcgtccgcaccaccgtcaccgccctcctcgtcggagtctggcctcttcccaagcggcttcctcagcctggcgagcccggacagcctcctgggcagcttcctcggcttcccggaggcggtttgcggcttctcgccggtcagcttcccgcctccgggcctccgtggtcgccgtctcctcggcctcagaccggccagacttggaatggcgggaagggcgcgacgggatctcgctgaggcagaagaaaaaccagaagacgaaaaacgggtgagtgaaaacttgccttgggagatgggagaatgaatacggccgcagtgggcgcggggatgaacctgcgaggaggtcggctaaacgaccaccttggggggagatgagctttccccggcatggttcggtcccccctatcttgcggagccgcttcttttttcgctccccctcgggctacgacgtcggcacagcaccctccgggcgcctgctgctggcacgcaccaccccgccccctcggggaggagatggggagggggtatcctcctgtttcctcttcccccgggcgtcggcagggcggctgccccccgggcccccgtcacggggcccagaagcacgactccctcccggggtagattgttcccccctgcggctcccgcccgcgccatcgtggcctcgaggagcccgctcccctgacgccccgaccgcctgcatgatggtcaggatgttggcgcgctctggatcgctgcagagggggaggacaccttgggggatgagggatgcctccacggagctgagattcagcacccgttggatcaccaccttgaagtcttcagggacccagtcccatttgaccccctggtgggtcctcatgtagtcctcggacccggtgtactcccaggcgccccgggcgcgccgctggagcggcgcgatccggcgacgaaggtaatcgccgtacaccatggcccccgtgagcccctgggatcgcagaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacttcttgcgaaggacgcagggaatgtagcggttcagcaccggcccccgcggctggaagtagcagccaccgactaccgacggtggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcataaagctccagaacatccatgaagaaagaagagaatggcgggaccagccctgccattgcgaaggaaaggaagaatacggaccgccccgggtagtgtggcgccgggcgtccctcacccagcgcaaccacctcctggccggtggcagattccggcatgaatcggcgcggcagcccggcttgcctctcgctcacgatgcgagaaggcggcagcacgctaccgtcgagcggtgcggagccccgtgccatgacaccggcggaggaggggtttgagagcgagtgagtgcggcgagggtagggcacaggaaacgagaagttagagcgcaagcggcgaaggcaaggggaataatggcgaagaggaaggaaacgaatctcttcctcggcgtctttatacccttgccaacgctatgcccggctcctcgcttcccgcgcccactatctcgccccctcgtttctcgcgcccactcctccactaatcccgttcgcccgtttgcggcgcacgaggcggatgtgcggccgtggcagtcgagatgggacatatcgtgcgcgcgttaactacgctcgccgaccgatgcaccatcatcacatctctaggcgaaacgaaccggttcgtcccgattcgcgcgctactcaagtaatgtagcggtcttgaagaggccgctcattattgtcgatcggtttctcccttgccgatgcgcgcgatttgcgaccgttgggtttctgcccgcctgtggggaccggccccacctgtcaccgggcctaaggagtggcatctcgcccgatcgcctccctcgaggggggcggtcgccctagcgtgacgccggcggctactgtcggtgacatggggccaggggtatcgtgactagaggcttgggtagccgcgatcactcacgtggcccgaccccctcgggggggtcgggcccaacggtgacatggccacccctccctctgtctccccgaggggtcgggccgctcccgtttcggccccgagggctggggcgccccgaccccctgtggcgtcggcgccacgtgtgtgggttaggtgagcaaagcggccctcacctaaccacatttatagcgggttagacgagcgcgtcacgccgcattcaatgcggcgcagcgcatgcttatccggtctgtgaccagtcgcggtatgtgaccggtcacagaccggtcagatcgcgggttaggtggcaacaggcggcctgtcgcacgcctcgctccgtcccgtcggaatgatgagagcctctaggcactcgtccctagacggagccggcgtgggaactcctggagttagcacatcggtctcggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcagcaaataaccgtgctcccacgttgcacctgcttccggcggagtggaggttggtatgacccatcccatcggagggtcattcggacagcagccattgcaaatctccgcccattaatgaaggaaggacagggttatcccggtgtcaggcgaaggtacgagccaagttttggtcaaagtaggatgggtccccacccaaaagaagggtaggtagaaatggtgtatgtggtatccccttgagatataaaaggaggaccatgcctaccaagagaggggactggaggaaaaagagagaagaaagggagaagaaaagaaggagagctcgtaaaaggaagagcggagctcgtagaggagagaaagagtgagagggtctctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacaaatcgagggcttagaatctcacctagcgcccccggccgaaccggcaaaggggggcccgcgcggtctcccggtgaggagccccacgctccgtcatctggcgcgccaggtagggggcatgtgtgtttttctaagctctcgtcctctttcgtgtgcgccaagcttttcccgctcagcccaatggccgaacgggcagtggcgcacaacctctctccgagcgctagcggtgacgacggggagcagaacccacgccgtcgagctcgtactccaccgcccccctctcgccgaagtcttaggcgggaggaggcgctcgagggggtcgaaagatccgcgacttcgccgcccacgagcgatggagaaggacggcgagacggggagcgtcgccttctcgtctacggcgatggtagcacgccccagggcgcgctccaagctgcgggcgtgctcttgtgtcacccgcccgtcgtccccgatccagagactccagcccaacgttggctggatgacgtggccgacttggtcatgacggcgtagcatcgcctaggcaccggtgggcggtcctccgccaccaaggcctctggcgctgctaccgccggctccgtgtcgtcgaggcggagggcgcggcgagcggcggccgttacccgccgttcgtcagccattccctcgtcaacgcctccgacccaagaagatgtgcgtagggggccggatgcccgcctcagtatcgagcgccggcgcaatggtcgtcgtgctgcccacgcaacggaaggcgcttcctcgtccggagcgccacttcggttcgggcgcgggggccagcctcctgtgcccccggttggtggtgtcggctgtcgagcctttgtggcgagccttcggaacgtccgttggcccccaaggttccggcccaccatcaccgagaaatatgacgg

SEQ ID NO: 43756 - DNA, 1141 bp, Oryza sativa
  unsure (1)..(1141): unsure at all n locations
ccaagagaggggactggaggaaaaagagagaagaaagggagaagaaaagaaggagagctcgtaaaaggaagagcggagctcgtataggagagaaagagtgagagggtctctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacaaatcgagggcttagaatctcacctagcgcccccggccgaaccagcaaaggggggcccgcgcggtctcccggtgaggagccccacgctccgtcatctttgaacaatcttgagaaatcaaaacaccatcgttttgttttgccttatttgcacatgaaacattgactaaagaacttgcacaaaaagccactttgtatttttttcaaaacattctttgtcaaaatcaactcatcaacaacacgagcaagtaaagcaaatccaagagcaaaagaagattccaactttttagatttttcaatttcaaattccaatttcttgcaattaacagaattgacatatcgcaaagcactaatttcagaaaataaaacttcacaagattgacaattatcatcattaggaatcaaaaattttaatctagcaatttcagcattaagaatctcaatagtatgatccttctcatcaagcacaatagaacatgtttgaagtttcttaccaaatttgtaagcagcatattctagttgatcataactaagcttttcttcattatcatcatcagattcatcaacatcagaacttgcattacgagcaataaaaactaaatcaacaacttgcttacctttgctctcatcttcatcttccgattcatcaaaaacttttatgagtttttggattaaccacttgatacaatgcttcttcttctccttctccttcatgttcttcttcttgttcacgtcatcctctttgactctaccatcatcttccttcttgcctctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43757 - DNA, 7068 bp, Oryza sativa
gcattacacatcgaaatattacaaatacttcgttttacaacccaacctagttctagttaactataatcaatttatataatgcaaccaaaattttctcaccttcatataattaatggttaaaagtttaacctatagactatagcatcaagtccatcaaattaaaattactttcatgcctcaaccataatttttcatccatccatccaaccaaaccatccaaaaattaacattaccacatatatggttaaaaaaatagtgacaccaatgagtacattgcaaacatgtagcactacaacaagccaatcctaagaacaaatgctaaaaatcacaaatttgggtaaaaaaggggttctagggttacccaccgatctacaaattcaaccaataaaaacgaaaaaaaaagaggggtgaatgaaggagtctacctttctcttcgatttccacaaaaaatcccgcgaaaaacgagttcaaatggagtggatttgaggtggggaggtgaggaggagagagagggggagagctgctgctgctcagctcgggctggtgcttgggcgaaaatgggagtggggaggagataggtggtggggcccacggggtttaaggggtcggcccacagaggaagggtggcgcagccatgctggcgccgtggtataaggggcggcgccagtgtggctggcgcccccttcggcctagtcagcacctccacgacagccctactgccacggtggcacgggcacggcgccagtgtggctggccccgccatgttggggtacggcgccagccactctggcgtcctaaaaaggaccatttccggtttaagtttttttaggggtctatttgtaaaataagtttttaaaaaggatcaaaatgtaaaaaattttagtgccggcggctggtcacactggtcgccaggctgcagcagttggaggagtgcctcgcgcggccggggccgctgctgtcgccggagacatggagccgcgtctcgacggtgcacaccatgagcatcatggtgtgatgaagggggcggggcgcccgcggcccgcggtgcgcgccggccttctgctgcacgcagttctgcttctgtactgtgggaggctcactaaggtgaaaattctgtagtttcttacttctcgcgagagctcctttgggatggggaaaatctggctcacatctgcgaccttgttcgtgcctgttttccttgttgctgcatgcggttctttgcttccttagacctcagagctcagacgtaagcaacttattcatgctttgtaaattgacccacttggtgcatttgtttccaaggacaaaatcttcgtacagacgctcttatgtattcacacagtcaaagtgtttgcggtacatgcacttgccgtagagatctactccctccgtcctatagaaaatcaatagtactataaatatctggttgtaggttgagttttttttacggagtgagtagtgacattaggttgatcagcacctctagcctggcagcgcgctaagccatgtcgtgaccaatcgtatctgaatacccgcgccatatactgtaccatgacgcaatctccctgttccggtctggaggccggcgcaagtacagtacagatctattgggtgggtcagggtggctcgtgcttggtttttccacttttgggatgtactatctgactatatctggcccacggcaccccggcagaggcccatgggttttcgctgaacatgacaaaggctagcgccgcaaccatctgcgcgggccgtgcggctccggttgttctttcgatatgggctattgcgttctccttcgggaataagatcactttgactccctcaactgaccccgaatctaaatcgtatccctcaaccgcaatactagaaatcttaacccccgaacttacaaaaccggtgcaatttgactccctcggtggttttggagggtggtttcgctgacgtggcgcacacgtggcagtgttgacctagtctttgtacaacgtggcattgacgtggcgctgatgtggaattaaaataaaaaaatatatgcgggcccatttgttattcacaaaaaaaaatttgtgggacccattggtcccacatgtcatcctcccttatcccttcttcctcctccctctcctctcttctctatctgtccctctttctcttcatgcgagagcggtgtccggaacggcggcggcgacggcgggcgatggacgaagcagcgacggcggacagagcggcgacggcgtatagtgggggtcaaaccaccccacaagctttggcgagattcgaaacacggcggaggagtttgccgtcgccgagatgccgcagccgccgccgtcggtgtgcacaaggagcgtcacctccgtcgcgctcccgacgcatggagatggcggtggctgctgccgcgtgccgctctccccattcgacgcatactgggtcgcgctgctgttcgtccgccaccaccaccgttcggagacgtcgtccacgcactcagggactccctcaaggcgttgctcccagcgttctaccgcttcgccagtgcgctggtctactcgccggaggaggaagaggaggaggggtcgctgtccatcgtcgtggaggccggaggcggcgtggcattcgtggaggccgaggcgttcgtggcatcggtggtgcgctcgccgcgggggatgatggtggcggggctagggccgcgctttgccatgcagcagcagccgacggtcttcgcgttgcctccgccaccgccgccgcagtagcaaggatttggcttcggcgggtccgggactggagcggtgctagcgccacgggagatggggaacgctgccgccccagcggccatcgagccccctgctcctgccgccaacttcccaagtctctgcgaggctgccacgggcgcggccggcagcaagtccaagaggaaaaaggggcggtctcgcggcggacgtggtcggggagggggcccgtgtcgaaggaggaggaggagctccagtcgctgcttcgcatcatggccaggtcgacgccggagcgctcgaggccagtccaccgccacgcgttggggcgcgcgagctattgctccctttccaccgcggccaccgcccaccttgccgtcgatgccgcggccgccgcccacctcactgcccacgacacagagtggggacaaggagcggcggctgggagcgtgctcccatctcccccgacgcattttgtcgcacgtcgcccgaggtccaccgcccatttcaaggagtagctgctcccgcgcttgtcgcccgaggtccaccgcccatcgcagccaccactccggcacccgctcgccgatgccgccaccgagcccctgccgccggctcatgtcaaggggagagagagagaaataagggagagaggaggaagaagggtagtgagagagaagatgacatgtgggacccacatgttagtgggtcccacatttttttttgtgaatgataaatgggtcccgcatatatttttttattttaatgccacataagcaccacgtcagtgccacgtggaataaagaccaggtcaacactgccacgtgtgcaccacgtcagcgaaaccgccatccaaaaccaccaagggagtcaaattgcatcggttttgcaagttcgggaggtcaagagttctggtattgcagttgagtgatacgatttagattcggtggtcaattgagagagtcaaagtgatcttattcctctccttcgagggaggacaaatatgttccacgataaggccgtaactcgggcctagtatatgcagcccacgacacgcacgaacagcatgccgggagcgcacgcggcacgccaacgccattgatccgccggccggcacccgacgccgcgccgcatacccaccaccactgccgcgacacgctcacgtcaacaagccttttccactgccgcggcgcatttatccggcgagtgaccatgagcccatgatgactcctcccccccggcctcaggccctggcgctgctgcatggcaggcaggcttgcaacagcatcatgcgattcatgccagtgaaacttccgcccgccgcgcctttacacatcagagtcaggagggtgactcagctgcagcctgcagatagctctgtacagtacagggcaatccgtgagagcccggcccgggaacgcgcggtcaacatacgggcacccaccaccgcgcgcggcgcggggcggcgcctcctgtccgagacattcggcgggggctcgcgcgcgcgggcaatgatcattcacaccgtgccatgataagcagtggcacatggatgatggcagtcaggagcaatggctgatatggtcacacatgtccggacgatatggctctcttcctccacacctcccgttcaggattttatcaactgatcgacctcggttcctttcacttatggcgagacaggtgctatctagcagcttattgcctgcgaggccaggccatcatccggttccttgcaaatcaagccactctacccagctttcggatgccatggtttttagccaacagggtacgagtatgaatgcttcaagtgatcataaaatctatagcttcccttcacaatctactcagttcagacttcagtgtatccttgagtgcgaaatttatggcgctaggggaagccatgatcgagcctgtagcattattcaccctgcgtgtgtagtcactaatcaggcacacatgactggttatccaccagctggtcgcatgtgaatggctactagctcgcgatatgattctgacggtgaaggggggcatcatctcggcaggcgttccatcacggctagcagcttcctgcttgccaataagggcgcgagcacgtatagtagtttcagctttctttgtattttcgaaagaaagtttcagtatatatatatatatatatatatatatagtttgtgcttgtgttgcagagcatcatatggcaatccttgcactacagttccgttcgtgccgggcgcgacgcctacttcgcttctacgtcactgaatcgaaggagtgggctgcagttactctccgcgcgcagacaccgcatttacctttgtctcgtcacgcggtgaaagtgcctgtctgggaagtaactttcccgtctcaggcctggcgaatgaattccctgcgcagtgcaggtttgccgtccgggccctagcagtcaaccatgctcgcatcaccatcaggatcagattgcatgtacatgtaacgtgctacctaacaatcctaacaaaaaaaaacacaatcctaacaatcctaaaaaaaacacaatcctaacaacaaggagatattagagaaaaataaaaataatcaaaataccccctattattgaaaaaaataataatgttgataggtaggtaaaggatatttaagagagaaaacttctcgttttatgtgtcgagattacgtaggatggtagaagttggatttttgttacgataaaattcaaatttcagaagttgatttttttttacggagggagtacgccactgccaagttcattcaaagtgagaattacccaaagatcacatcacactcgttggtagatgtacatctactccaaacagcttctccggcatctcaaaatttaacaagggatcttgggactgaaataatagtcttatccacaaatacaagagatttcagtgcttaaaatttatccacggatataaatggattttagatagaaaaaccattactattttgccttcccatctaacattcactgttcgctgttagttgcatcgctatacgtgaattttcataatcaagtatatatagtctcaggaacatgaagatagtaattcacctaaacattaaactttgctaaataatttagaatcaattatatttatggaggaagaaagtagtaggcgctctagtactactcctacttcatttacttttgatatatttccatctgaacaccacaaagctgaaattgacaggatgtggctaaattaaagatcacacaaattaacaaagcaagacggaacctttcttatatcggtcgtaatatgaaaacagaaaaaccgttcttgccgaacctggtaaaatgagctgatcgataagacctggaaaagaatgagctgatcgataagacctggaaaagaatcacgcaagactaaggtaacggtattactactcccactcctacaaactaaggccatgtttagttcccacgtaaaaattttacaccctatcacatcgaacgtttgaacatatgtataaagtattaaatatagaaaaaaactaattgcacagattgtgactaatttacgagacgaatcttttaatcctaattgctccattatttaataatatggtgctactgtaaatatttgctaatgacggattagttagacttaataaattcgtctcgctgttttctgacggattctgtaaatagttttttttattagtgcccaaacaccccatgcgattcctatataatatccgatgtgacacgcaaaaactttacacccctgaatctaaacaccgcctaagtaatttcaccctttgtggcttttatgtctggagatggggacagatgggagcagttggtatggggctaaaaaattttagtcctatcacatcggatgtttggacactaattagaagtattaaatgtagactaatgacaaaacctattttataaccctggactaattcgcgagacgaatctattaagcctaattaatctataattagcctatgtgatgctacagcaaacattatctaattatgtattaattaggcttaaaagatttatctcgcatattagctcttatatttatacaattaattttataagtagtccatatttaatactttaaattaatatccaaacatttaatatgataagtaataaagtttagtcaccgaatgcaagcacccagcagagagagagatatcagctcggctgcgtaggtatggaattatggatgatgcgggctcggcgagaggtcgatccatcgatgaggacgacaatgattggcggcggtggatggtcgaggacgacaggacgacacgcgtgagagcggattgttggtggtggcggtggcggtggggggtggggggtgat

SEQ ID NO: 43758 - DNA, 11893 bp, Oryza sativa
ggatttgcccatcttccctccccccgcgtacgttggccccagcccgtcccatcccacggttcgattcttccatcgctccgcgcctcgcctcttccgccatgcgcccctctctcctctcccctttacctagccatgattgatgtacccatcggtgagcgctgcgtgcgagaggatcacccgctcctcatgtgtagacggactgtcgggcgagaaagcgtacggttccaataagaaggcccttaaactggccagaaaaattacaacccgtgatggcgttgtcctttccctttcttagggcgagatataagctggtttgcatgcgaccatgtcagcgtaggacaaaacactaggggcactgttcagctgctccaggacgtcgacaacatggcgtgcgccgtgcaaagctctaactaggctagagcagccgctagcggtggtacaccatgagagtatttgggaccatttttctttgatgaaaacggccttgttaggattaattttcacactgctatttggacaccattcgacgtgacttttagccggagaaagaaagtgtggacaaacatatagatgcgtgtgggttactgtacacgaattaattaaaacatgtcaaatggtttagagaacattcttttcgtggtatattggatcttacaccgaatcgatttattttttttcaaatcttgttttaggagtgcaattggacatcatcacacacacatttctttacatatatatgcttgcgatattgtcatagacatcaaatatctcctgagcatgagcacacacatacccactaatgcacatgtgtgcgcatatacccttaaaattgataggcactagcactgaatctactcactttgtccaaaaaaaaaatcaattcctttcttcggtttgcagaccgataaattttagcctctcaaaaccctttacttacacactatttcaatactattctgttattaacgagggacatttatatttttttcctctcccttaaatcttttttggatgttagaagtagatgagtagtccattttttcagttgacggagggattagtatttaagcttcagtgagctaagtgcacaaccatatcacccacccatctggtaatatataggccatcctagtgactgtgaatactttaaccttgcccctctccatatttagtgttcaacctccaccaatgtctagttaatgtatctatcgaatctccaatactggctgtcatgcctttaatttttctcacctctcatatttggtggtgctttttatggatgatctgccattgtcccttcctccacacagggaggtggatacaaccctaaattttctgaagatatagttgtttcaatcacggataacacagtcaagctactatgtcagtaataataaaatttgtttacgtatagcagtttctatgcatgttaattatctagtgcatacagtacaacaggaggggcaggtagacgaaactttctctttctaatagtagagatatgctcagtcgctaatagatgataagttcataaaccaaggaatcgatagattatttatctaggggtttaacatctcccattgtaatgtcttcttttgtttctgtaatggtggatctaggaaatgaatggggagggaggcttatctccttcctcctccttcaggcccccctactcttcctcttctccctttctttcctctctcatctcccattttctcaatggtgattcagtggggtagggggacctaagtctccccagtacgtattacgctcaatccgatcttgaatttagatacctttctaaccggaacaaatactaatcggattagccaacggaccctctctcgcatgaaaacaaccctacacatcctcaagcatgaaattaaactaccctccacatcctcaagatttccacccaaatataaccagcactaatcaaacttctcgaatctctatctcctaaaaccaatcaagcaaaagaaacacgtaatcacccgtaataatcaatcagaccaatgaatgtaattaagtgcgtaataaaccccagccgctttcagcccatgcaagagagtccatattgccgtgtcacaaaggtttttgggagggtggacggaaggcaatgatgggatgatgatggtcgcggagatgagccgtggatgtggggcctccgcccgcgggggggataggtgcgcgcgtgccggctcaaagcgggacacgatgatttgggcctgggggaaaggccatgcgaacgcatgaatggacacttgaactggcctttccctgtggcgcctagctagtactgtagctaagcttggcatgccctaccaatgcgagcagagcacgccctctgcaatcatgccgtccatccccaggtccggcagcagccttgccttgccccggcgttggtttttgctggttggtaccagcaactcgatcgaaaagccaatcatttcttcatgcactgctcctacgtgccgcgatcattgcttattatccccaaagctagcatggctctcccctaatctagtactcctgcacctagcatttcaatgtgcggtacagtttctcgtctcctgcttctactgtgtgaaaatgtgcaaacaaatgagcattgagctagctatagctagcaaccttaaaacatcgaaagcttgcactctatctctagctacttgttgactggattggaggatggacggtagtcggttgagattactgaaactggttgtctctctgtttttttttaaaaaaatgttctgatttggcaaaaatacttccgtggaatgatcgccgaaatgtactaattgtacgcgacgacgactagtttattttgcaccacgtacgcacacttgttcacgggccataaatcaaagcgcatgttggtttgctagatactccactccattcggtggaccagattataaaacattcgtcaaagcggaaatgcatgcccctccttatatatatttttttctcctaaaacaaatgctactttgagtggagaatagctgaagttagctaagatagcaattttaagcctttaaggtgaaggaggtggggaagttatgattgcaccaattaaggagctcgccccacaagttaatcattgctgtcccaagaaccgagtgagatccaacattccttcccaccctctctttaaaaccctcactctcccccacttctttatcacttccaagttccaactctcagctagctgcaaactctactcagtttgcatcgagatatacagagatcgagtagtcagagctgagagctagtggagagaaagcaccagggaagaacgcagagagaggttacagggagcgatgatggagagggccgaggacctgcgcctgagcctcagtctcagctcgccgcttattgctcctcgtactcaccatgtcgccatgctgttccacgctcctccaggtacctgtcactagctcgatcgcgcttttctgcggaaacttcagttgtgagactagatcgatttgtgagtagttgctgatgattaacctttgagtacgcgcgttgtgtctgtggattagagaaaagattcctggagatgccgctgctccctgctgcgaagcggagcgaggtcgtcgcggcagaagaggagcgcgcgggcctgcgcggcggcggcggcagcgacgaggaggacggtggctgcggcatcgacggctcacgcaagaagctccggctttccaaggaccagtccgccgtgctcgaggacagcttccgggagcaccccaccctcaaccccgtgcgtaaacacctccgtcctcttcctcttcctcttcctctcctgattaattgcttagtttaactattttcggagacctaatttaacacagatgtatagttcgcgtgcattttctctactactgctgctgctgcatctctaaaccctgcgtgttacatgcgtgcagaggcagaaggcaactttggcgcagcagctcgggcttcggcctcggcaggtcgaggtgtggtttcagaacagacgcgcaaggtacgtaataagcacatgcaataccgtactgtacatcttggggattaatggactgttagtttagtggtttaagcttggatcgacatgagtctcgctctcaattaatcaatcgatcgggattatattctgaaaccattgttctttgcggcctgtgtaactaactcaggacgaagctgaagcagacggaggtggactgcgagttcctgaagcgctgctgcgagacgctcacggaggagaaccggaggctgcagaaggaggtgcaggagctgcgagcgctcaagctcgtctcgccgcacctctacatgaacatgtccccgcccaccacgctcaccatgtgcccctcctgcgagcgcgtctccaacaccaataacaactccagcgccgccgccgccgccgaccgccgcggcatcaggactactactgccgcaggcggcggcagcgtcgtcgacaccgccgccgacgggggcatcctctgccaccgcccgatcgccgtccggccgcagcagtcatgacaagctagctagctttttacttcctagctagacagactacacccgtacactgtccccatgtgtcaacgaggcagcaagcagtgtacgtgcacattatattcgcgcaagctgtgtgtgttgcgctcaccgatcgatcgctcagttgttgtttttttcctttttgttggaagcagctagctggctagctattagcatggtgttcatgcgtcaggtggagtagtagctataggcggcgctgggatagaacaggagtgtctcggcagcttctggccggcggtggtggtgttcgcgggcgggccggctgggagctgggcgtagcgaatatttagctggtccaggggaaagttggatatggtgggatacgggtgtaggggaagtggggcgcagcgggatggcacggtggtttgttctgtcccggctgacgatgacggcgatgatgatgagagggtcagtttgtttgttggacagtcgtttctcttaagcttgattctagcgattaatttaacacgggtaggcatgtgcatttggtctctgctgagcttaatttaggtgattagtagtgtgttctttaattggccggccgggaaagccatagcttgcatgcatgcatgaaagtttccttgtgttttgatgggatattatccgctaactgaaagcgttcgatcggtttgttcgcttaatcatgtgaacggctaaatataaatatgtactactactggatatcgagtaacgaatcatctggatataatcgaattgaattgcccggtcgaggaatatgcaccattcgatcggaggtggtatatatatgtcagttcttatctatgctgattgaatggtgcttataccgctataccaggtgtttgttcttagttgctctcatgatcataacggcacaaattcatcgtacgcgcgagcgtatagctgcaggaagagtgcctaggaagctacaccgaaatgaggcccaaaatcatgtacgtacgcgtgacaccatggcacaatataatcgccaagttcacgtcaaagtagaaatattttccatcactccatttattctcttgttgtacaagtcaaactgttataaagcacaagtgtatcgctcagactctcagagtcactcgatacgtggagagacttgcctataggtggataggaattctcaggctggttcacaaattaatcacaccaaaatttggtaacgccaaattttgatatatttcgacgttaccaaatttggtagtgttgactttatttgttttgatgcttttactatattttggtagagttttaaagagaggaagcttataggtagtaacggctgaagtatgcatgtttagtttgttgttttactaaaatttgataaggtttaaagtggcagccaactgaatagcccatcaatttgaatccgaaaggatatactatatgataccgttgacttggttggatttttttaaaattttaatcatttttttagaccaagtagggggggcgcaaaaacatcaaatttaaagtttgaagtgaggagctaaaaccttcttccaagggtaattttaccgctatattttctagtgtaaaaagttaatacctctaggtactaagtattttaaggtataaaaaattttagtataaaatttagatacctcaagatactttctaaagaactgtaaaatccctcttcttccaaacagagcttgcgtccctatcttgactttttaagtctgacagtccaaaagtttgtttcctacaaacaccttcttgaagccgaagcaaccgagggcgccatgtttcgaagaccacatcgtgtctatgattccatagaacctaggaatacaggaaatagaagaggcaaaattgccttgtaggattcaaataatatcctacatgcattcaaatatggagggagtggagtttgtcattgagaaaaccagatcaattgaatattgtgggacgttgatcctctgctgtactagaatgcagtggtactgtagcaaacttacctcgacaaaatattattattcctcttctgtgttcgagatcactgtagaatttgttttcggccgtttgatgaagatccgacggcaaaaacaacgcctaatgtcagtgtactgtagatcatctgcaatttcttcttcccaatgcagagtatactcgacgcaatgtatcgccagcatccacttcagctgcacggtgtgcgtgcgtgcaatgcctaagagtacgtggacacaaacacgtatgcatgcagctgtagtaccatctcagccagtactacccactgtagctatagcagctacagcggccaaacctttggagtttggaggtcacgcgacccacgcggccgcgcaccataacttggggagcaaaagctggggctttttcccggccgtgttgcatgcaatgttttagtataagcggcatgcattaatccgtgccgtgtgttaccactcattggctcccacaccggcccccgccttttacgagattggctagcacaatgattcccatgggagagcgtactcacatggctggtcgtactgcctgtttgcttgctgctggagcccaaaaaatcaacgggtaatcaagctgaaaggactaaataaagaggccctgtcgtgattaactgagagatttatggtgcttatattagagcatgtcgcgtatgagaccgtctgcagtagtaggctgtaagccactaattaccctatcgtgtttccccagcttttgtcagtgcgctcggcttctaatttgaccacacatgatgtacgctaacgtgctgtcctgtactcctgtgcctgtccaggctagtcagtttaggctgagtttagttccaaagtttttttttcaaacttccaattttttcatcacatcaaaacttttctacacataaaatttcaactttttcatcacaccatttcaattttaaccaaactttcaattttaacgtaaactaaacacaccctcagacaaatcatgtagaaatcagaaagaccagatcgtccaatactgtccagctttcggcccatgggctttagaccatagcctattagctcatactaatcacaacgttgggcttcttttcttcttttcctggattcctaacgtataactggcatatatccgaaaagaaggcactatgtaagggggatcttaatgggcgatcgatcgtccggagacgggggtagcgatcgatcccctcccccctccacccctccacctggtttcctttgttggcaccgcattactttcctattttagtaaatttatacacctaaagtttatacacctcaagtttacacatctaaagtttagagaccaaaagtttataagtcgaaagtttatatatccgattcaaaattgaatttgaattcaaatattttttatatatatagtatttctatacatctaaagtttatagacctaaagtttataagtcaaaagtttacatacccgtttcaaatttaaatttgaattcaaatattttctatatatagtatttctatacatctaaagtttatagacccaaagtttataagtcaaaagtttacatacccgattaaaatttgaatttgaattcaaattcaaatttgaattgaaatattttctatatatagtatttctatacatctaaagtttatacacctagggtgtgtttggataatgggttaggagaggtgggattgtgaaatggaaatgaataaaaggataggatgaaatggaatgagaagaatggatggctaggattgaaacttaccctttgaggggtgggaaatcatatcccaaacccattatccaagggggctgctatacaacggaatcccgttttcgaacgggatgagttctgatacctaacatgtatcatacgtttctaccacatatcaggtgatacttgcgaggtatcagataatatctatcatgtatcatgcgattcttaccacgtagagggtgatacttgtgaggtatcaggtcctaatacctaaccggtatcaagtgatacctatcaggtatcatgcgattctaccacgtatcaggtgatacttgtgaggtatcagatggtacttatcaggtatcatgcgattcttaccacgtagagggtgatacttgcgaggtatcaagtcctgatacctaaccggtatcaggtgatacctatcaggtatcatgcgattctaccacgtatcaggtgatacttgtgaggtatcagatgatacctatcagatatcatgcgattcttaccacgtagaaggtgatatttgcaaggtatcagatgatacctaccatatatcagaggtcgagcaccaaagacgtgcatagccgagtggtcccaccatccaacgtaccatgccggagcttgtcgccgagcggccacatctatccaccatgccgacaccacgtcagagttcgttgccgaccggaccgtgtcctccgccatccatgccccacgccggagctcgtcgccgacggccgcatcctccaccgtccacgccatgtcggagcttgtcgccgatggccgtgtccttcgtcatccactcccaggccggagctcatcaccaatagccgcatcctccaccgtccacgccacgtcggagcttgtcgccggcggccacatcctctgctgcctcgacgagctagccaggtacgtgctcgtcgtgctcgcgccgatgacggcagcgagggcagcaccttcgtgctctacttcctcatctgccgccgtgtccgtgttgggatcctcctctcctacgccggcgccggtgccgccggcgagaggctcgcggtcgtggcgcagtgcgtcgatggtgcgggcgtgggtgccacagccggcgccaccggcgaggagctcgcggttgcgggatagtgcgtcaacggtgtgggcgtgggcgccacagcgccgccacccatgtcggccatgcatgcgtgcatgttggagcggcaccgtgtcctgcacaggcagctgctgctgctgctcgggacgtccatggtcaggtatcgctcctctttgaataagcaagagtcccgtccggacgggattccggtatgtagcattcccgttatccaaacatggccctaaagtttatagacccaaagtttataagtcaaaagtttacatacccgattcaaattcgaatttgaatttaaattttttatatatagtatttctatacataaatttttttaaccttttgtttgtgaactgtctcttctcccaaggaaactactttctgggtatcgaccgtaataggtagagggcgtggtataggaaaggagtagatcaaaagtatctgcgcagaaggaagaggaacaaaggaaggcgacaagaaggccaagcatgcccgacgagtcaactctttaaaaagctaaaatagatgccaaccgcacatgaattgcaagaatgcggttagtgattgattgtgaaaggttttttttaaaaaaattgtgtggtgtactgtaaatgaagagaagaaggggagaaggaaggagggagaggagggaggagtgtatcgtataggggaggggccgggcgggtgatcgctgggcggacgggggagcgatcacccacccagggtaccattctcgctatgtaagagtagagaaggtattagtatctgccaagaacagaatattattggcctcttcacaaatctagcggtaggtaattaggtggtaacttagatttttttttttaatcttccctaccgcaaagaggtaacctgaagaaggcaagaaacggagtgggaaacacacgggatctctttccgatggtggtaaagaatagccgtcgaactaagcaacggataacctgctgcgcgaaagagagcctgacgcgaccgtcttttccctgaaatttgctcccactcttcaaagaaagttggcgtgcgcatctcaaaagaagaatcgcagcgacaaatcaggtcacctcttgcttcctggaataatggggaggcatgcacacggccgggaggccggcggcgatggataatacggcgcacggcgggctatctggccgaggcggcaccctccagatttgggccttctttgtttttgattcttcggggccaaaagctcggttgctttgctgctactgttgttatcgtggaaacgtcctttacagagtccgagacagactttgcaagggaagctagccagctaggcatctgccaacactggagagtttttacccgcgaactagtccagtatcaggcatgcatgcaaccgtcaacctgaagaaaagtcactactacaaaacactctttgggtttcgattggaaattttatgttggtgtcggatttctcaaccgatatcctactagcgacatcgataaaaattaattatattgatttaggaattaacacctttgagaattaggaataataataataataataataataataataataataataataataataataataataataataataataataataataataatacctttgagaattaggaataataataataataataataagattggccctaatgtatcggctcaaatcgagccgatacttcaagcgaccccacatcacctctgagatcgatcaacatcaagaatcgactagcatgctaaagaatcaagatcacacaaaacttacacacatcaagaatcaactacacattacagaatcaagaatcctaaccttatcaaatttcatataaaatcacaattttttttctcaaactccatccttagattcagcacaaaagaaggcaataaagcaatagcctgtcgtcgcgctgagaaagcgagggaaccaccgccgagcctagggagaatgagggagttgccgccgtcggtggtgcagcaggcacatagttaatttttttttggggggggggggcactgtcgatgtagggggaatgagtcgccgccaagccaagggagtggaagggagttactactgtcgagctggccgtcccaagctcatggcaaccggatttggtggtcctcaacttatggccgccactgttgtctacccatcaaaacaccaccgagctctaggctaccagatccgccacttcccactcacgcgccatccttccactgtgaagaagagaaggagagagccgagaaggaggatatgttgcgggctaggagaaggatatgaggtgtgctgtgagcgaggaggaggcacattggtgatggtggacagaaggcgactatgtgggtgaggaggaagcgccgacaatgcgagaaggcaacgctgctggcgaggaggagcggtggcgacagagagaacaagggtgaggagagacagaggacttaaaaaggcgagaggataggattggtggactagaggtagtattctctccttttttttatcttaatttcgaactaaccaacgtcatacgttaaagtgtaattaa

SEQ ID NO: 43759 - DNA, 3670 bp, Oryza sativa
  unsure (1)..(3670): unsure at all n locations
tcgatttcaccgccgctagcccgtctcgatacacattgccgctgacctacgatccatgctactgtggccctcgatccgcgtcgtcgccggtttgatttgcgttgccaccagcacatgccgagctcgttgtcgccggctcgattcacacaagcgctggctcgattcacacaatcgccagcacccgattaacgcttgtcccgagctcgtctgcgatggctcgatttgcgccgcggctagctcgattcatgccctagagcttgtccacagttggccttttgcaaccttgattcacgcctctaccgagtctcggtttgcgctgtcggccaccgagatcctctcgcacccccagccacccttgctgccacccaccgtcagtgccaacttgtctcattgcactcaagttttggccctacatgcagaggtaaagaacgagaggaggaagagaaggaaaaaaaaagaaagagcgaccgacatgtggatcccatcggtcgggttattatacaagagagagaaactgttggtagttttgcaggtggtcccatttttaattataggggaggatattttatgaccctaaatcggtaaatcctggttagcaagttttgaaaaatcatctatggagtggatatattgggtatcttttggtgatgctcttgtaacaaatagacaaatagcttttctgaaaatcaaaaggacatgttcttttaatctatttttctataattaacaaaacttgctttgttacttcaacagtttcttaatctatgtcaacaatctgtttacataatttatttgatatggtctactacagcttgggcattgaatttgcgtctggaagttaaaagagataagcacacgatcgagtacatctcactggaagagagcagatcaataattgttgacttcttgatgcatctctcgagctcccctgaaactagtatcaacagaagactgaagtggatccgtttgacgttttaccatcagatccgaaatctatctattatattattaaaggaatagaaaaaggagtctccacgttcgctctcatggcctagaaattctcacgttaatcggagaaaaagaaaaatcagagtccatatagaaatacaacttagaaatagctgaaattcagaattaaaaaataagggatattagaagaggaggctagagtccatatagaaacacaatttagaaatagttgaaattcggaattaaaaataaggaatattagaagaggagactagaagaggagactagagtccatatagaaatacaatttagaaatagttaaaattcgaaatttaaaataaggaatattagaagtagagtatagagtctatatagaaatacaattagaaaataactgaaattcggaattaaaaataaggaatattagaagtagagtatagagtccatatagaaatacaattaggaaataactgaaattcggaattaaaaataaggaatattagaagtagattatagagtctatatagaaatacaattaagaaaaaaaatagaaattcggaattaaaaaataaggaatattagaagtagagtatagagtccatataggaatttaaaagtaaataaaatttggaataaacataataaaattaaaagtagagtttagagtccgtataaaaatacaatttacaaataactaaaattaaaaattaagaaaaatatgggaagaagagtttaaagtcaatatagaaatacaatttagaagtaactgaaattcgaaattaaaaattaaagaatattgaaagatgagtttagagtccatatagaaatacaattagaaataataaagattcagaaataaaaataaataatattggaagaagagcatagagtctatatagaaatacaatgtacagaaaattcggatttaaaaaaagaaatattaaaagacgagtctagagtccatataggaatatatataatttacaaataactaaaatttgatattaaaaataattaataactaacacgtatataatatataatatgaatattacacattagtagttttgtaaagttattgcaaaatttaaaattatattgtcgttttaatatatttgaataaatgtaatgagaaaacatatatgctattatacgagataaaatataatgatgctagccgcacaatctgcgcgggctaccatgctagttaattaattactcctataacctactgtaacttgttagagctccatggcacgtaaattaatttagccgcccctacctagctagaaacgtctacaaaacaatacctcaaagatttccactaaccttctaatctcgaggtaggagagactaggagagccatggcccatcatcggtggcacactgccaaagctacgtacgccttgtgtcatgtgtcccgacaaccgttggctccaccatcgttggctatgaactatccattggcgcatgcagttctcgttctagaggctaccatgcaaagaggtccttttcgccaaataattttctcatctagcacattcccgcggtttccatcatcagttaatacagcatttttttgagatggatcaagtcgttagatttaaccgctatctttaaatgacagcagcgttgcttgcttcccgtctccttgctttgccgtttgcgttgcgcctctcaaattcttttccctccattctccgtttgcttcccgaccacgtcttccgcttcctctcctcaaccaaaagcagaggattccaagttaatttctaaactcgcgcagtccatagcttagctaggtagagacaaacaatctacgcgaaaaccttcgcttctgcaatggcggactcggctccggcgccggaggccagagtaagcggtggcgacgttccggcgaggctgcagcaggctctcgcgctgctgttccctaccaacctcgccgcgaaggccgtgctgttcgccgtcgtcgtggcgctgctgccgctcctgccgacgagccaggcgcccaggatctgggagctgcctcacatcctcctcctcggcctcatcatctcttacggcgtgttcggccagaggaacgccgactccgaggtggccgccgtggccgccaccaagaccgtcgacgacgagtcggtggagtcctacgtcacccagatgatgcacggcccgctggtctttgaggagaacgatggcggcggtgaagctgacgccgccggcaagaagggcgtccaggcgtggagctctcagtacttcccagacgatcccctcgtcgtcgttgccgatgccggtgcagggagcaacaccggcaagggcgatgaaagagagaagccgctcctcctgccggtgaggaagctcaagccggcgaccgaagaatccgcgacactaacggagagcttcagtgacggcgccattgaagaagaagaagaagaagaagaagaagaaacggagttcctcctccgcaaggcgagatacggcggcgtcgttagcatcgttgtgttggagtcccagtcgtgatcagttattcccttgcagggnnnnnnnnnnnnnnnnnnnnnnnnnnnnnnnnnnnnnnnnnnnnnnnnnnnnnnnnnnnnnnnnnnnnnnnnnnnnnnnnnnnnnnacgcaatacggtagcatgtccgcaggcatctgttcgagatnnnnnnnnnnnnnnnnnnnnnnnnnnnnnnnnnnnnnnnnn

SEQ ID NO: 43760 - DNA, 774 bp, Oryza sativa
gttgttgggcgcctacgtcttcaccgaccggcttgccttcgtccccgccgatcgatgtcctcgcctgcacggctggcctttatcccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgtcgccgccgactggtgtccccgcctgcacggctggcctttatgccgccgttgttgggcgtctacgtcttcaccgaccggcttgccttcgccgccgccgactggtgtttccgcttgcacggctggcctttatgccgccgtagttgggcgtctacgtcttcaccgaccggcttgccttcgtcgccgccgactggtgtcctcgcctgcatggctggcctattatgccgccgttgttgggcgcctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgcctactggtgtttccgcctgcacggctggcctttatgccgccgttgttgggcgtctacgtcttcaccgaccggccgcctcgaccggggatcctctagagtcg

SEQ ID NO: 43761 - DNA, 719 bp, Oryza sativa
caaaaggagagggattagagagagaggaaagagcgtgggagggcgagagcgccggccgaaggcggcggccatggtgccacttgccggcacacgacggggatgggtctccggcggcgaacctcgacggggaaggggcggccgaggtagatctcgaccccgcgaagctaacggcggcgacggcgcgagacggcgacgagcctagcggcggctagcggcggccggagtagcaaaagcggcggcggcgggtggttgcacggcgtggaggcgatggggagctcgggagagatcggcgaaatggggaaaaagcgagagagggggacggcgatgcttaaaaagggggagagggagccggacgtggccgggagcggcgggattcgacggccgacgtgggggagtggggaggagagagaggcgggattcggttttcgaatcccggccatctcgggcgcgggcgcgaacgggagggagaggggaaagggcgcgggagacgcggcgcacgcgcgggcgtggccgacgtggcccgggagagacggaggcgtgggcgcggcggcggtttcggcgcggcggcgcgccgggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatg

SEQ ID NO: 43762 - DNA, 1007 bp, Oryza sativa
tactaagtgcaggccaatcattaatggtaataaatagcaacgctcgtaggttaaattgctcctatttgtccttatcccacacgaggacgccctctttcctgcacaacactttcagatcttcaaccaatggtctaaggtacacatcaatgtcgttaccaggttgtttcaggccttgaataataatcgacattatgatgtactttcgcttcatgcatagccaaagtgggagatagtagatgcacacagtgaccggccaagggctatggccgctgctcatctctccaaacggattcattccttccgtacttaaaccgaacctcacgtttcatgcattctctccgaagtcgttaaatgttctgtcgatatttagccactgcgacccgtcgacggggtgtctcagcatcccgtcttgtttacattcttctacgtgccaccgcatcattctagcatgtgatttatacccaaaaaaccgcttcagccatggtattatagggaaataccacatcaccttagcagaaactctcttcttcaaaggctgtccttcaacatcgcctcgatcatctcgtctaatcttgtatcgtagtgctttgcaaacagggcatgctttcaggttttcgtgcacctcaccgcgatagaggatacaatcgttcggacatgtgtatcttctgaacttccagtcctagagggcagatggccttcatagcttcgtacgttgtttcgggcaattcgttcccctccggaagaatgttctttacgagctccaataactcagaaaatgccttgtcactcataccatttttagccttccattgcaagaattacagcgtggtacccaaatttttgtggccctgctcacaacctgggtacaacgacgttctgtggtccgctaacatgagctctagttattgcacctccttttcactttcgcagtcctcaggtatgtcccgcaacatttgaccaagatcatctgcaccgtcattatcttcaacatctacgtctgcctcgcc

SEQ ID NO: 43763 - DNA, 4305 bp, Oryza sativa
ctttacgagctccaataactcagaaaatgccttgtcactcataccatttttagccttccattgcaagaattacagcgtggtacccaaatttttgtggccctgctcacaacctgggtacaacgacgttctgtggtccgctaacatgagctctagttattgcacctccttttcactttcgcagtcctcaggtatgtcccgcaacatttgaccaagatcatctgcaccgtcattatcttcaacatctacgtctgcctcgcccattgtgttttcttcaaatccctagtacaaagccccgtccggaatgttctcgtcttctacttcatcttcttccattgcaacccctagctctccgtgcaaggttcaacaattgtagctacgcatgaacccccactgaaacaggtgggaatgaatagttcgtgcagtggaatactccttctggttttttcacttatcgcatggacaacatataaaaccgttacgcttgttatcattggccacactcaaaaagtaatgcacgtcgttaataaactctttcgactgccagtccgcgtacatccattgccgatccatctacctgaaatcttaaaaaaaaatccacgaaagacaaactcattaaataatcatacaataatttaaaacatcatccttaaaatcattaaataatcatacaataatttaaactattttccaattaacttagttttcaattattttgtacaaataatcatataataattatacaataattccacaaagtatccattttttcattatttttaaatttccaaacataccttcattgtttttcaatagttgtttatattttttcctttgtcaatgttggcgatatggcatgagacccttcgaccaaacctgccgaaaacatgcgaccgatgaggattcaagcccgagacgtcagggttagtcgaggcgaaccctccccatgtcaaaaactatggagcaaagagcagccaagctagaggcctcctgggcgaattgcgcaaggcgaagagcatatgccgaagggggacgacttcgccgtagcaggttcggccccgggagggccgaagaatctgtcctggcccatcaagcccaagggttaattgggtcgacaataacctgtcggctcgctaagggcccatggaccgcaattacgctatgtacccatgtaaatgtccctttcataagggcaaccatgtaaattcccctgtataactaaagccctagtagtaagacctgtaatgggggctataaatagcccccgtagggccatgtaatagggggatctcaagtaaaaattctcaaattaatacactttacttcttttccatccactgtttagtaaccacgtctttcaacgtatgcggttgtcgtttcgataacagtcaacttttctataacatatttatccaaattattttaacctaattttccctcaacaagttttctctctcatcatttcccacccatataccttgttggagaaaatattgaatacaaacaaagccataaatgtaacatgctaaacacacatcattagataatgaagttgctaaccttctcgattcctccgatttgtatattatcaacaaaaaaatttattaaaaattttggcagcacctccctccctcaaagctccattttgcagcaatgacttgggctggaggaggaagaaaggatatatatagttgggtcaccaaccgggactaaagatctccgggactaaagagatgatctttagtcccggatggggttagttccccagccccccgacaggagtctgacacgccctgtcagagggaaaaccagccctaaagatcacttaatcccgttggagtaataaactgggacaaaaaaacctctttattcccggttcttgtttgaacacctgtatgaagtattaaatataagctaaaaaataactatctgcataggttgcgactaatttgcgaataatttgcgaatgtggtcctacagtaaacatttgctaatgacggattaattaggcttaataaatttatttgctaatgacggattaattgctccatgatttgacaatgtgatcctacagcaattagtttttttttataagtgcccgaacaccctatgcaacactttatataatacccgatgtggcacgacaaaactttacacacccttggatcttaacacccccttagttgggaaaattttttgggtttagttatcacatcggatatacggatacacatttaaagtattaaacgtagtataataacaaaataaattacagattccgccaggaaactgtgatacgaatttattaagcctaattaatccgttattagtaaatgtttaccgtagcaccacattgtcaaatcatggcgcaattatgcttaaaagattcgtctcgcaatttacacgtaatctgtgtaattatttttttattttatatatttaatactctgtacatatgtctaaatattcgatatgacagcgtgaaaatgttttgttttagaactaaacatgctacagacgtcgtagccgagggagtgggatacagccgagatcatgctgcactttctgccggatggaccgtacagcaggaagccacgcttccaacgtcgaagtgctatttcttcccctcccgaaacaacgtacgtgcttgatctcatccttcttggcggggtccatggcgagtgtggaacgaacgtggctgggtgcatgtttccacgggatgtggctccacaggaccacatcgtattaccaccactgccacagttggtgaagagccacctatctctcagctgagccggctcttggttcctggctcgtgcccccgcaggattatgtcgcgcaggtaggggctctgcatgagctcacggtggcgcttgtggaacacgaacaccagcttgtgctttcaattcccgcttgtccttgagctggttccaccacgtgttggcgccggggaagctgtcgatgacctgctggttcttgtccaaccactcataattatattgcgttataagatcgagaatacttgtcttcgggctaccgggcggggggagcaaaaatagggcgctccccccgccccgcctcagtgcgcggtgatgtcgttaggccccaccataatatctgcccccacctgcaacaaatcaaccacatattttggaaaccatctattaaagaaatttggtttattttttgatccacaaaaaatgtttcaccgagtgtactcacaatgtttcactatgtatagatctaatgttgcagtgaactgaaatctttcattgcaacaaaaaaacctacatattttggaaacccctattaagggaattcgttttattttttgttccaccgaaaaatatttcacctattgtacttataatgtttcactatatatagattaaatgttgcagtgaactgaaacaatctttcgctatttgctgaaacattgtttttatataaggtgaaacaacactcgatttaaacgagtgaaacattttcgatctacttagtgaaataatttcgatataccaggtggaacatcgtgtaacatttaaaaataattcaaaaataagctaaaaaaatttttcgtcggaatatatccatgtgtggtcttgttttgaagatttaattgcaatgaatttaatggtgcaattggatcataatttggataagtaatttaagagaaaaaacagttgaaaggagtttttgcacgtaaatcgggcgctgacgtcaccgaatttctcgaaatgatcgggcgcccgagccatacaggttcccttataagatgttgtaacaccctgaaaattcgaccgataaaaccaaaactctaaaaatacggattttcaaaaactttttaaatcaattgcatcatgctgatcttattcgcctatttttggatttgatctcgaagtttattaatcgtgagtaaagaatagttaattagaaataaaccttaaaaataaattggtaaaataaatataaattaaaataaagattaggtgtggatagaagtaaataaaatattgtcgcgaccatatttggatcaattaaatttaaatacgatggaataataattaaccctaattaaaaaacttcaaataaattatataaataataataataataataataaatgtgtgatattaatctagggtgagttcattagttgagataacacaattattgagtaaaatgcatatatgcaaaaattaggaattgtggaattaaatttatatgggaaatacacaaaaatcggtttaatagaaaaaaccactgttcattggccgccacacgtgttcgacgatgtcccctagcctt

SEQ ID NO: 43764 - DNA, 1891 bp, Oryza sativa
cctcccctccatccccaagcctctccacacccatccccatctttcccctccttctttttcttctccacgcgccgccgtcgttgtgccgccgcgccgctgttgccatgccatcgcgccgccgcctttgaagccgccgcgccgtcgcctcggagccgccgcgccgtgcgccgccgtcgctgtcgtcgccgccgaccgtcgctgtcggtaagccgccgccccccccccccctgcgtccatcgtcatcgccgcccgggaggaagaagccgagagagagagagaaaagaagagaggaagagagaaggaagccgggaggagaaaggaaaggagagagaaaaagaaaagaaagaaaagagagaagagagaaaaagagaaaaagaaaagaaaaagaaagggaagaaaagaaaaaggaaaaaaagaagtaaatagggaattagagggagattgggaagtttagaaaatttaaaataattagagtatgattatagattagttatagtcgtagaattgcaaaatttaattatagattattcttagtaatctctataagaaatcaattcgcggtagtaatttagatgtaattaataactaaacaaatgtatgaattctcgtaaattattatggattatttttgggtaatctctataagtaatcgattaacggtagcaattcgtatttaattactagggattttagccgtgtattatatttaatcatagactaaattaagtcgtataatatttctaggatttcgtccgatgtttagctcgcaatagaaatttctagcctattatattggtatattgatcgggttgattaaattaaaaacttatgacaacaaaatatttatacacgcaaaatagtttaaatcaaaatggggttcgccctaattcgcgaatagtaaagataatataagagaattgattttcgcattcgacttccatttggatttacttggatttttatttgaattctaatcgaattcaaattgttcttacgcacgtaactacagagaccgagggagccgcggatccgggcgaaggtcaagacccacaagacctcgagcaaggcaagtcatcactattccttgatcacgttgatcccaattgcgaaattaattttgtttacaaacaagattgcatgcaatgatcaacatcccacttgtggttatgccatgccttgttattgttttccttcaaatccttgtaaccataattacgtatgagtccctagtcaattatgacacttgcttagaaaatgctattctagaatcttgcatgttcatatttatcaaatgctatatgcttgggcaattacctttgggaaggtaattgagatgcggcatgtggaggcatgagcaccacattgccatgataatggtgacatgaaaggaattaaaaacctatgttttagaccggggcggatggtggatttgggtggtatccgggaaaggctagtaccgtccctggtcaattaaggaccgagccatgaagttaagcatgaaacgaccccggatttctcgaatggggatagacctagcggagttaatagccgagcggaagcagtatccatgcatagtggtttctcatgtgtaaggcaggggctctacaatggtgtcgccattgttaggactgtcgtgtgttgagttgaacttagttataacttaattgcatgggtgtaaaacttcccttcctgggtgcgccagaactcctctcactgctagaaaccgtgtacgcctagagtgcatgaggatgaaaagttcatggagcgggtactgccaatgcgaggttatcgaaaggctttgccgtgacgcgtctcatgtgttgagacaaggctcatgtgttgggcagtcgcagaatgtgggtaaagtgtacatccactgcagtgtgagtgt

SEQ ID NO: 43765 - DNA, 9199 bp, Oryza sativa
actgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttcccccccaacctcagagctcgagtatgtgtccgatggcgggttctccgaggagtaggcttcgtccgtgccgtcgaggatgcctgtggagtggtgttcccgctgcagttcaagtcaaggcttagctccagttatcttttgttttccgctgcatttctgtaagacctttataatgtttgtaagacgtggatctgtatgtcaacattgtcgtttgtgtaccccggctggtcctggacgggggttttaatacacattctgcttggaattctattcgggaatttctgggcgtgacaaaaatctatcctcgaaattgtgcaaagaataattaaaattcaatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaatgaacaaagttaaaaaggtttataaaaagaaaatcctaaaagaagttctttttcccccccttccctcttgggccggctcggcccacttctccctctctctctctctctcctcccccgcggcccatcggcctccccgcgcgcgcgcgccgctgacaggcgggcccgcccgccactctcgctgacgggtggggcccacctgtcatcgccttcctcccgccgcgcccgccgccgcgcccgtgccctagcgccgccgccgccgcggattgcgccgcatcccgccgtccccgcgcgcattaaagagaggggaatcactccccgtgattccctctcccgtttcccccgttttcccctctctctctccctcggattcgtccgatttccttcccgcattcatcgccggcgcatctatggcggccgaaatctccgcggtcggtttccttcctccccggccgccttctctccctcccgacgctataaaaccgttgcccgagctccgctcttccgtttccgccgctcgccgctcgctctcgccgtcggattcgtgctcgcgccgtgctccgctctctccgccatcgccgccgagctccgttccgccgccgccgccgctccggacttcctccttactcggcgacacctccgtccgcttcgccgtgttgccgccgaccccgtccgccgctccgctccgtccgccgaccgtcggagcgccgtcgccatcgtcatcccgagccgcgccgccgctttcctccactccggccgccgttctcgtcgtcgtcgttgtcccggggtgagccgaagaccgccgttcgctttcccccttctctccgctctctcgggcgccgctccgccgcgccggtggtcgccggcggtgaccatcggggcgcgggcgcgccgctcccgtcggccgcgccggcgaggccgccctcgggcgcgccctcgcggctgccaagtgggcccggccgtcagccgcccgcgcccgcgggtgcggctgacgcgcgggacccacggtgccgaccgccgacagccgtgtgcgcccggtccaccgtggaccgagcggctgacgcgtggccccacttgcccgtggacccggtccgcgcgcccccttccttcggcgacgcaataaatgggttttttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattatggcattatcgctttatttaaattcccgcgttatcactgttttatttagccatgcctatttacctttgttatgaccatattattattgttattgttattattactaccttgttcaccctagacaaacaaaacctcaactagtggacactctactcatggtatccctagtataattttaggtagatgcttcgcaatttaattaggtaaccttaggtggttttacaactttagacttgggaattatttcatatcacctggatactctggaattgttggattattgtggaattggcttcacaccgccccctctattcaaaatcccctaaaatggttttaggctgggctcggggtgcatggttttgatagtagcacctcggccgtttaaggaccggtcttcgggcctctgttgcaaagcactaccgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcatacggcagagggttggtgccctgctgctaggggctcagtcttgcctgcctgtcccgggggttccggccgtaggcaggattgggtcggtactcttgtctaaggctaggatgggttggaaactatgtcatgtctttcgtctgtataccgtggtggtatgtggcacgtggttgcacgtgagaaagatgtgtcttgtgggtaaagttgtacacctctgatcagagtataatctattcgaatagccgagccctcggttatgggcaagccgagcaatgtacccaagttagtgttttaattcttaaaacttgcttaacaactaaaatgtggaatggttggcctgggttggcttaggacgagctgggacccagggtcgggttgccagttcggtctgaatcatcgtaggccttgggttaaggcaggttcgtgtgggttcacggccttgattaacaactttgcatagttctaagatcgtgtttacaaaatagccctgagcaactaaatgtctttaaatgctgtttactgcaaccctaaccctttatgttataattcccttgtactcccttgcatttattctgcatttgtgggtgtgtcttgttgagtacggtggttgtactcagtcttgctcaatttttcccaagcccagatgaggagttcctggaagatgaaggcttcggtgtctagctcgtgcctgccgtcaagcgcctgtggtcgtcgccctagtcttccgctgttcctcgtttgtcttcgtgtgttgggccttcgctgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacagtgagtaaaccaaatctattcgaatagccgtgctcgcggttattgagcaccgggacatgtattacacttggctagactctgaattcttaacttgtgtgggatgggttatcgcatgatgaatttttatgctgttggagtcacttcctgagatgggggaaagtggacgtcctcagaaaaccataacgactcaatggcgggaagctatccttgggatcacaatggatggtggacataaccgtcattgtttaaatacaaacactggtactaaaatttgatcagttgatgctaggtcttaggcttgtgaaaagaattacaaaattggctttgcgcaaaagaaccatagccatcctttgaaatacccctttcatatgtattgttgctgtggtggcttgcggagtacggttggtactcacccttgcaaatataaaattaatcacaaacgggagatgaagctatggaggatccctatgcctactaccaggagagagatgaagacgacggtgcccaataggtcttagtacggtcgttgcctgtggcaatggcataccgctgcttaaattcccctgccttatctaaactctgcttttggttgtattccggaccgctcggtccaataatttaagacaatgcctgcgggctcatgttgtaataattcgtactagactctcgtgtatgagcatttggtattaaactctcgtgtatgagcatttggtattccggctatgaactcgtgtgtaccagactacttgatccagggaaatggtactgtttacacgattgattcctgttataaaaacgggggtctacagatgtgcaccaataaaacacaattttcaattatggtaacaacatgttgtgtgtcttctacctaactcattgatatggttgtaaaagatatgtcccataatcgaattattaagctgagcatctactcatggatccatactcgaaaggctcataaattgagtttaattaagataatgttctggacaatacatgtgtaattaaagtattaaataagatcatggataaagggttgttaaatttatcaatcaacaaccaccagtttccttcccaatcaagaaagaaaaaaaaagagataagatcttgtttttgtgtgatcggtgcaaaacataattcaaaactaatcaagccccaccagtgtcgttgtataagaaagatgagaagaggcaactgatcgagtttgaactctctctctaaccctaagccctaaatcaatcgccggatcgatttgacactgaaaggggttcatgaggtttctctttgtttccttttcatcaatagaaaatcagtacagagaagaagaagaagaagaaggagaaaaagcaaaaggacgaacaacaaaccaaataccggcttcaatggcttcacaaataaggtcagttagatcaattttcgcattaaacaaaggtgatcatgtttaggctaagatcttaagtaattaagtaagattaaactccaactacattttgttaattaggtgttacaataaaataacaatattacaaaagcgtccgtcaatgcagtttttttacaaaataaggttgagaacacaaattctagaacgtgaagtataaggtacataagtagttttacactgagtagttatgtatgactcgccagtttatttatcacacaccacacttgtgcgtctcctaacacacgcaaattaaaaaggatggagacctgcagtacatattactggtaagtggtaattaaagtgggtttatttaggctatgactctgcagagtttaaccgactaaacaaacacgaaaatgcattgtaacagaaaaacacagaaagatgcagctagctagcttgctaggcaattccccaccacacaagagccagcatcgatcccactcaacatatattccccggtgtagctctcttctgccttagattataccttgatggcctgtcggtaggactcggcctcgggagaggcgcgttccagattccagtttggccttcttcagcttttgtattaatcctgtcaagcatttgttcgtgttcctcttcctcttgccctgaggcatgaggttatgggcaacatccgccggcgtcatatcagtctcgtcgagcagtcgttggattttggtgaacaatgggtgctcggtgatgtctaggtagttgttggcgagcaccttgaaggcctcaaaccggcagtaggacatctcgatgtgcttgtccatcctcccccggcggatcagtcccggatcgagcttatcaacgtggttggttgtgagcacgatgatccgctcaccgccacatgctgaccacagcccatcaataaagttgagcagccccgacagcgttattttctttctttcatagtaccactggaagtctgtgctcatgcgtttatcctccaattccatcgcatgaatgtcctcaatgacgatgatggattgctctgttgtctggaggaagaggttccgcaggtcggtgttgttcgtgacggtcgttaggtcgaggtcatagacgtcatatttgagaaagttggccattgctgagatcgtgctggacttgcctgttccggacggaccgtatagcaggtatcctcgcttccacgccttgccgaccttggagtggtactcctttcccttctggaacatcttgagatcttctatgagctcatccttcttgccggggtccatggcgagcgtgtcgaacgtcgccgggtgcttccacgggacgtgggtccacgtgctcatatggttctcgtggtgggtgtacagtcgcctctgcctgttcttggcggtgagcgcgcgcccttgctggaggatttcagggagatatgagtcttgcacgagctgacggtggcgcttgtgaaataccagcatgtagttgcgccgttggatcttacgtccatacaaggaatagtcatcggaagccttggacagtttccaccacatgcgggtgccgcggaagctgtcgacgacctcctgcttctcgtccaaactgaactgggtgtcgccgttgtcgccgagcttggcattgagcttgtgggccccttccatgcatttgctgcccaggtacagctcgttccgacccaacttcgtctcgttgtcgtcgatataatcggagatggtgttctgctcgtagggattgaagtaggcaacactggtggagaaaccatctttcgtcggtcggccgatttccacaataatcccggatgcaataaaaactggggctaaagatgatctttagtcccggttcaaaagggtaacgggcatatttgatctttagtcccggtttgtgttaccaaccgggactaaagatcatctttagtcccggttcgaatgctgtcaggtcatgtcaggccccaccgggatctttagtcccggttggtataccaaccgtaactttagtcccggttggtataccaaccggggctaaagatcccggtgatctttagccccggttggtgctaccaaccgggactaaagtcccacccctatatatatgtcttcttcctcctccagctgcccgagcaagcttcaaaatttcttcaaaaaagaggggaggttatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattataagaataattatttgtgtacggtttttttgactcatgtagatggatcggcaatggatgtacgctgaccggcggtccaaagagtttattgacggcgtgcattattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaagcaaatcaaacgggcaaggaggaaatagctgctgatggtaacgatgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggacaggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcatgaaacatacggtttggtttgagtacgtgtcgcgaccgggaaaattgccttttcccgaacgctagtgtattaatccccgtcccaggaaaagccggggtacaccacacaaacatgatataaaagacacatttttattatatcgataatatttacattattacaaaggcgcttcaggcctggcaatcaaaaataaacagcagcggactagcgggcctacggtttggtttgtcgatgtttcgacagaaaatttaaagaatttggaaaggacgcacgaaacatacggtttggtttgagtacgtgtcgcgaccgggaaaattgccttttcccgaacgctagtgtattaatccccgtcccaggaaaagccggggtacaccacacaaacatgatataaaagacacatttttattatatcgataatatttacattattacaaaggcgcttcaggcctggcaatcaaaaataaacagcagcggactagcgggcctacggctccatcttcacaggcgctcaactggggtataagccaggactccacctaagacatcttctccaacgcttctcttactgaagaggggaaagattgagcaagaatgagtacaacca

SEQ ID NO: 43766 - DNA, 5686 bp, Oryza sativa
  unsure (1)..(5686): unsure at all n locations
ccgcttgccagaacgccgctctcctcgccatcggcactcttcaccagcgctacccggacgagttgcagcactcgccctaccgctaccaccctcgtcgcggaggagcccgcgactacgccaccttccgagacgccagctcggaggatgacgctaccgtcgtgcatctggcacgcatggtggaggcgtacgacgcggctcgtatcgacttccatcagatggtgcgccgtggcatggtggagaacaacctgaagatcctggagctgcgtcaggagaacctgcagctcaagaaggacctcgacgcgttggaggcgcagctgcaccagctcaagatcgcccagggagagatcagccgtcccaagcgtcgccgcgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagttgtgtggggcatggttacaccggtgtgtggtgtatctatgtcggagcctgtcttattttatttgcctaagcaacttgaacattaatgaaccaatttaatagcagtgataaatttaagaataatggtagtcgtgggtggttagttttaatcgtcagctccttctctgtttgctggttccgtgtggggttttcagatggtgacgaccaggagaaatgttaacaccggtgaaggcaaccaacccgaaggcagcaaccccaaccaccaaggcaattcaccttcgtcaccaccgtcagacaccaacgccattctcacccaaatcctcgcccagcaacccaacatgatgaccgctttcctccaccacctccaaaacccgccacaacagaatgctccaccaccacccccacaacactctaaactcgccgagttcctccgcatccgcccacctaccttctccagctccaacaaccccgtggatgctttggattggttgcatgccgtggggaagaagttagacacggtgcagtgcagcgatgaggagaaagtcgtcttcgccgcccatcagctgcagggacccgcatctctatggtgggaccatttccaggctacgcagccagaggggcaaccgattacttgggctcgcttcaccgccgctttccggagaacccatgtgcccgccggagtcgtggctctcaagaagagggaattccgggagttgaagcaaggcaaccgctccgtgatggagtatttgcatgagttcaacaatctagcccgttatgccccggaggatgtgcgggaagacgaggagaagcaggagaagttcttggcaggaatggaccctgagctgtccgttcgtctagtctctggggactatcctgattttcaacgactggtggacaagagcatccgcttggaagccaagcacaaggagctggaatcgcacaagcgccgcttggcgaatttccgcaatcaacagggtgctaaccagagggtccgctacaccaatccctacccagggggatcctcctcgcagcagcagcagcagcagcaacctcgcccagcgccccgacctcaattcgtggtgcgcgtcccacagccacagcagcagcagaatcagcaagggactcgtgcaccccgtcctcctacgccagctgtgcagcccgttcaaggccgcagggacgctcaaggtcagcagcgtctgtgcttcaactgcttcgagcccgggcactttgcggataaatgcccgaagccaaggcgtcagcaaggccaagcacctccccgctccaacaacggcgggaaggatgtcattcggggtcgtgtgaatcacgtgacggccgaggacgtgctgacaactccagacgtcatcgttggtacgttcctcgttcattccatccctgctacaattttgttcgactctggagcttcccactcgtttatatctgtgccattcgtggggagaaatcagttgggggtagaaaggcttagaaaccctctgctcatcaccacccctggaggggttatgacagcaaagtattatagccctgccgttcctatagaaattcaggggattccttttccctcggatctgattcttctagacacaaagaacttggatgtgatccttgggatgaattggttggcccaattccaaggggtagtggattgcgcgaggcgcactgtcactctgtaccgaggaccggaacaaccggttgttttctttgcaccctcaacctctgtcagaagttcggaacttcatcagatagaactgtcagaaatccccatagtcagagagttcggagacgtgtttccggaagaactacctggtatgccgcccaagcgagagattgagttccgaatagatcttgctccaggaaccactcctctgtacaagcgaccctaccgtatggcagcaaatgagctggccgaagttaagaaacagttggaagagttgaaagaaaaggggtacatacgtccgagtacttccccatagggtgctcctgtgatttttgtagagaagaaagacaagacgaagaggatgtgcgtcgactacagagctctcaatgaagtcaccataaaaaacaagtaccctcttccccgaatagatgatctgttcgatcagcttaaaggtgccactgtattctccaagattgatcttcgttccggatatcaccagttacgtattcgtgaagaagatattccgaagcccgcattcaccacgcgatacgggttatatgaattcacggtgatgtcgttcggcttaaccaatgctcctgccttcttcatgaacttgatgaacaaagtgttcatggaatacttggataagttcgttgtggttttcatcgatgacattctgatatactcacaatcagaggaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgaccgccgtcaccgattggaagcaacccaagacagtcactcagattcgcagtttcttgggtttggcaggatattaccggagattcatcgagaacttctccaaaatcgctcgacccatgacacagttgttgaagaaagaagagaaatttgtgtggagcccgcagtgcgagaaggcgttccaaactctcaaggaaaagctggtttcctcgccagtgttaatcttgccggatactcgcaaggatttcatggtgtattgtgatgcttcgcgccaaggattggggtgcgtactcatgcaggacggtcatgtggtagcctatgcttcacgtcagctacgtcctcatgaaggcaactaccctacacatgacttggagttagcagcggtggttcatgctctaaaaatctggcggcactatctcattgggaaccgctgtgaaatatatactgatcataagagtttgaaatacatcttcactcagtcagatctgaaccttcggcaaaggagatggttagaactcatcaaggattatgatgtgggaattcactatcatcctggtaaggctaacgtggttgccgacgctctaagtcggaagagccattgcaatactcttaacgtccgtagcattccgcccgagcttaatcaacagatggaagccctgaacctaagcatagttggtcgcggattcttggctgcgttggaagccaagcctaccttgctcgatcaaatccgcgaggctcagaagaatgatccggacatgcatggactcctcaagaatatgaaacagggtaaagccgctggtttcacagaggatgaacacggaaccctatggaacggaaagcgggtatgcgttccagatacccgagaacttaaacagctgatacttcaggaagctcacgaaagtccttattccattcacccgggcagtaccaagatgtacttagacttgaaggagaaatactggtgggttagcatgaagcgggaaattgcagaatttgtggctctatgtgatgtgtgccagcgtgtcaaggcagaacaccaacgaccggccggacttctccaacctctccaagtgccggaatggaaatgggatgaaattgggatggatttcatcaccggtcttccaaaaacccaaggtggatatgactctatatgggtaatagtggatcgattaaccaaggtagctcgattcattcctgtgaagaccacctatggagggaataaactagcggaactctacttcgctaggatcgtgagtctccatggtattcccaagaaaatcgtatctgataggggaagccaattcacctctcgcttttggaagaagctccaagaagagctgggtacccgattgaatttcagcaccgcctatcacccgcagacagatggacagaccgagcgtctaaatcagatcctagaagatatgctccgcgcatgtgtcctagatttcgggaagacttgggataagagtctcccctatgccgagttctcctacaataacagctatcaagccagcatacaaatggcaccatatgaagcgttgtacgggcgcaaatgccggacaccgctattgtgggaccaagttggagaaagtcaagtgttcgggactgatatcctgagagaagctgaagctaaagtcagaatcattcgggataatctaaaggtggcacagtcccggcagaaaagttatgcggataaccgtcgccgtgacctggaattcgcagtggatgactttgtgtatcttcgggtcacgccattgcgaggtgtacacaggtttcagacgaaagggaagctcgcacctcggaatgtgggtccctttcgtatcactgctcgacgcggagaagtcgcctaccagctggagttgcccgcctccttgggtaacgtgcatgatgtgttccatgtgtcgcaactcaagaaaagtctccgagtgccatccgagcaggccaactcagagcaaattgaagttcgcgaagacctgacctatgtggagaggccagtgaaaatcctggacaccatggagcgcaggaccaggaaccgagtaatccgtttttgcaaggtccagtggagcaaccacgccgaagaagaagctacttgggagcgcgaagacgaactgaaggcagcccatcccgatctcttcgccagttcttccgaatctcggggtcgagattccgtttaaggggggtaggtttgtcgcgtcccaaaacgactctaaaattgtcacaccccgaagttttcctcccaagccaaattgtaaattacaaatgaccccaagaaaatgcagaggaaatcaggataaaaccctaagaaaacaatgcaaacaataatcgggtttgacatgtggaatttttcttgaattctacatgtcgaaattcattaacaggatttttagtggaattttcagagctctagaaataattttaaccaattaaaaatcactaaagtgcaatttttaattccagggaaaatccttttcctttttctttttcttttccctccctttttcctcctttctnnnnnnnnnnnnnnnnnnnnnnnnnnnnnnnn

SEQ ID NO: 43767 - DNA, 6430 bp, Oryza sativa
gtaaatcaagaaaaatgtgtagaatccattaaaaatggttttgttctctgtttcagtagtcttatagcctgtttgcaatgtttgctttgtatgtcgctagattccgatccctccgacgctccggtgtacttcgagatagtcgccgaggtccctccagcagcagagcaaggcaagtcatgcctgtcacttgaacatgttgatcctatattgcaaatgctctactgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgcttaattattacaactgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttcccccccaacctcagagctcgagtatgtgtccgatggcgggttctccgaggagtaggcttcgtccgtgccgtcgaggatgcctgtggagtggtgttcccgctgcagttcaagtcaaggcttagctccagttatcttttgttttccgctgcatttctgtaagacctttataatgtttgtaagacgtggatctgtatgtcaacattgtcgtttgtgtaccccggctggtcctggacgggggttttaatacacattctgcttggaattctattcgggaatttctgggcgtgacaagttggtatcagagccgaccttgaccgtaggacaagccaaatggaaagacctaagagccctctgaatccttttcattgcatatgttctttgcaattggattttgttccgggaaaatggggatctgttcttatggttcaagggaaaaatcttggtcgctcgtttaaagtgagtttttcaaaacgagtcagtctagggttttagtaaaattattgggatttattcgtcagtcagttgggatttgatgggtgaaatgcactcggtcctagctcggtatcatgggttgcaaggtatttatgctttgttcgttattattaatatgtatctaatttctcattattttatcgttatgtgagtctgtcttatttattcgcgctcatgtaaaatgatctatgcataaaattttgctcttatttgattcctttatttgagtctttattgctttatttaaatttggatttgagcatgcattgatcctactcctttgtcttctctagatggccggtcacccacccaaccaccgcggagaaggcatgattgatttcgtggcagagttggcacgcatgaccctggtggtgggctaccccgacgcgccggagtacacgacgattccgccgctcagtggcgagcttcctcaccgtgtccgcttggaggtccatggttacgtggggacttgcctcgctaacatggcggtcgaggcatctggaggcacagcagatcacgcctgtcaggaggcagcctacttgatgatggccagactacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgagatagcgcgcctgaagaaggagaatgctcagttgaagggtcttccagcaccaggaggagtccggatccgcactacgccccgtaagaggacgactgcacccgtgcgcatccagcttgcgcccaggaacccaccttcaccagcagctcccgcagcacctccagttccgcccgcagctccggcagttcccgcagttcctccagctccagctccagctcccgcgttcactctctccttcgctccagcatcagccgccagaggtccagccagtggtaccggaggttggttgtccgctactcccagtggcagcggcgagactgatctgtcaggctccaggagtcgttcagagggaccaggtgacgagcaggaggacgctttcgactccaccgaccgcaggagccgttccgagcattaggctcgttttcccattagtttatcgattgtctagtttctgcttgttagtttgtgtgtttaggttgcttgtttggggtcagtcgacggtcgatatcatgtgcctatgatatggctgtcttaataaggatttttgtttgctctttttaagtgttttaattcagatcagaacaattgcagttttaattcctatataataaagcttagttcttgagcatctgtttttctccttttccccccgtctgcttttccctccagatggtctacaccaggactggcaaccgcacgacaggcgagggcagcaacggcgaagaacgcgtggatggtgtgcaccccaacagtgattctggcaatggtccgccaccacttcccgagaatccgacgcttgcccaagttatggcacaccagactcagatgatggcagccatgatgcagcagatgcaacagcagcaccagcagatgcaccagaggatgatgcagcacgccgaacagcagcaccagcagtttggtccccctccccctcagtccaagttgccggagtttctacgtgtcaggccacccaccttctccagcaccaccaaccccatggaggcaaatgactggatccatgcgatagagaagaagctgaatctcctgcagtgcaatgaacaggagaaggtcgctttcgccacacaccagcttcagggtcctgcgtcagcttggtgggacaaccacatggccacccgcccaccgggtactgaagttacatgggcagagttctgccgtagcttcaggaaggcacaggtgccagacggggtcgtggcacaaaagaagagggaattccgggcgctccatcagggcaacaggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgtcaggaggatcagcgcaacaaaatggacaggaaaagaaaggcggcgcagttccggtccaaccaaggtagtcagcaccgaccgcgcctcactcccggacagcagggtggacctaccaccatgattgttcgtcaacaccgcccattcaaccccagcaacttccaccagggcactagtggcagtcagaaccaccatggaagtcagcccaaccgcggtacagctccacgcccaccgatggcaccggcacagtcaggccagcccgcacaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcatctgcggaggaggcacaagcagcaccagaggtcgtactgggtacgtttcctgttaactcaatccctgcaacagtactttttgattctggtgcaacgcattctttcatctccaagaaatttgtcgggatgcatgggttaataagagaggaacttagcacaccgatgcgggttcataccccagggaatagctccacttcggttcaattcagcccttctataacaatagaaattcaaaggtcaccgtttctagccaacctcattcttctcgaatccaaagacctagatgtcattcttgggatggattggctgaccaagtttaagggggtcattgattgtgcgaatcgcacagtcaccctgaccaatgagaaaggagaaaccgtggtgtacaaatctctagtctcgccaaagaaaggagcctcgttgaatcagattgagacggaaatcccaatggacgccgaagagaagaacttgagaaaattggaggacatacccatagtctgcgagtatccagaggtgttccccgaagacctcaccaccatgccacccaagagggagattgaattccggattgatttggcaccaggaaccgctccaatctataagagaccgtacagaatggcggccaacgaattagcggaggtcaagaagcaagttgatgaacagctgcagaaagggtacatacgaccaagcacttcaccttggggcgctccggtcatttttgtggagaaaaaggataagacaaagaggatgtgcgtcgattatcgcgcacttaacgaggtcacaatcaagaataaatatcctttgccgcgaatcgacgatttatttgatcaactgaaaggagctaaagtgttctctaagatagacctgcgatcaggctaccaccagttgagaatccgggaagaggatattccgaagacggccttcaccactcggtacgggctatatgagtgcacggttatgtccttcggacttactaacgcacccgcattctttatgaatctgatgaacaaagtgttcatggaatttctggacaagtttgttgtggtattcatcgacgacattcttatctattcaaagtccgaggaagaacatgaacaacatctccgtctagtactcgagaagttgaaggagcaccagctatacgccaagttcagcaagtgtgacttctggttgacggaagttaaatttctgggccatgtcattacagctcagggtgtagcagttgatccatcgaacgtggagtcagttaccaagtggaccccaccgaagacagtgtcgcagattcgaagttttctaggactggctggttattaccgtcgtttcatcgaaaacttctcaagaatcgcccgacccatgactcagttgcttaagaaagacgagaagtttaaatggacagctgagtgcgacaagagctttgaggagctcaaaaggaaattagtatccgcaccggttttgatcctgcccgaccagacgaaagacttccaagtctattgcgatgcatcccgtcacggacttggatgtgtcctaatgcaagagggcagagtggttgcatatgcctcgcggcagttgcgtccacacgaaggaaattatccaactcatgacttggaattggcagcagtggtccatgctttgaagatctggaggcactatctgatcggcaaccgctgcgaagtatatacggaccataaaagtctgaaatacatcttcacccaaccagacctaaaccttcgacaacgaagatggttggaactaatcaaagactatgacatgagtattcactaccacccgggtaaagccaatgtggtggcagacgcattaagccggaaaagttactgcactgctctatgcatcgagggcatgtgtgaggaattgcgacaggagcttgaacatctcaacatgggaattgttgaacacgggttcgtagccgctctggaggcacggcctacgctcgtggatcaagttagagccgctcaagtaaatgatccggaaatagcagaactgaaaaagaacatgagagtcggaaaggctcgggatttccttgaggatgagcatggcacaatctggatgggagaaagattgtgtgtaccggacgacaaggaattgaagga

SEQ ID NO: 43768 - DNA, 1876 bp, Oryza sativa
actactatgcataaagctagtatatgtaaagtttatacagataaagttacatgtatgaaatagaattgtttatgttggattttagtctaaatgagaaaggaaaaggctgggatatgctagtgggcccatgaaaattttgcatatacgtggactatgttgtgggctggagtagagttttgtgagcaggttcagatacgcacggaagaaataggtagcgtccacgcgtttgctcgacacgagcagtcgcgtactagactcaccccaatctgggccaggagcctcataactcggatatatatgatggggctgttcactctaacgaaaaaaaaccttactaaattttagcaggattttttatatagttaccaaaatttgacaacaaactaaatgtagctaatttttttttttataactttaccaaaacttggtaaagttgaaaatgacatcaaagtaaacgggcccgatgtctctagctggcctacatgactcggcgggctattaggattaggctaacaacgtgctatgcggcgacctatcacgccaaagtcccaagcacgagcgtggcctatgtacggcctgaaatcgggctgtgcctgaccaccgccttggaccaggctaggaaagcatggcccaattcctagcatccggcaaacagccaaacaggaaactttgggcttcttcctcctagtcagcaaccattattctagatgctttgacatggtcacatggggaaattttttatatttatctgtatctctgtctttatgctaatggccactaactgaaatcaaaacctaaagctcaaacctcacgcttctatatcatcattagttgtaagacgatggatcagtgcattatatcacttctgagctgataaggaataagttcacttgtggtcccttaacttgtcaacgaatccgattttcgtccttcaaccggaaaaccagatacaatgggtccctcaactatcaaaccggtgcaaagcaggtccctcagcggttttgatggtggttttggctaatgtggcgcctacgtggccggtttgacttggtcctcgtcctacgtggcgctgaccgggcactggaaggaaaatataaaactaaaaaataaaaacaaaatgtggggcccacatgtcagtcagacaaaaagaaaaaagtgaacccaccgttagtgggtcccaccatcctctctatccacggacgattggactacgggagactgggagagggagcgaccaacgcctcttctctctccctccagcatccttcctcgccggccggcgagcgcgcacggagagggaaaaaggccccgcccggcgagtggggcgaagacgacagctggcccccgcttgctgcgcgcctcttcggcgggctgcgcccgcccgtcgccgtcgagccccagtgccccacccacggcgccccgccattgccggccaccctgcgtgtcccccgttcgacccatgcagcgaggcgcgccgcatatgaccttgaagatctctctctcatgcacagcacagtgcacacacgatctcaccacactagtactagctactttgagagtgtagtaggataagccagcaagggatctggtatggcaacgtgtttccggtgaccagaagcctctcggccaagcccatcgcgccgcgggacgcggcgacttgcagtcggcgcgcgtagaacctcgtgttgggaaagacggtcaagggcggcccggcctccgccatggagtccgcggcgagtcgtaacgaggagatgggcgtcatcgcacatgaccagtccttggacgccaccgccgagcatggcgtcaaagtctccaataccctcgtcatcggcggcagccgaatcgtcaatgagttcgtcgccggccaggtaatcac

SEQ ID NO: 43769 - DNA, 1075 bp, Oryza sativa
gactccggcaaccctagctccgtgtcgcagcccgccaaagaagtgcgcagtgggcgggggccagctgccgtctccgccccactcgccggccggcgcctttttccctctccgtgcgcgctcgccggccggcgaggatggatgccgggagggagagacaagaggcgtcggtcgctccctctcccagtctcccgtcgtccaatcgtttgtggatagagaggatggtaggacccactgacaggtgggtccactcttttttccttttgtctaactgatatgtggacctcatatttttgtttttgtttttaatttttatattttccttccagtgccacgtcaccgccacgtaggacgcaaacaggacacgtaaatgccacatcggccaaaaccactatcaaaaccgctgagggacctgctttgcaccggttttgatagttgagggacccgttgtatctggtttttcggttgaaggacgaaaatcggatttgttgataagttaagggatctcaagtgtacttattccgagctgataatgaaacacaacatagtctgattaaacagagcccaaaccatctcacacacagccaccagtcaccgcgtgatggtgaggcccatctaattcatttgtggtccagctcgacattgagggattttttagggtttcctttggattagtggggtgtcctagtctgagggacggcggcggctgctatctttgccctcaccatcgacggcaggtggggccctaacgcacggcgcacgtgatgcggcaccggggaaccttggcacaacggtcggttcgagagatggattggcgcgcgaattgacgtgccctggcgcgacgctcgtttcgggagatggctccgtcttttccggcgtgcgttgagagccccggcaccaccgatggtgcgcgtcaaccgcgtgcctggacgagacacatatgcatcgaggacaccactataaaataaaggagttaatttagattttgtgaagaaaatattgatggtttgctaatgttaatttagagattttataagacgattgattttatgaagtgtgcagtttcggttgaccttgg

SEQ ID NO: 43770 - DNA, 730 bp, Oryza sativa
acgaggggcgcggctattcgaatagattatactctgatcagaggtggtacatctttacccacaagacacatcttcctcacgtgtaaccacgtgccacataccaccacggtatacggacggaagacgtgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccgaatgatatgagacttcccaaagtctaaagttataaaaccacctaatgttgcctaattaaccagcgaagcatctacctaagttcatactagtggaaccatcaatagagtacccactagttggggttttgtttattatagggtgaacaaggaaat

SEQ ID NO: 43771 - DNA, 4417 bp, Oryza sativa
cacaaccatgcactatacatgctggaaactttacatttaatggtgtcactaagaaaaatttcagatttacaagcttttcaaattgaaatggcagatcataccaagttggcgtatcactcaatcttagctacacgctccgagaccacaagaactatttgcggaccaagtggcagcaggagatggcatatggccaagcaagtagcatgcttaagtattttcaagacaaaattgccgattgcccatcattccaatatgcattgcaaatggatggtgaagaactaatagctaacatattatgggttgatgctaaaatgatcgcagattacgcacgttttggtgatgttgttagttttgatactacttttggaacaagcaatgagagtaggccgtttggtgtctttgtgggattcaatcactttagagaaactgtaatttttaattttttggtgctgctctcatgtatgatgagacatttcagtccttcaaacggttgtttgagacttttctaaaaggtcataatggacattcccattatgtagaatgctatcaaacatttaggtggagagaagaatgaggagaacaatgaagacacaagtattttgtcagattttaatgcatgcatgtatgagtacgaagacatggtagaatttgaacaaaaatttgacatcatgattcagcggcgtgctgctgcatggtgcggcgcgtcagcctgcctggctcggcatgccactcagcctggctcgacatttcgtcgagcaggtggtgtgcatgtgcagccggctggggaaaagaaggaggggaaacagacttgggtcacaagggggagagggtgtagaaatagacttctgatatgctgggctgagagggaaaagaaaagcccagttgtaataggaatattctgtagaactgcaaatggaatttgtgaaggggatttgtaatttggaaactgtagatggactgtaggtacttcatgtaataggattgcataactgtaaaaggactgtatattcggacatttgactttgggctgaaatttgtaaatgggagttggaactataaatgggctgtttaatttgggtaattggattggattcaatttggccgctcagtcgcccaagtatttaacttaggatgtccttgcggctgcttgaatgtaaagacgatgatatcgatggattttagaaacgacgtttggcataagaatctatgcgatgcggtaatgtttcaacggtagggatgatatagacgataggtctaggtgcggcgtatggcatacaaatccatttgtcgcggtggggttcaaaggtagaattagagtcgagaatatacgagtcgacgcacgacagttaaattcgtcgagcgattttagagtttcaagcgaatggccgaactctgggattttaagtagaaggaatatgggagaatggaatccggggagagccgagtcgaatagacgggacaactcaggctcaactctagtgttcaatcggtctgaggaaggaagcgatgttatgacaaaggaaagggtttcggggctttgattagcttcaccgaaacgcttagcaaattagtcggagaggaaagagggcaaggaaggatgtcgactggagaacatcctttaggtggatcgatttaatcgcggtattccaacaattcaaggaaacgacggggtattacaataacttgggagggttgaaaggacagtgaatggatattactctgagaggtggttctgggggaaatactgagttcgagcaattccagacaccagaacaaattggttcgggaggggttcgattgagaagaaggattgaactacggaatatgattccggaggaaatacgacaaggattggattcacaaggatggattaaccgagatccttggcacaaacatacaaatgcaaacaaataatacaaatcccattatgcgggtaagctaggcctttcaaggaggaaaactatacttttccgtgaattcttttgaaataactcatttaagattttagttcgtaaatagagttttgctagtaaattccttctagtctttatttgtaaaaataattcccaaacacttataatttcaaaatagggtttttagaagttaactaatattagccctcatttgtaaaaatagtttcctcggggaaatatctctcaaagtatgttttctaaatatttagtatttatttttttattcataatacaaatacctcaagtaggttctatttcaaagaaatggttcacagaaagacaaatggcatttacaaatattttcttaattaatatatttcataatcatggttcttttaacaaaatagtatttgaatcaaaaatatattttgtttctagatttccgtcctcgtggtccaagcgcaaccgaaaaaggggagatagaatccaataaaagccaacatgatggattttggaaaagatttttgattaacacgaaattttaatttcgcaaatcaggacagaaattttcatggtgttacactttaggtgtataaactttagatgtgtagaaatattatatataaaaaatatttgaattcaaattcaaatttgatttgggtatgtaaacttttgacttataaactttgggtctataaactttaggtgtataaactttagatgtatagaaatactatatataaaaaatatttgaattcaaattcaaatttgaatcggatataattcaaattcaaatttgaatcgggtatataaacttttgacttataaactttgggtctataaactttaggtgtataaactttagatgtatagaaatactatatataaaaaatatttgaattcaaattcaaatttgaattggatatataaacttttgatttataaactttgggtctctctaaactttagatgtgtaaacttgaggcgtacaaactttaggtgcataaatttactaaaataggaaagtaatgcggtgacaacaaaaagaaaaccaggtggagggaggggagatccgaactgatcactaggggcgatcgatcgccccggcccttagcaatctcgcaaacaaggccctatcatacccggatcggattacaaaatccttttccttaaatcggcatgatttcttctctatttatatctttatccatacgttgggatacctttacatatacaaaaatgtaagcagtattctcaatgagagtagtaaataaagatacgtagtatgggaatatatctttgttcacacaaaatttccgtgtacatatcgtgcacaacaactaataaatttcacaaaaaattctaaagaaaattatatatacttccaataatattacaatacgtgtagattcttaatttctaattcattatattttagctataactaaaaaataaaaattttgacagttttaagagtataaatctatgagaactctatctcctttttcactaaacataattaagaaacataattaagagtaaattgcattggtggtacacaaacttgttaggtgggtgtaatttagtatataaacttgtaaaatgctcgtttcggtacacgaacttgtctagtttgtgcaaatgagatcaaaatagcttggcaatgttaattttatgaagctgatgttgattaggacgtgccatgctgacgtgtagtgagtatacataagatatgcaatatttttaaatttggtctctactttgtccttcgtcatggaaatgatgaatttcatatatttctaacccttatatcattgctcgttttgttttctatgatcactatatccattctatttttattgaagaggtgtatgtctaatagagaccttctcagatatatgtttatatagtaatcctaatcagcctctaaatcaataagattagctatgtagtgttctttttgtctttctccgcacgccctagacaagtttatgcaaaaaacaagcattttacaagttcgtgcactagattgcacccacctgataagttcgtgtaccagtgatgcaatttactctataattaatttcaagatgagacattacacaatagacgtaatagtactaaaagtatatatacaaatctttcactactaagaaaacgttataggtgccggcacttttgagatgcacactagccaaaaatagttggctcgattcattgagccatcaagccgatcccaaataatacccaaatcccaagatttcctcaaatccatgaacacgagctacaatcaataatccttagaaaaacaacacatctagatcaaataaaatcacaaatagggagggagtgggagggatggatctgtcggccgccgatgccgtcgcacctctagccggcagacccacctctccgccggttgacgtcgccgcgccacaccttcagccggtggccgcactgccagatccctgcagccaatgggcgagcgccgtcacgctgtcaga

SEQ ID NO: 43772 - DNA, 3583 bp, Oryza sativa
ttcgtcaagtcagctgaaagggaggctgaagcgaggttgaagacgaagcagttcgcgatttggctggattcgaagaacagtctacaaccacgagtccacgagcgcagtctttaaattttggcccggccaactcctagttaaggcccactcggctcagccactcccccaaccagcctctccccctcctggcctccacgattcgtcgattccctaatcccactgccgccggccacctcctcttcctctctcctaaatccatagccctaggcggctaggcacggcggcgggcgcggtgtgggcgatgagcaggcggcggtgtccggcgaggtcgagcggcaagcaggcggtggctttcgacgagctagtggcgctacggcgaggggcaagactggaggccggccagccggccagccggcgccgcgcgcggcagtccaggcgtccagcgccgtcgcgccacagcgaagatcaggaggtggcgagcctctctccggcgagggtgcaagcaggggtgcaaggcggcaaggcaggcaggaaacgccactgtgccgctgacccgctgtgggctgtggctggcagtggcattgtggcaacgacgcagcttattgatggtctgattgaagatttgaagttagaaattggtaaactactaacctctaatctctatctctatctctatctctatctctactacttatatataaaaaaataagaataagagatgtttccttcgtccatcaatataaaaaaacagcggaaaaaaataaaaaatccgattccctggcggaaaaaaatgcgattcccacataaaacgggaaaaaaaaacgtagattgaaaaaatatatccgattcccacctaaacgaaaaaaaaatccgtttcctgcccaaaaagaaaccaagaaacgtagatccaattcccacagcggaaaaaaaaatccgattcctccaaagtgaaaaacaaaaataaatccgtaaaaataaaaaaatccaaaaaacatgtagaaatgtccgactctataagaaagtagcgaaaaaactgttcgtaaaaaaacgcaggagaaaaaaaaagggcggaaaaaagcacggcaaaaaagtctaatttttattcgcagtgttagtagaccgtatttatctcttctctatctctaatttaatctaatctaactatttaaaaaaagaagtttccatcatatattaaaaaagaaaaatgcacgagaaaaaagtttaaaaaattgaaatgttagaaaaaggtgcaaaagaaaacgcgctagaacaaaaggttttcgtagtccaaaaaaaacatgccagaaaaaatattttcatcgtctgtaaaaaaagcaaaaaaaaaagcatatgaggaaaaaactgtaagaaaaaaggtaaattgatgcacgcttggtcgtatcggatccatcgattttttccatctcatacacagcttttgtttcgccatctattcttctgtattggataccctgcacatctctgtaggcaattatcagactatttttatgaacaaaagctactattcttgataacatattatatggaaataatattagaaaataaacatattttaattgttatttagagaatagtgcacagtgactctattttgtgtagttttgtatagacttgaccatgtgaggcagtctaggatttgattggttgcaagaatgggattaaatgttgtcatatgaataatctaattattttaggtaaagcaaatatcggtaaggttgccatcattgaggttgggccattacgtttaagatgttccaattttctaattttttgtttgtcatcaacatggttatacatgtaaaacgtatattatcattagttttttcacccgttgcaacgcacgggtatgtttgctagtataaataaaattgtgtcttgatagttcaagttcagtgaggttgtgaacttgtgattgaaacttataattgttctctatacatttttattttttaagattatcaacatgtcaaaaagaacactgctcacttattattatggttcaacagtggcgaaaacagcgtggggacggggaaggtctttataccccctatcccctaatggaccattagagcctccataataccccgaaaattctaatccacatatcagaatgcccaaaaggctgagaagcccaaaaaaaaaaatccccacccaaccctaaatctccatcagtcgctcttgccgtagaggcgcaaagagaggcgtagacgcggagcagcaaggaagtaggggcggcaccgcgggcggcggcgtgcagctagcagacaagcacgagtgcacgacgttccaggcagagtgcggcaaggcactttggtttagccccattataattttatcctggctctgcccctgatggggagtgccccgccacgctgctgcctcggtgtatggaggagaggagagtagaaggaagaagtggagagcaagagagaaggaaggagagaaggaaggagaagagagaggaagaagagggagaggagcctacgtggactgggtgcgttcactggtggagaaaccctttgtagtcccggttggtaccccccttttagtcccggtttccaaaccggaagtcgccatcgggggattaaagtcgcctatctttagtcccgggtgaaataaccgggactaaagatcgagctgacctttttttttttttgcatggccctgttgctgcatggtttatatatatatatatatatatatatatatatatatatatatataaaccatgcatatatatgtttcaatacatatatatgcatacatatatatatatatgtatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgttctagctagctacgatttcgacgtagtagtagtcgctgctagctcagaagctaaggaccggtgaattgtgtttctgtcgtagtagaattcacccttgggatcaaggatttcttcgttgatgaatcccatgagttgttcttgaaccgctgcgataaattccttgtgtgtggtcaggttatccctcatgcgaataaactatatgaatgtatgaaattgattattaattaaacaagaaatcgttacgtaatgaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacat

SEQ ID NO: 43773 - DNA, 1499 bp, Oryza sativa
agactcttttttatccattgagtcacatacgttgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattgaactaactctgtgttgtacggcaacagtatgaacgtcttgtaatgctgcgccttcaggagatggacgagattgtcctctatttcttgtggatattggtcgagcattgcgacgtttactctccgagggtcgatgaatccagtatcgaaaaccctccgccgtcgggccctttgaatctccattctacaacgataaaagggagtattttattttatatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattggtccgtagttagaccggtgtcagtaataaattgttctatcgtcatttctttaccggtcaccaatggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcgatggagctgggggggccttgactttgaaggtgccggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcgccgtctcctacagggtaatccagctcgaggtcctcgtatgcgccttcgaccaactcaacttcgaccttcgagtatcctgctggaa

SEQ ID NO: 43774 - DNA, 2006 bp, Oryza sativa
gtgttcgtcccgaatcaccccgttaatttgtcagctcggccctatctctgtctggtcggaacgtgccctgggaggaggcttccactgcatctgttagtcgtcgcgcagcctctcgtatctgatcgccgaagactagtgagccatcagctgggttgagcgttccaccgtgagcatagtaccagaacttcgatcgttccggccaattgggtgttgccggttcgatacccctctcaatcaagcaagcctccatctcctcccagttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctctgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccatatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatatgacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactaaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatacatatatatatatatatatatatattgcatttcacgttaacgttcgtcctcgttcgttcgctcgttctcgttcacgttcgttcgcttgttctcattcacgttcgttccctcgttctcgcttgtcttcgttcgatcgttctcgttctcgctctcgttcgttcgat

SEQ ID NO: 43775 - DNA, 3621 bp, Oryza sativa
ggcgaattcgagctcggtacccctaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgataattacttcgaaaaattatttttgtctgtaataaattaagtggataaatcgtaataagcaaatatatgacttataattaataaaaattccatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactctgacgatttttcttttgcctgcgagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgaaaggaccatagtcaagttcccatatgtcctcgatggcaccgtaatacgtggcagttgttccatcgtgtcccatggcatcgacacgaacagcgctgttttggttcgtgctcttcatgtcttgggctcttgtgtagaatgtgtacccattgatctcatatcccaggaatgtcgcgatcgacccagacggtcccctcgccaggaaggcaagttgttggttgattgactcgttacccatgagatattgtcgtagccacgcggggaaagtatcaatgtgatgccgtgtaatccatgcatcggacataccgatgttcctagcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacagatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagatgtgtcatcaacacgtgacagtcatgagactttaggtttgtgaacttcttctccttcgtgcttattattcgcttgatattcgtggagtatccagacggatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcattacgtcgattgcgtggcgtacgtccaagaattcccaatatggtaactcccaaaatatagagttctttttccacatcgccgcgtgaccatcttcgctctctatatgctggcttccaggcccttttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactgtcacgtcctgataaattcatcccgaaataaaaatcattttctaaaaggaataatagaattaattaaaattcggaaagaaattggcaaacactaaaatacgtacaagaaaaattcgaatgtggcccggagaatttttgttaaattctccttggtctaaaaagagccctcaaattttacttgaattttcagagcaccggaaataattattaagcaacaaaaacaattatcaaagtttattaaaaagaaaaacctaaaaaataatcctcttctctttgggcca

SEQ ID NO: 43776 - DNA, 6751 bp, Oryza sativa
gaattcgagctcggtaccctagtgggtactctatttatggttccactagtatgaacttaggtagatgcttcgctggttaattaggcaacattaggtggttttataactttagactttgggaagtctcatatcattcggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtcttgtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttctaattcttaaaatttgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggattgtctttataaaatggctttgggcaactaagtgacttttaaatgctgtttactgcaaaacttaacccctatattattatccccttgtactcccttgcattaattatgcatctgccggtgtggcttgctgagtactgtggttgtactcattcttgctcaatctttcccctcttcagtaagagaagcgttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaaaatatgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaatgaaactatttgcgaaagttccttttcctcctttcccgtgtgctatttgcaaaatgtttactctttcttccgtcttcaaatttcaactagtactagatggttagttttgcgagagaagaagatgtcgccaattgtctgccgaagctccggaaggctgcaggattcgctagcgaagtggaggaagcagtgaagccagctgtgaagccgaagctaagatcttggagaacctgtcgctgaacctaagccaccctctagggtagagtcgttagtcgtgtgttccttgcttgtgtgtgtagtgcgtggtttgcatcggtgggttgtgatgtgaccatgctaggttgtttgtttaatcaacttgcagaataagcaaaacaaacaacacatcaacaaaaagagttagttcctttaaggtcttgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaattggaacaacccagcaggggcaaccaacgttcaagtacctacagtccagcaacagtgcaagttatcagaatttctcaaaactgagcctccaacctttgccattgccgtcgatcctatggaagccagtgattggttgcgcacaatcgagaagaagctagggttgattcagtgcaccgaccaggagcgggttggcttcgcaactcatcagctggttggaccggcttcagaatagtgggaagtgaaccaaatgtaaagaaagtgaatccgagttgcttgttcatgagagctattcccagttatgaaccaagtgatatgttcgaagatagtctatggaggtcagattaaaatcgcatctaacaacgaagcttcagatttggcaggataacgatcagaccataacaagtccagcagcaaagtcatttggggagacgtcaaagcatgtcaagtgggataagttggttctttttagaaacataattcaaaggcaaagttaccgacccttgcatcgaatagcagaagtagctagcacctggagagcaggaaagctaatatgaggcagttggtggcaagttagaagtaaatgacaagcatggtatcctagtaatgacgagctgatctcgacgcatgacatgaagtgggtaacttgtatgaggttgactccaaagatatgaactatgcgaagttctggaactgaagccccatcttcaagcgccgcaacccagtcgaagtcagctaaaggttcaaccagggacaagtcaggcgaagagaagattccatctgcaacaagggatcgagccaagcagcctagagtggcgaagttttgctaggcaagtttgttataaaagacgcgacggaagaagtcagacaagaagagaagaccgcccaacctatcttcttgctagcctcctcgaatctcggggacgagattcttgtaaggggggtggatttgtcacgtcctcataaattcatcccgaaataaaaatcattttctaaaaggaataatagaattaattaaaattcggaaagaaattggcaaacactaaaatacgtacaagaaaaattcgaatgtggcccggagaatttttgttaaattctccttggtctaaaaagagcccttaaattttacttgaattttcagagcaccggaaataattattaagcaacaaaaacaattatcaaagtttattaaaaagaaaaacctaaaaaataatcctcttcctcctttgggccaagcccagcccaaagtctccctctcctccctctctttctctccctctccttctctccctcctcctcttgggcctcctcccctcccggcccactccctcctccctctctctcccgggctgcctctccctcctctcctcctgggccggccgctcggcccaagccgcgccccctgcccgagccgcccctccctcccgcgcacgtgcgttgcacgcgcgctgagcgcgcgccccgcgtgggacccgcctgccaggcgtttcttcctcctcccgcacagcttctctctcccccgtgcgaaccctagctcgctccctcctccaaatccgcttgattcacttggttaattccaaaattgattagggggttttaatccccattgattcctcttcaatttcccccaatttcccccttgaatggcgcccccaatcgtcgggaacgcccgcgttttctccggccaccaaccatggccgccggccgcctttaccgccgccgttccgacctcccccgtggccggctccctcttctctcctataaaatgcaaccccctcgctccgttctatcgctttagccccctcccgcggtctcccatggtccctagccacctccccaccgtcgccctctctctcccgtgccgctggacgcctccagccgcccctaccgccttgcccgtgcgccggccggccgcgccgtcgcctcctccagcgtcgccgccacctcctccaccccggcctgccctccgtttcccgcggagacccccggagctgccttcccgccgtcgcccttctctttcctccgtgccggccacctccagccgcacctcccgcctcgcccgtgcaccctccggctgcgccgccacctctcccggcgtcgcagctgcctcctctttcccggcttcgcctccgtttcgcggggaaatcaccggagacgcgtcctcgccgacgactagtggtgtcgccaccactccaccatctccagccatccctgccgcctcgcctgagcgtcggccgacgtcgccgtctcctccctcggcgtcgccgcatcgccctccaccccggctgctcctcggtttcgccggaacgccgtcgccgcgccggcctctccatcctcttcgtcgccggcgtcctttcggccgccccttcctcctccccggctcgtcggcttgctgcaccactaccacctccggcatcgcagccgcaaggtcgtcctcggcatcgtttcccctccatccaaacccctccgcggtccatcatcgtcgtctccgatcgttctcgtcgtcgacgtcccgtcggtcgcccggctcgtcgtctcgcggcgccgcctccgtcatcgtcatcgcagcggcgtgttccacgtcgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagtgagccgccgcagccccgtcatcgtcttcgtcctcggctccgcatcgtcaagcctcgtgccggccgcgtctcgccttcgtccaaggatcgccgccgaagtcgttccctcgcctcgccgcgtagtggtaaggacctctccctcgctgccccgtcctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgttgacccgtggaccgtctctgtgtacccggtctaccgcggtcctttaggttgacatgtggggtccgcatgtcaacagcgcagccttcctgtctcttccaggctagcgcttacacctgttttataattgcaaagcttaattataataatccgcaaatctccatataacagcattaaacctcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagtaaggcaagtcacgtcatccttgaacatattgaatcccagtttataaaattatgttgctttaaattattgcattatcgctttatttaaattcccgcgttatcactgttttatctagccatgcctatttacctttgttatgaccttattattgttgttgttattatttccttgttcaccctagaataaacaaaaccccaactagtgggtactctatttatggttccactagtatgaacttaggtagatgcttcgctggttaattaggcaacattaggtggttttataactttagactttgggaagtctcatatcattcggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttctaattcttaaaatttgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataactttgcatagttctaagatcgtgtttacaaaatagccctgagcaactaaatgtctttaaatgctgtttac

SEQ ID NO: 43777 - DNA, 3222 bp, Oryza sativa
gatcccgggggggcctgtcatgacctgacagcattcgaaccgggattacggttggtaacacaaaccgggactaaagatcaaatatgcccgttacccttttgaaccgggactaaaaatcatctttagccccggtttttattgcatccgggactattgtggaaatcggccgaccgacgaaagatggtttctccaccagtggttggtgggtggtgccgtggtctagcccaccggttcagctcgggtcattaatagttaaacccaacgcggtgatatagtcccttctcgtggtttctttgagccccttgcaatttctactactacttacttttcctgtggagtaagccaaatcgcatcatcgcgcttggttcgacgaaacttcgacgaggcgcgttgtcacctttttcctgttccacgatgaaacggcagggatcatttgcgcgccacaatcgccaattatataagccgaggccacaccgccacagaagcaacggtaagcaagcccatccacaacggcaaccattgaagggagctacagtgtaagtagctagatacgcttaattaggcgactaggcgagtacgtagtggctgcaccgcgcagtcatggcgttttctgtggagaagtgggtagggttcgggtcagctatggctggcgtcggcttgctttggtcccgaatgccggagcacgtccatgaggaggctaggtacatcatcagtagcttggttcccatggcgatgtcctacttcaacccctacgagcagatcactgtgtccgagtacattgcaacggaacatgctgttcgacgccatctctgcctacctgagaagcgtgtgcttggatggtgcaagcaagctcagggcccagctccgcaacaacagcaatgacgacccacttattagtctggaggagaaccaggaggtcgccgacagcttcgagggcgcccgcatgtggtggaggctgttccccaagacctccaagaagagggggggcaccatcatcagcttcttgcctggggactcggacgagccgcggagcttgaggctggtgtttcacaagcgccaccggcagctcgtgctgaactcctaccttccaggcgtcgtccggcagtggcgtgagctaatcgctaagaaccgacagaggctattgttcaccaaccacgtcaaagacgggaagagcatgtggagcaatgtcccgtacaatcccccgtcgacattcgacttgctcgccatggaacctgccaagaaggttgagatcatggacgatctcagagcattccagaaggggaaggagtaccactccaaggtcggcaaggcgtggaagcggggataccttctacacgggccaccgggcacgggcaagaccaccatgatcggggctatggccaacttcctcgactacgacgtctacgacctcgacttaatatccgtcctaaacaatgccgacttgcggaagctcttccttgatacgaccgacaaatccatcatcgttatcgaggacatcgatgcgattgaggtcgagctcacaaccaaccgcaagggcaagaaggcagccaacggcgacgacaaacatgtggtgatagggctgtccgacaagaatcacgacaaaagtaaagtgacactgtcagggctgctcaacttcatcgacgggctgtggtcggcgtgcggcagtgaacgaatcttcgtgtttacaacgaaccacgttgaccacctcgacccggcgctgacccggcgtggaaggatggatatggacatcgagatgtcctactgccggttcgaggccttcaagatgctcgccaagaactacctaaacatcaccgagcactcactattcagtgaaattgagggactgctgagcgagaccaacaccactccggcagacgtggccgataaactcatgccgaggaacggtgaaatcggtccactgctcgacgagatcgacgaggaaccagtcgatcgtgatagcatcatgctgcgctacaaccggaagagacatgctgatgaacgcttggaaagtttagtggaaacactgatcatgaagagggccaagatgaattccgcaacatctcctatggaagaggccaaagaggaacaacctaacgcagaagaaagctagacaagggccccggtcggatatatatgtcatggtgactgggcttttgtgtgtggtggaaaatggtcagctaggctcctttttgtgtgttgctattttacctgattttcgtgtttgtttagtcacttacgcttgcataagtcataccctaaaatgacacaatatacaaatgtttagcacagaaaaataacaacgatatgtgtggggtgccagtataactaagtacataaaataaacaaaaaacatagggaacatgtgcttcattaatctcaaggttcataaatacaaattcccaaggtaatatgtatgtatgtatgtatgtatgtgcactctatagcttgtcgttggatagatctgaacttgaagaagtggtcctctggtttctgaggtctcgaaagtctcccagttaattacctccgcaggcctaggtcaacagaacacctccgattaagctgcttgtggttgtctcttcatattcgcttcacgttttgcatgcatgatgaatattggtgaagatggtggatatgtacgtgggcgctgacaatgcatctacggccagggtttgcagtttcgaaagtgtgtattttgccaggggaggcgaaataactgcaatcgacaaaatttcagaaatttcaaaaattttcatccgaaattttttgaattaaatttgaaaattttgtccgaaaaatccgaaatatagccgaaaattccgaaaattcggggacaaatcattttgcaatcaacagaaggataattgaacattcgatcaatcaataattgccaaatactcattaattgtccaatgactaaagtatttacctcctggtggggctatgtttctccctcgcccaataccagtctcaggattgccgccctccgttccacttccaacagctgctgctgctgatccccttccccttccatcttccgctcgtcttccaacaactgctgctgctccccttcccattcccctgctgaaatcagctccaattattgagttgcatgcactgaccagttcaacccaaaagcttaagctgatgaggaaaatgcgggcaattcactttatattccaacactccccctcacgcgaggcccccttaagcctctagcgtgga

SEQ ID NO: 43778 - DNA, 1931 bp, Oryza sativa
acattcgatcaatcaataattgccaaatactcattaattgtccaatgactaaagtatttacctcctggtggggctatgtttctccctcgcccaataccagtctcaggattgccgccctccgttccacttccaacagctgctgctgctgatccccttccccttccatcttccgctcgtcttccaacaactgctgctgctccccttcccattcccctgctgaaatcagctccaattattgagttgcatgcactgaccagttcaacccaaaagcttaagctgatgaggaaaatgcgggcaattcactttatattccaacactccccctcacgcgaggccccctcaagcctctagcgtggaatagaagtgggttgcatgcactgactagtttaacccaaaagcttaagctgatgaggaaaggtaggcaattcactttatattccaacactaatagctgcggcggcggctgatggaccagggcaaccatgacccctgcatctcctactgccagcatatgcaggaccttcttctcccatgcccacagtgcacactacttcaagaacaggacaagagcagagtaactaatcagacagtggcgaagtcgaaaattgagagttgagacaccgaatcagtaagaatggggatggagaggcaagaaattccaagatacataccgctgccttctcgtcgtcgacaaccctctcgccaagttaccggatccaggagcaactgaatgccaccctctacaggaggagcaccgccgccaggagcccgaggggcagggatggctaatgcgctgatgacgtggactctacgagggagcagctgagccaccgcggccacctgtaggacgagcgccaccgtgattgaggtgtggaggtggcagcgtcacgtaagaggatttggcgccggaggttaaggttttcgtctctcagcggcgctgtcggggaaaaaatgggttagggttagggttgtgggggtagtgagggccttattagcaaatttttttaaaaattttttgtccaaatttttgaccggcattgacttttgccggaccccactagcaaaaccgaaatttttcatccgaaattgcaatccatgtctacggcctcatcactccatgcgtcggttattgttattcatactatcaacatgtgttgcatgggttactgttattcatactattaacatgggttactgttattcatactatcaacacgtactcagaccttaatatatacatagtcaatataataattttatcagtaacgtaatattcatggaagatgatgacatcgtagttgaaaattatagtaagagcaaaacctgagatatgttatctacattaagtttttttaaaaaaaataaaattaccgaggaattggcttctaagattgctggccattgcatacttgtggttctcttctaagaagaagagtactagcaattctaatacacaggagatccttatattattgcgtcgcctcactgcttctgcttcgacacgttcagctggttcagttgctttgccctctacacaaactggttctattgttcctggttctcagacttccaatgagggatcctcatctgcttctggtacttttccgtggattcttgattcttgtgtttctttccatatgacccctgataagtcttgtctttcatctatatatcatcctttagtccttattactgttcaaattgccgatggtacccctctttctgttgttggtcgtggaactctttcattttcttcttttagtggtcgttctgtttcctatgttccaaatttgaccatacagctcatgtctgctggacagcttgctgatcatggttgtcgtgttatttttgattctgactcttgttgtgttcaggatcgacacacgggtctcctagttggtactggccctcgccaccatgattctcagcgt

SEQ ID NO: 43779 - DNA, 6437 bp, Oryza sativa
  unsure (1)..(6437): unsure at all n locations
nnnnnnnnnnnnnnnnnnnnnnnnnnnnnnnnttgtttcgaaagggggtaatcgctactatatcatttttatagatgatttttctcatcatacttggatttatttcatgtctcatcgcaccgaggttttggctatttacaaatcatttgctcgcatggttcatactcattttgatacacccatcctaacgtttcgtgctgattcggctggtgagcacctttctcgtgagctgcgtagttttctttctgagtagggtacacttccacagctctcttgccctggtgctcatgcacagtatggtgtggtggaacgtaagcatcgtcatctccttgagactgctcgagctcttatgattgcttcttctgttcctcctcatttttgggctgaggctgtttccacagctacatacttgacaacatccaaccttcttctgctctttagggtaggcttcctcttgagcatctttgtggtcaacctcctgactactctaatttgcgtatgtttcggagttcttgctatgtgcttcttgcaccccgtgagcatacgaaattgactgctcagtctgttgagtgtgtgtttcttggctaaagtgcggaacatacgggttatcattattgggatcctgtagggcgtcggatgttgatttctcgggatgttacgtttgatgagtcttgtcctttcttttcgcgtcctagttccacatcttctcatgagacctctctctcattcctcacttgtcctgatgcccctatttgtactagcatccctctttcagtatcttcctctccagtggagcctcttccagtggacccttctaatgagactcttgcatcttcctatgtgcctcctcttactcaagtctatagtcgtcgccctcgtgttatggagccttatgttgatgcttctcctattgctcctccgagatacaatcttcgggatcgtaatttagttacgatttgtccagaggatcgctatggtcgctatgcttatgttgctactattctcgctgaacctagttctcatcaagatgttgatattcatcaagaatggcaacatgtgatggcagaagagcttgctgcacttgagcgtactggtacttgggatcttgtaccattgccatctcatgttcgtcctatcacttgtaaatggatctataaggtcaagactcgctctgatggaactcttgaacgctataaagttcatcttgtagcgcgtggttttcaacaagagcatggtcatcatgagacttttgctcctgtggctcacatgaccattgttcgaactcttcttgcagtagcctctgctcgtcattggaatatctcctagcttgatattaaaaatgcttttctcaatgaggaattgcatgaggaggtttacatgcgaccacccctaggatattcggttcctaagggtatggtttgtcgtcttcgccgctctctttatgggctcaagcaagctcctcgtgcttggtttcaacggtttccttctgtagtcagtgcagctggtttctcggccagtgcttatgatcctgcactttttgtccatacttcgcctcgtggtcgtaccattctttttctctatgttgatgatatgattatcactggcgataatgctgattttattgctttggttaaggcacgtctcaatgctcaattttctgatgtatgatcttggttctcttcgctattttctagggattgaggtttcctctacccctaagggtttttatctttcctaagcgaagtatattcaggatcttctggatagggcttctcttactgaccaacgcacggttgacactcctatggaacttaatcttcatctttctgccactactggtgtgccattagctgatcccactcgctatcgccatttcgtagggagtcttgtttatcttgctgtcactcgtcctgatatttcctatgctgtgcatattctgagtcagtttgtttatgctcccacccaacttcactatagtcatcttcttcgtgttcttcgttatcttcgtgggactatctctcgttgtcttttctttactcggtccacatctttacaacttcaagtgtattatgatgctgcatgggctagtgattcctttaatcgcaaatctctttctgcttattgtgtttttcttggtggttccctcattgcttggaagactaagaaacaaacaacagtttctcattctagtgcagaggctgagttacgagctatagcccagcagatgttacttggttacattggttacttgaggatcttggtgtttctgtgacttcctcgacctctttgttgtcggacagtacaggtgctaattagtattgctcatgatcctatcaagcatgagcttaataagcatattggtgtggatgcttcttacacacgcacctaggtacatgatcaggtgattgctcttcagtatgtgccttccgagttgcagatagctgatttctttaccaaggcacaaactagagctcaacacacgttctatctttccaaactcagtgttgttgattcaccataagtttgagagggggtgtgttagatgtatatttagattttatattcctttatttgtaaagggtttttctgcatatttgtgtattcttgtacctgtatatatttaggcgttttgccctgaggtgaatacaagtgttgttcataacaattcctaatgcatgaagatttcatcgcatttgactgcacccatccacgatgaaattgatttctctctaacaacttgataccctcgattcaaattaattgaactgctctgctcaactcctcttcatgtttgttgcctgctgcagatgcatatgtgatatgcaggtcccgctgcatatatttggccaccgagtcgcccggggcgcacaattaactgtatatgtcaacatctaatttcttctatttactcccttgctttgctttgctctttgtagatcgatcttccatcacacgtcatgaacaaactctcaaagctatcaaatgagggcagccattgttccgctgctaccgcaaacctgggcaagacgaggatgccagccgtgaagtcccatggagcagcgttgaatctccctgttgcatgcgtgcaccgtcgattttagatcagtggtgctgattgtatgacatgttaaattaactaggaaggtagcccgcgcattcgcgcggggatgtattgtacacagggttaaacttttcggtttagccgatttgattgggcatcagtgcatcaccgaaataccgaaatttctgaaattttgaaaacatagtttagttgaatttgaacaaatattaccaaaattcatgaaaagttaaaaaaattcggccaaaataatatcatatctgaggggtccgaaatgatcgaaatttctgaaatttccaaccttgatttgtacattgcgtttgaaatatatatatatatataaacagaatatcaattggttgacacctcccatgtttaaaagtacttttttatttttttatttgaataagacacatcaggtgaggcctccgctgttcttcaatattttgctttgataatttttccaagatatttgttaggttctaaaatatatcaaatttgatacatctatataaataattatctacaatctctttattatatataagaagttcgatttagtttgtttggaaaacgtgtctaacaaatcaactgtaaattagaagtaaggtgttttgttctttttttaacaaattctaaagaactatatttttaataaatatgttttatttgtaccatcaagtagttctccttttagtaggtttaagttgatgcgagttgttacatacttatatataaattaatagagacatgtcatatacctcgcttcgttgtgacctatactatctttttcaaaagaatatacctagttaacatgaatccaaaattttaaatttagtagtaacaaatataacttttcaaagaactatatactgcgaaccttagtgcggtttatatatgtaaaaatatgtggagaaactcataatgcaataatataggatagatgtaaggccattaatgtctaagcattttaaaattgttacgaaaatggaacatgcaatggttggtccaattttagtgaaatgtaagaaccaatttttttatgaacgtatcacgttttctcaaaatagtttaatttagtccctattgatattttctattacctgctttattttatattttatacagttcaaaatataggctttatggatctttaaatcattattctaattataaatacaataatatttagattagaaatcagatgagcttgaaatttatgcatttttttaatattttgattatttttggctgtataaacaggaagggatagagtggagaagggatgtgacgagtagtgtcgtgttgtgcgtatgttctgggggagggcgaagtggaggcgtggatttttctattttatctaaatgatttaagtgaaaccgttgatatattttttatcacattttttttattccaatttttaagacataacatattgcggcttaagacattcttaaatgtatatctattggttgaaaataatagatctacctatttaagtggaaactgatggtcagatgatttttcttccaatttgtaaagttttatttttatttaaggcgtaacatgtgacgccttaagtgcgttcagaggatgtacaatgatttacgataatatagtactcattttcattttgtattatggtttgtattttttctatttggttaccatgcaaaggaacggtgtctatagagtgaaatatgggtaacatggatattaaattatctatttaattataaataaaataaaaattcaaataagttaaaattatgattcaactttagaattataatcatttggctttctaattattgatctgtttttacttagttaaaaattaggagacaaaggaattaaatgagtgaggagaggaagagagagttgaagagaggagattatgcatgcatataattgtaataattcccgagttgtagtgttttagtttttattacttttttaactgaaaattaaaaaaaaatgatttattgatcgattaaaatctatagtttttacttctcttttccagtatattcatagtagatattaaaaatgcgaacactacaatctaataatctaataatactattttgacttattctaatgttataatgggggagtagttttttaaagcattcggtcattttactgttatccatatagatctaatttaattattccgaagtcatatatggtgataaaatatatatcattatctttctattattttataattgttcgaatggcacacaaaagtcagaaaatatagccctaaactgacatatttcttctcaaaatcgatattacagtggatatggatcttcaaatgtaaaataatctaaagacgtaagttcatcaaataatattagtagtgtgagtcagatgttatagttcttattttgttgcataagttttgctttctaactaacatattttgtaaacattactcatagtatattcattttactttcatgattgtagacctaatttaattattataaagttatgcatgatgataaaatctatattattgtcattattttatatgtttttataattgcttgaatggcacgcaaaagacagaaatataaaccaaaatgacattttttttcaaagctaaattgtagtgaaatatggtcttcaactgtaaattgagttataaataatctaaagatttacgctgatcagaaattagttgtatgattaagaagcttaattgtttaacacgatattattgcttatctaactaataaggcatgaacataggagaaggaataggtgggtggataaatgaattgaagtaagaggaggcgtacatacgtatattcgtttttgtaaaaaaaaattaacttatacatacaaagctctttggtaggcccgagtttaggaaaggaattttttcttgaaaattaatctaatgcttgtaaataatgggttcaccaaatttaatgaaaatatgttttgttattttagaattttaagaatttcactaatttattagagcatcagatgacaacttagaagcgtttggcgaattaggagcatttttggaagtttaatgggctttaagacatctaacctaatgttgtaaaacatcaattgagtccaccaatttaaatgaaaattgatggtgatatttatgtaaatttatagagtattatgtttcatctatttctatatgttactacgtgtaagtatatatatgtgttcttccggtgtttctctgatcatgtattacgtacgtacaggagtatgttctttccggtttatctgatcgtgctatactcacgtatgtactcgcatgtcttttttttgggtgaaacaatagcataaaaataggatcagaaaaaggaggaaaccc

SEQ ID NO: 43780 - DNA, 2284 bp, Oryza sativa
agagctcctagaaagtgtccaattagtatataggtatagaggtatgatagatagatagatactccctccgtcctaaaaaaaggcaaaccctggatttccgtgtccaactttgactgtccgtcttatatgaaatttttttataattcgtattttcgttgttgttagatgataaaacatgattaatattttatacgtgacttgtctttttaatttttttcatatttttttcaaataaaacgaacgatcaaacgttggacatggaaaccagggtttgtctttgttttggacggggggagtagatagatagatggattgtactggtgtcagaagacccatcttgaaaaaaaaattaatggctctgtaattttcagttctctagggctgtctttagatttaaagttaggatccaaacttcagtcatttttcatcacatcaacctgtcatacacacataatttttcagtcacatcatcttcaatttcaactaaaatctaaactttgaatccaactaaacacagcctaaacacagcctaggttctattctaattttcaggatgttacccgcacaacagggagggaagtagcgggcagatggaggcactgggcggcttgtccatctcgtcttgagccgtaggccttgaatgtataattgctttgattttctcctcctccggtcgccgatctgaggtcacctgcgagtgcgactggtctggctggtgtccccaccagttggaccctcagtgcctagttgcttaattaattacagcaattaatcttctattttttctcacctttgttggccggccgttccatatgtttattttatcgcgatgtttctttcctatgattcatttctgttttctttggcaatttttaaggaagagcgatctttgtctccaagcgtttctgaacatgtgccagcagcttccgttctcgggttgccaaacctcagatgccgtcatcattgcagctgctcgattagggaaggagattcaaatgggtttggttaggctgaggtgttaattaatcaactgaggctgcaagttgggttgagtgtagaagagtcaattgcgaaatgttgttccccatttcactcgttttatttttttaaaaaaaaattgatacacagggaacgttaccgataaatttctctaacaacaagtcaataagtccaaagataactgaaaccgtaaaaccattatgttccatagaaatctaaggtatatctatgggagataatagtacaagacctctaaaagaaatgattgatttctatcgattacttcgaaattagcttttcgggaaatttccaaacgaacaatttcaacgaatctttcaatttcttattttattatgttcaactttatgtattcctctatccgtagagtacattgaatgtacagaaaaggctataacatagtaatttcgagaaattcctacggaatgattattgtataggaatttcgaaagagaattagcatgaggtcttacattatgttttcttctttcaatgtcttgaattctattttttctgtgtgactatcaaacattagttttaaagtgttcctgtgttttcaaatcccctaggaatccaataaatatgatattctatttttatatttttcctattcccatgatttgataatcatgcgttcaaaagtgatcctgaacttgtaaaattattggcccatttttcttttctttaatcccattacaacacttgggtacgtccctagtaaaagttcgagcaattctgaaccaaaacaaatcgttagctagctagctagctaggatgggtgataaaatatgggtctctctctatgtgtgtgtgtgattttttttttaagaacgtgatgatgggtctcaactcccgcggtctcgcccgcatagggtgtggctaatgcgggagcgatcacccgcacgcccctaccccctatacgcgatcacccgcacgcccctaccccctatacgtacggatctcccccttcctccttccctcattctcttcctactacagtaaactataaaaaaatttaaaaaaagttgaaaaaaattatgtataaaaatactatatataaaaaatatttgaattcaaatttaaatttaaaacgtgtatataaacttttgaccagagccggtcctagggaggcgagcggtgcggtcgctctggcccccaaatcgcagggccccgcgccaaccccaccccccccccttcggcgcgcgcggcgcgactatgtggcgttagggcgaaagcgaacagacgccgaataccccactcgcgagat

SEQ ID NO: 43781 - DNA, 4581 bp, Oryza sativa
ggtgtaggtggctaccggccaggcgctgcacgggcaccccgccacccgctgcttgcttgcttgatggcttgatgcttgccgccggctgccctagcccctagagcactggatgtcttgacgaggactcgagaaggatgggccgaccgccgacgggggttagtgaatctgaatactgtatttgtctgatcagtgatcaatcaacaatcattctattaaggtgagtgtaacaccaatacatcgccatcgccaagtgaaaaattgaaatttttgtaacattgtgattttatttgttaacatgtaatctcatgtgttggtttttgctgtgtattgatgtatggtcctatgttaggttaatttaattgttccgataattggacaaaccgacgaaggcacaaatgtttgaagaaatatttgaggtaacatgtactataatgttttctatataaatattttttaataaaattttaatatttatacaataatttatatataaagtatatgtatatactaattatatgataagggcctctatatttagtttcgcaccggggccctaaaaagtcaggaccggccctgctttagacttataaattttcggtctataaactaatatttgaattcaaatttaaatttgaaacgggtatgtaaacttttgacttataaactttagatctataaactaatatttgaattcaaattcaaatttgaatcgggtatgtaaacttttgacttataaagtttgggtctaaaaactttaggtgtataaactttagatgcacagaaatactatatataaaaaatatttaaattttaaattcaaatttgaataggatataattcaaattcaaatttaaaatcagcacctataatattatgggtgccggttctacaccaaaaaccaacacctatatggcactataggtgccggttgtacacccagaaccgacacctatattattgtaaccaacacctataatattacaggtgccgattttttagccgaaccggcgtctattctcctcgctggcctatatgatgcaaactataggtgtcagtttggttaaataaccggcaccattgatatatgtgccggttttttcgcacggccgccacctgttgtattttaggatagttggtgggaggattttttgtgccaccaatgtccctcccaacaaaaaccgacaccaattaaccgttataggtgccagtttttcactatattggcgggaagtgtcttataggtgtcttttttagctaaccggtacctttgtggccgacactaatggttgtttttgtagtagtgagatttgtaaaaatactagtggaagtcacgggcttgttcactttgctaccatttttaaccttatcaagttttgacattgccaaattttggtaaggttgccaaaaccaaattttgatttactaaaatttgacaacaaactaagcttagccaaaatattggtaactttataaaaaaaatggtatggttgaagacgatgacatcaaagtgaataggccccacatcttgaagattaggaaaaactaaaatagattaagtaaaggtagccgttgatgtaacaatccatttgaccctgtaattaatcttatccttcccatttctatacacataaatcatttgtttgacccatttattttttatacgaggttatcaccacttcttgccgaagagaaaagttctacgaagctccaggtatatatactcatatatgtataaaaattaccacgcacgccatccaggattccataagcattgaccgctctgccgtgacgcttaattaggcttcgataagcattaattgacctttccttcaccgttggcgtttgtatcactctccacctagagccacctactcccttatggactatacagactatagtcaaaataaaccttactaaattagtaatattgctaagttttagcaggattctttatatatttatcaaagtttagtaaaaaaaataaatgtatgcatatctttgacaacttaaaagaaatatagtttaaaatggcatcaatctgaacaatcccttattgtattagtcatgcaggtggtgcatagcttgatgtgcaaagtactggatggcatcgacaaacaaccgatgcactcatttttcctagagcaagtataaggtgatgtaaatggtttgtacaagctagttgtggcatcatatttgtgtttacatgatgtagagagggagggatttagagaaaaaaagcgggctataaattgtaactagctataacacgagctccaataaactgagtatgtgagagataggtggattaagtattaatgatgcagtatagatgtataactaaatatgcatgaatatactattaggtcgttataactgatattttaatttttggagctgggagttcactgtattattaaacttgctcttaagcacatcttgagaaaaaagtcctagaagatttcgagcgcccttggatgccaccactggtctactgtcgtcacccaacagctgtgacgtgctctgttttctggtgcgttcgttaggagatgtgataagagtggaaaacttgctcgcttctctacgcgcatgattcccaaacggttaagcgatatgttttttattaaaatgccgcacttatccagtcgtgttcacctatagatcttgtcgttgctgtttctctctctgtcggtactacattattgccagccacattcatgctattatgactttcttcattaccaacctccaccatctatggacgaagacactattcattcttggtctagcctaactatgctcctgaaccactcatataatattgagacaatagaatatgaatataacaggaaaattctaatttatgtcaataaaatggttacctattcagaaatgatggataggatttgtatttatgggctaaaataagtttttttttaatttctagctaattttagttgtttttccatttacaatattaattttagcactatttgatcgattaaaaattattgtattaaaattattaaataattttgtcagggttatggataccacctacctaatagtagttgactaaatctcggaaggacccaccacataccatgtcctatatggaaacaacctgtggatataggaggagttccggataaggaaagataatcagagttctacatggaaacgacaaggactactcggattatatccatattggtttccctagttcaacttggacaaggggacacctatgggtataaatacaagcccccttaggaggagagtggggacgaggcaatcaacacccaacacaatagacatagaagcctacatacgccaagacacgtcgccggatatcgacttcagggataggcatggctagtcccctacggtgtctctagatactgtcaggagagacgaaagcactatctctgatctcgccaggcacggatttgaggaggaaggctaccctgttgtcgactacgagttatatcatcataccgccatgtcgacaacagttagataggctaccccaaatattatactggtgtgattatcatgaataagagcaataccggcttcggccaacaggatgtagggttattacctgacaattcaggggcccgaacctgtataaaaatccctgtcttcatctcttttacctcggtctcgcgtatatcctagtaccaatgatccccataccatgcaaataccgtagtcgagacatcaaacgtcgacaaatttgaattatcgtttgggccaaagttatttatagtttcatgttgttatttttattattatatttccttcagtcgagttgtgatatatgatttaggattttaatttaagcatatttctttcagtccagttgtgatatgtggttcaaaattttaatttttgtcgatgaatgttatttagattccgttgtaacgcacgggcattattctagtaagttaaataaatggataatttgatgtgttacccacttatttaatctatatataagtgataggtttgtgagatgacccaccgctccctctcttccgttaggccttgttcgtttaatccccatgagggaggggttggaagggatttattccacacctattgtggtatggaattattctctctcaatccctcaaatcctattcaattccctccagactccaaaccaaacaagaccttatagagataagacatgctagccccaaactcggaaccggatcctctgactttgcttgcaaagtcacaagcgtgcagttgggtttaaatccaccgttcgttgcatccaacggttctgccatgcactaccatgcgggctgcgacctaattcggcccaatagcacaaatgcacgatgatctattcctccagtcctccggcaagggcagcgccgctggcgccgtggcggctctttcctccgatgctggcgtatcgtgctcgttcccttttctgtcgcctccaccttcaccttcaccttcaccttctccttctacacatccacacacgcgcgcgtacatgtattgcatgaggcatatcaattccagcctcgtcttccaattgaccgtggtctcttggttaagcagctt

SEQ ID NO: 43782 - DNA, 1644 bp, Oryza sativa
gactggtagtccgcacggccatgcgtgctgcgactcgctatgcaagccgggaccgtcagatgcaacagacggtggatttggaccatagtagaaaaaaccggaccggtcattgatccggtggagtgtttggttcaccggtctatcggttcaaccggtgggtcactggttgaaccacggtttattggctaagtatattctgtgttgtcttctagtcaaaacagctaacttagcctagtggttggcaaggtttgcatctatcctaacagcctggggtagaatcccacctttgcaccatattttttctcgcataaaaatcaagttgggcctccagtcttacaaggctcataagaaatatacaagccagccggtttagggtcacccggttcagcggtttcgcgcgaaaaccacccggttcagccggttcacaccgggtcgattgcgtgaacgatcctttgagggaaccgagccggtcagggagctggttccggttttttcctgttgaaccgccggtccggtccggttttttctactatgatttggaccccgactgcacgtccgtgactttgcaagcaaagtcagaggatccggttcccctaaactcatacctgccgggccctccaccttccagcgttgtagtcactatgtactagagagcggaataaacctctataaattttaaaacaaatgtatatgtttctataattgtttaaagaaatataaaaaactcagaggtagcatctcgtacttagaccgatatacaatctgagcgaaaaagctattgcgtgaacgttcccggaacaagttcacgcgaatgccgcttttccggatcacatatgtgtactaaccctagccaggtcgtggtaatttcaaatcaccaactgattagattctggagatatacgacatgggccttgtgggccatagtttaagttgagatctttatcttatttttaattttttgtttcttttgtgaaattattttttcttctagtttgttatttattttgtgatcacaaaatatgtactcatttttcaaacatatcagcaaaaattatgtttgaattttttttctattatttagagaaagaattttatatcttatataaacttatcatgtggaaagtatattatttattaataaagttataggtagaaagattattattctactttggcccatttaagtacaatagaagttttattaaatattttttcgctggacttattttttttattgtttaaaattcactcatacttttttgaaaaaaaatctatgttgaaagtttgcatatgcaaagtttatatataacaagacataaaactactatgcataaagctagtatatgtaaagtttatacagataaagttacatgtatgaaatagaattgtttatgttggattttagtctaaatgagaaaggaaaaggctgggatatgctagtgggcccatgaaaattttgcatatacgtggactatgttgtgggctggagtagagttttgtgagcaggttcagatacgcacggaagaaataggtagcgtccacgcgtttgctccacacgaccagtcgcgtactagactcaccccaatctgggccaggagcctcataactcggatatatatgatggggctggggatcctctagagt

SEQ ID NO: 43783 - DNA, 839 bp, Oryza sativa
gtctacgtcttcccggccggcctgcttctttccccgccgattggtgcctccgctcctgcgcctacacggctggcctattatgccgccgctattgggcgtctacgacttcaccaccggcctgcctccgtcgccgccgattggtgcctccgcctacacggctggcctattatgccgccgctgttaggcgtctacgacttcaccgccggcctgcctccgtcgccgccgactggtgtcctcgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgctgctgttgggcgtctacgtcttcaccgccggcctgcctccgtcgccgccgagtggatcctccgcctacacggctggcctattatgccgccgctgttgggcgtctacgacttcaccgccggcctgcctccgtcgccgccgagtggtgcctccgcctacatggctggcctattatgccgccgctgttgggcgtctacgacttcaccgccggcctgcctccgtcgccgccgagtggtgcctccgcctacacggctggcctattatgccgccgctgttgggcgtctacgtcttcaccgccggcctgcctccg

SEQ ID NO: 43784 - DNA, 10225 bp, Oryza sativa
  unsure (1)..(10225): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaatttagatgaatttaggatcaagtttcattcaaatcggagttaaaatgaataagttatgctagtgtaaggattcaaattcgaataattgcgaaacagtactgttcacatccgatttattttaatccgaaacctatctacagctcagagtcactgacgggtggggtcaggggtcttattatcttttctaccgaattatttttgttagagaaaaatggggagtgggcccggcttgtcagtggctcggctgctctctttctctctctcgttcttttcctatcgtcttctacctccagaccgtgcgggagcagcaggggcggcgcagcgcgcgcggcaaggccggcggagggcgacccgacggcgaccaggggagggagcggcaaggctccggcgtccacctgccggcggtcacggcgtaagacggcgcgggggcgagcagcgccgcacggccgccatggccgggcacgggtagctaggtgctagggcgatacggagggtttccgaccaaattggtgcgggcgtgagcatctatgacgtgtgagggttccattttacttattagatggctaggaagagctccgggatggcttgtccacggcaagctcgccggcggcataatggtggccgggccagcacggctacgggcgctagtcgccgaaattgaaggaggctcgagtttctacggaaccaggagagacctgaggagcgtggacttaccgatagacggcgggacgacgaagatcgggtgcagtggtggagcggagaagaaggtgcagcacgcccacaagatgctcgatgaaatgtatccgaggaagaagaaaaggaagagaggggaggacgagctcgtgggggctgggaggtgtggggagggaaggggaggcatgggtttatatagggggcggaggggagaggtggccggtgcagtgatggcggatgggacgcgcgcggcgtgcggggctcgaggcgagcggcgacgggacatgagcgcaggcgcagcgcggggctcggcgcgatgatggcgacggcgcagcagctgacggcagcggcgcggggctcgagacgagcggtgacgcgacggcgacacgcggcgacgcgacggtgacggcgacagcgcgacggcggcgcggggctcggcgcggcgagaacgacggcgacgcagcagcggcgcgatgggacggcacgcggcgcggcagtgcacggggcgcgagggcgcgtaggcggcagagggaggtgggacgggcgcgcggcggggcaggggcgcggggcgcgaggcgacgacgtgacggcgacgacgatggcgcgcggggctcaaggcggcgacggcgactgctcgacggcgacggcgatggcgcgcggcgcggggcgcgagctggcgcgcggcagcggcgcgggcgacgacgatggcgacacgagcggcatcaggcaggaggaggaggagggctaggacggctaggaaccaaatcgaacacctagggtgctaatgaacagtgctagccggctatttaaccctattttagcatatttcctatataaattttattctataaatcctaatttttacacaaatgaagtttactcaatatttgtgttattctaaccaatggattcaccctagattaatattacccatatttatttatttatcgcacaaatgaattctttttagattaatttgagttattggccctaaggtgaacttgtatatttttgaagactttggggtactattacatttaatatatcgacttgtcatgattaatacattagcagattggtcaagtttagttgtatagcaatatattttacacggataggttcaatctatttattctataaatagtaaattgagactcggtacaatatcaatctaattgtttaattaaaactcacatattcttatttatatataagcttaatgtatttatatgaccatcattttatatgagtgaattttatgcccagaaagatatgttaaatattaatgtaagtattccaatgaaatactcatctacaaataggattactatagtggtgatcatcatttcatgtggataggttgtccttttaaatcggttttacctctatatgaatcattatattttaatatttgacctataaattaaattagtaattaaccttctctttgtatggctttgttgtggtgcgtaattatttatagagttcataataaatatcttatttttataattgttactcagttgtatagctttagcttaattttcagtggtgacaatttatagttcggcaagcaataacaaccataacttccagcatgatgcaaaagttttaaaaagttcaaaattttagtgatttttattgtcttgaattttcaggatgttacacctagctccacaaatcccacgtgaaaaataaagatcagaaccttaaatgacctttacaagttctatgcaaaacttatgctgagcaaaaattatagtctaaaactaatttcaattgtgtgcaataataatgtgtagtccaagggtgctactcccgccccatgccgatcgatgtcattaggtatctaaaaaccaaattaaacacaagagtgagtaaagaatactcagcaagtacaatcttgaactagtaaaacatacgcatgatttatgcattaagaaaccaacatgaagggttggatttactttatttttaaacaaaagaagtcaaaagatagtagttccctcccgggcaggtgtgaatatcctcttagcattaccggtaagccgagcaagcgtgatcagcgcttctcaaggatcatgaataaagatccaaattgcactcccatggctacgcatggttcttgaataatgtaaacagaacatccggaataatgaaacatgaatttgaatatgggtcgaaacacgaataactagcataacgtcatagccatacaatcagtaataacaagcaattgaataataattatgcaagtaaagccaaacaaaacaactcagttttgtccatcatataagtccgtcttgtacttgccttaactcattcgatactccgactcaactcctccaacgttggaaccctccacacctgtggagcaaaactacgcataaaccactatattcaactaatgatggttacaagggatatttagtaaaatcgaaacctagaacatataaaccttttaccgatttgtattaaataacctatagctgttccattactgttttatgagtaactcacaaaccgtctaacggaaactagcaaataatacaacttcggacatctagacaaaattgtctacaactttcatgttgagcacaaaatcagattatgcctctgaaaatcccacattaaggaaaaacgaactgctgtcctgatttccggacccggtcagcagtactgtttttgctgtttctcctaaaccgttgatcggaatcgagtgaaactagcagcgttggaaagatattgacaatgactacaaactttatttaggacaactaacctgattcctgatggtttaataccagatttgaaaatacggtttcagcctagcgttcgatataaaataaattcgaaaaaaccggaaacagatcgtcttaaatataaattagaaacaactatagactaaaacggattacctagcagtactaatgtataagaaaaacgaagaatttggaaatattcaccaaattccccaaatttcccttcttctatcaaatttccccttctttccttccttcctgttcttctctgccttctctccctccttcctgttcgttgcaggccaacagcagcagcagcagaaacgaatatcggcagcaacagcaagccgtacaccaccaccaaggaagagatcagatcgacaatagcagggttcggcagcagcagggaaattaacagaaacaacagtagctcaccaacgaccggctgcggacgacgacggctgtggcgaccggcgatggctgcaccagcggcggcgccggcgaagagaggaacagcagcggcggcggcagagcgcaggaggtgcggcggctagggctacaggagaatcgctcctgtttctttttttttcgtttgttttttttttggttggttatataaagagactagataagatctaacggctcacatctattcaatcctcgggacttcgttcggactccgattactataaatttatagtctattttgcactactcggcgagctctacgcatccacggttcccgatcgcctatacgaacaatggtttaaaagttgaacttttgcgcgtttgctctaatattccgcgagatatattaatttaaaactcggggtattacattcttccccccttcgatcgaattcgccctcgaattcgcccaatcatactctagaacacgggatatttcttgaaaggagtacaactaaataaatcatgtgataattcacggcggaagattgcttgtgataatattgttgtgcttaagaacgaaggagatgcacaccttggtaaaaaaaacgaaggagatgcacaatgtaaaaaatgatgatacagtacagaaggttccaatttggcctgccacacggacccaagttgaaaaggatgcccattgattcaaggtttcgtttgggtgccatgcaatggtatattcgatctggcctcaaaactaaatttaatctggtggacagcacttccaaaaagagtgcctacttttttctgtaaacgagtgctacgatcaaacctgcatacatgccatatggactacacgatactatttcttgcagcttattcttatgattctcctgtagccttctccagttatgtatcaataagacaattatacttttcccctagacaaacagacaatccatattcatctctgaggagattgattattctcttgcttggtgaacaacggataatattattatcatttctttactattacaggcttgataagccgatcaaacaattggcttgcaatttgcctcacaggcttgcaagctagggtagcgtacatttctacagcagaccttcgatggggagaaaatgttgcatggtacgggtaccaaaccatttatattgacattgttgcgtccttcattcatggatgcactcctggtgtaatctagatttttacctgaaaaataaaaaatattttactaggaaagcatgaaagataaagaaaaaccatatgcaatacatggatatgtgaagatggatgtctagaagaaaaatggaaacacaaattttactctgaaagatatgtttctataatacatcgtgattaccacagaataattgaataattgtgaaatcgaaataaaccttggattcaccattgagattcaatattagatagtagattaccatacagatggccaggaatgctaaaacagcctagaagggccaacaacagaagcagaagtcctcggctacagttcggcatctgcttgcccatttgtgtgattgctttgtatgaagctgtggcttgtgtttcttctttgttttaggatggttatatagacagcacaactgaaataaatagacaaaagtaatccaatgattaatagtatccaattataaggcttatcgttaacatatgtacagttttgttataaattagtcaaatgaagtatggtggataatcttatctaatcttaccatctgcagtttactcatattgctaaacatggacggtggcctatgtaacgtctactagacactcaatgtgatagctaaatatttgttaatgtgtttattctgcacaatctatgcgaagttattccctcgtgtaagtaatatatgctcttttgcacgatgacatggtctgacatattaaattttaccactaatattctttccaatatactctgtgaaaagtcactagaattacaatattataagaagatgattgtaaaagtagttaaacatattttaccagctcctataatctctacctcccaatgaaaattttaaaaacatttacgtgttgtttggtgataaacctgttttatggtcaatgcaaatttctttgtattatataatcccttattttccatatgttacatggtatggatttttcgtaaaaaatagctatggatgttgatatatttttcggaatagataatgaatataggattggtggataatcgttcagatgtatttgttggtctatttttgtaaagtattcttaacggttaaagcgtcaaacattgtacgctgaactactaggtagttggaggtggaactagacatcctatggaattttacttacatcgtatagaattgtaccaactagagcaggttgtatgacccgagaggtttcatgtttgatcggggggagagggtgcgactacaaccttaggtgagcatgattccatgcataactcttgaaaatggacaagaatcacttgtacaaccaaacttggatgcaattgtccgaggtatacgacgtgaaccacaaggtataccacgaaaaaaaggtagagggaagatctcaaggtgacaaagatgtaaagtcaacaatacctaaccaggacacccactttttacaatctatcacgcatagtgaaattgtattgaaaaccaaacacatccttgtggttaccgcgtttacaaaatttgtggaaacaggttagtccaatgaaattgatgcatggaatctctgtattacccattttattagaataggtttgtagttgaaatgggtaaaaatgggtgacaatggtgtctccatagtggatactaaactggtgatacaaggaacaatcacacgagctcatgcctgttcacttcattatcaggcagtttcgttcttaaggttacaatatcatgatttctttaaaggggtacaactataaataaaatcctgtgataattcacgggggggagattgcttgtgataattttattgtgcttaagaacgaacgttatgcatactatggtaaaaaaaaacgaagcagatgcgcacagtagaaaatgatgatacaatacaaaaggttccaatttggtctgccagtcagacccaagttgaaaaggttgcccattgattcaaggcttcgtttgggtgccatgaaaagatatttttgatttatcctcaaaactaaatttaatctagtagaccgcacttgcaaaaacagtgcctactttattatgtaaacgaggactatgatcaaacctgcatacatgccatatggactatacgatactatttcttgcgcttattatggtgtttctcctgtggccatctccagttatgtatcaataagacaattatacttttcccctaaacaaaaggacaaaccatgtttaactatgaagagattgatcattctcttgattggtgaacaacggacaatattattatcatttctttacaattacaggcttgataagctgatcaaacaattggcttgcaatttgcctcacaggcttgcaagctagggtagcatacatttctgcaacagaccttcgatggggagaaaatgttgcatggtacgggtaccaaaccatttatattgacattgttgcgtccttcattcatggtggcactcttggtgtaatccagattattacttgaaaaataaaaaatattttactaggaaagcatgaaagataaagaaaaaccgtatgcaatacatggatatgttaagatggatgtccagaagaaaattggaaacacaaattttactctgaaagatatgtttctttaatacatcgtgattaccaaagaagaattgaataattgtgaaatcaaaataaaccttggattcaccattgagattgaatattagatagtagattaccatacacgtggccaggaatgctaaaacagcctagaagggccaacaacagaagcagaagtcctcggctacagttcggcatctgcttgcccatttgtgtgattgctttgtatgaagatgtggcttgtgtttcttatttgacaacacaactgaaataaataggcaaaaataatccaatgattaatagtatccaaatataaggcttatcctgaacatatgtacagtttttgtcgcctcccaaaacgaccctaaaatacatcctctaaattatgcctagaataattaaaatacttgtgaaagccttcaaaaattaaaatgtgcaaagttaaaagtcaattaaggcttggaggatttttgtatatttcgtaaaagtctaaaatgtgtaaataagttttagtggaattttcagagcataaataataattattaagaaataaacaaagttaaaatgattttataaaaagaaaaaccttaaaattccccctctccccctcttgggccggctcggcccatctccctccccctctctctcctctccccgcggcccactcggcccctccccgcacgcgcgccgctgacgggcgggcccgcccgccaccctcgctgacgggtggggcccacccgtcatccccttcatcctgccgctcccaccgccccgcccgcaccaagcgccgccgccgccgccaaatccgccgcatcccgccgtccccgcgtgcaattaagtgggaggaaatactccccatgatcccctctccctttcccccattttcccctctctctccctctctatttcggatggaaaccccccttaatcccgccggcgccattgatggcggccggacctcctgcgccggtttccttccccgccggccgccctctctccctcctaaccctatttaaaccctccccgctcttctcccgtctgtttccgcctctcgccgcccttcctcctcgccggaatcgagctcgcgccgtcgctctctctctccgccgtcgccgccgagctccggtccgccgccgtcgtcgccccggactgcctcccacctcggcgccgcatccttcgacttcgccgcatcctcgccgaccgccggagcgccgtcgaccacgtcgacccaagccgcgccaccgcctccttccgctctggccgcctcctccgtcgccgccgtcgccccggggtgagccgtggactgccacctcctttccccattccctcccctctctcggccgccgctccgccgcgccggtggtcgccggcggcgaccatcggggcgcgggcgccgtctcccgccggccacgccgacgtggccgccttcgggcgcgccgagcggcagccgcatggggccccgccgtcagccgcccgcgccctcgggtgcggctgacgcgtggggcccggtcgtcagccgcccgggccctcgggtgcggctgacgcgtggggcccacggcgccggccggtgtgagctcgggtgcacccggtccaccgaggaccgtgaggctgccgcgtgggccccactcccgtggacccggtccgcgcgccccctccccacggctgacgcaataaattctttttaaattaaaatttaaatgaagaaattcacaaatattcacttaaagagcatataaacttcaaatggccataacttggccatttgaactcggaattggaccgttcaagtctctaatttttccttaagaagtcaagaacccatttttgtactttgttcctgcttgttatatggaatttattagagtaaaagactttttcctttccgttggtcgtgtagacgctgcagcttcggaagatccgctcttcgtggaggttgaagccgacgtttgggaaagcgagcaaggcaagtcacatcatctttgaacatattggatcccactttgtgaaattattttgatttaaattaatgcattatcgctttatttaaattcccgctgtcggtgatatgggaccgggagtatcataaccagaggcttgaggcagacataatcgcccacgtggcctggcaccttcggggacgtcgggcccgagggtgaggtgtccgccctcctcctgatttcccccgagggggggtcggggtgcgcttgccccgaccccgagggccgaggtgccccgaccccctgaggggtttgcacta

SEQ ID NO: 43785 - DNA, 18493 bp, Oryza sativa
ttacaggcaaggtgttacacgaagaagggcaaacatgcacgttgttaaaccgacgcgtggtggacaagaatgaccggtctgacactggtcgcatcagcaacgggcagccacgatcccacgttgcgcctgtctccgccgggagtggaagcaggtatgggctgtcccatcaaagtgtcatttggacggcaaccataccgatctccgtccataaagagaagaaaagtccagtttggaaagggaagggtgcatgtggtatccccttgaagtataaaaggaggaccttgcccatagagagggggttggttgattctttcccggattgagagcttagaacgggggagaagtcagctcacactttgtaactcattcatacacagatccaccaaaacacaggagtagggtattacgcttcgcagcggcccgaacctgtatacatcgctgtgtctcgtgtgtcttgcgggcagacaatctttccacatacagagagaaagagagcttgagatctcaccctaagcccccggccgaactggcaaaggggggcctgcgcggtctcccggtgaggagccaggagctccgtcatctggcgcgccaggtagggggctcagcgtgtgctttctgagctctcagactcttccgtgtgccccaagcttttcttgttcaacctaatggccgagcaaggaaaaacgcacgacctctcgccgagtgtgagcggcgacgacggggagccgaatccacgccgtcgagctcgtactcccccacctcctccgcgccaaagccctaagcagggggaggcgcttgagaaggtcgacaaatccgtggcatcaccagtcgcaggtggtgcaggaggacggcaagatggggagcgccgcctcctcgtctacggcgacggcagcacgcctcagggtacgcttcaggctgctggcgcgctcctacgacatccgcctgtcgtccatgacccggagtctccagcccaacgatggctggaagatgtggccaacttggtcatgacggcacagcagcgcctgggtgctggtggacggtccgtcaccaccaagacctccggcgccgctaccaccggctccgtgtcgtcaaggcggagggcgcggcgagcggcggcggctgcacggcattcggctgccactccctcgtcgacaccctcgactcgagaggatcagcatggggagccggatgcccgcctcaacatcgagcgccggcgtaatagccggcgtactccccgtgcaacggagggcgcctcttcgtccagagtgtcacctcggcatggacgtgaggaccagccctccgtgcccccggctggtggtgtcggctgtagagcctttgtggcgagtcttcggaatgtccgttggcccccaaggttccggcccaccatcaccgagaagtacgatgggagcgtcaatcccaccgagtttcttcaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgaatcgcttcgctcgtacattcagcggttttgccaagtccgcaatactataccatgcatccctgcacatgcggtgatctacgcgttcagggggggcgtgcggcacaaccgcatgctcgaaaagatcgcttccaaagagccccagactaccgcggagctttttcagctcgcggaccgagtggctcgtaaggaggaagcatggacatggaactcctccggttccggagtggcagcttcggccgcccccggatccgccgctcagacagggcggcgtgacaggaggaggaagaagaggtcggaccgttccggcgacgagggtcatgtcctcgccgtcgagggcgctccgcgggccacccgaaaggggaggcctgcgagcgacaaaaagaaagaggctggtactcccagcagggagcgccccgtcggcaggtggtgctccgtccacaacacctccctccacgatctcgcggactgtcgcgcagtcaaaaatttggctgagcgaacgaggaagtgggaggaggacaggaggcaggaacgccgtgagggcaagtccccggcggttccttctggcaaacggcgaagtgaggccaagcagaaggcccccgctgttgacatcgatgatggtgaagatgacctaggtttccaagaacctggggccaccattgccaccgtcgatggaggagcgtgcgctcacgtctctcgccggagcttcaaggctatgaagcgggagcttctggccatggcccctactcatgaggcgatgcgtcgggcgcggtggtcggaggttgctctcactttcgaccagaccgaccacccaccgtgcattgcccggggagggcaggttgcgatggtggtttcccccaccatctgcaatgtgaagttgggacgcgtcctcatagatggaggagcggctctcaacatcctttcccccgcggcttttgatgccatcaaggccccggggatggtgctccagccgtctcaaccgatcatcggtgtgacgccggggcacacgtggccattaggtcacgttgacctaccggtcaccttcggtggacccgccaacttccgcacggagcgggtaagcttcgatgtggcggacctcagtctgccctacaacgcggtcctcgggaggcccgcgttggtgaagttcatggcggcggtccactatgcctacctccagatgaagatgccgggccctggtggccccatctctgtccgtggcgaccttaaagtcgcgctcgcttgcatggagcagcgcgcggaccacctcgctgccgcgaccaagcccgagggtggtgacgagaggcttggcacctctgcccccaccgccccgaggcagcggatcgccacatgcgacgaggccccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggcctgtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttatcatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcttatgttgatgacttggttgtaaaaacgcgcaaccaagaaaccttactctcagatctagcggaaacttttgaaaacctccgctccgcccgcataaaactgaaccccgataagtgcgtgtttggtgtacctgcgggcaagcttctcgggtttttggtctctgcccgaggcattgaggccaaccccgagaagattcgagctatcgagcggatgcgcccccccagcagacttagggatgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgtccggttgaaggcatatctcagctctcctccggttctagtcgccccggagccaaatgagtccctgctactttacttagcagcgaccccccaagtagttagtgcagcgttggttgtggagcgcgatgaggacaatcctcattctgcgcacccccactctgtgccgacttggctcgggagcaggcagggaggagaggcccccgagtcaaacggtggcctaaggcccctgacgaccggagacggccctctgcccgcttgtcagacggtgctgggtgcccccgaccctcaggaaggccccgaggccactgcgggaaggccgcacttaacgccctttgaccccgaggctaaccctgtgctgactcgacccgggaaagagcagggagaagaggcccccgagccgaacggaggccagaggcccctgacgaccggagttggccctttgcccgcttgtccgacgatgccaggagcccccgacccccaggacggccccgaggccactgtgggaaggccgctcctgtcgtcctccgaccccgaggtcatcggcacagaagacgagtgcgccccgaggggccacttggacgaagaacgccccgggggtacggcccctagcagagaggaacggccccaccgaagggtgcagcggcctgtctactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaattttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtcttaatgcccaaggccagcacgaacccctcacagctgcctcaaaccgcccactgggtgatgcagttcgacggttctctgtctcttcagggcgccggtgcaggggtcacgttgacctctccgaacggagacgtcctcagatatttggtccgtctcgactttcgagcgactaacaatatggcagagtacgagggactccttgccgggctcagggtggcagccgggctggggatccgccgcctcctggtgttaggcgactctcagctggttgttaaccaagtctgtaaggagtaccggtgctctgatccgcagatggacgcctacgtgcgccaagtacgacgtatggagcgccatttcgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgatcccttaggggagacggatgcgcctgaccggcccccgaggcccgtcggagtccaggtctcgggacccgaagggagcgctccaagctcccttagattgattgcttggatctctgagatccaaacatacctcgcagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgcagacatccatgagggcgagtgcggagcccattccgcctcgcgaaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagactttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtggtcggtgtcccccggccgggctcggtacggctggccacgggcgacggcacggagctgccaaacccgtggaacatcgaacaccttcgtcgcttctacccctgaaggggggggtcgggtgtcaggttttggctcgggccaaccccgcacccccctcgggtgtgcaggattggccgggggctaccacacatgcacatatattccttttcttatttcagcatttcaataaaagcagtttcaatttcctaaaggttgtgtctgtgccgtttttccttctaaagaatcttaacttaaaataaggtcactcatgctcaaccttgccctcgggggttcggttcggtcagctaaaatcgccaaacggggcccagaaccgagccgtgccccggggcgtggtgaactccgggggggaatcggcaaaagcccacgatcgggttacccataccccccggtcaccacgttcccggcctggccagtctcgacatgtggatctccccaggcactagccccgacccgagccattcgaggaccgggatttgggcgcgagcccttatttcaagctaaggcgcaaaaggaccatggcacagatcatcctcaactcatatatatagcaaaataaagttaacatagaaattttttttcatcatttttgattgcagagtaagttgatctatacaaaggaggcatgaaggccttagaagaaagaaaaagaaaaaagtaaagattgacgggggctcgggggctcattctgacgcgcccgggtcgccggcctcgtcgccatcgtcgtcctcaccgctggcatcgccctcctcgtccgagctgggggcgaacgcgagccgaggggccgagccctcgaagccgttgacgatgtggtcggcggcatcccggacgcgcgcgcgcgcgtcgtcctcggtcccgggagggaactcctccagcgccatccatggagagaagttggggtcccgggcctggtaactcgccagcacgagttcgaccgctccccgcgcgaggtcccttgaggatgacttgatggtcttctcaagctcctcggggagttgctcgagaacccaagccatcctgttgaggtgcggagcgaggccttccagattggtggggggcaccgacgactggcctccccagaggcccgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagccgcgaggcgggcggccaagtcgctttcgcccgcggccgccccgccgataggcgccctcgcggccagctctttctcccgtgcctcgaggttggcagcccgctgctccagcgcggctctctcggcacggacgcattcaaggttgcggcgcgcctgctcctcttgcgccgcctcgcggagggagaggctgttcgccagccgttgcgtcgtggcctcggcctcctcgagagctcgctcccgctcagcgagtgcatcctcgcgaaggcggagcgcggactcctcctcggcgcaggcggcctcatgcgccaccagcgtcgcctctcggagaccagcggcggcctcgcggtccgtcaagcccctctccacggcgccggcgtgttcttccagcgccatggcacgggcctcaagggcctcttcgcgccgccgcaacgccgcttcagcctctgttgctcgctgctctcgggcggcggcggcgtcgaggaccccctgggcggcgtcgagctttttctttagctccgcctcccagctcccgtgttgaaggcggagggagtcctgcgcctcgatcatcgcggtggtggcgacgagggcggcctctcgctcctcctccacctctcgggcgatctccgccagtgccgccttgcgggcttcaagctccgagatgtggcggcggtgggccttaccgcccacctccaccatggcgtccaccgagcgccgcccctcctcgacgcgtgcccatgcggcctcgagctccgctcgttccgctcgcaaggcctccacctgggcgctaaatccatctagcaccgcggtgtttgcggcggccaaggcctgcataatgggctcggcgctcaccggggcgacggaagatgaggagaaaagtcgccttggagaaaatgcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgaggaccgcccgagggagtgggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcgggctggccggacttggggtggcgggaggaatgcgacgggacatcgctgaagcagaagaaaaagccagaagacgagcaaaatgagcaagaaaaaacttctttttggagaaagatggttgcaatgagagtgagacgaacctgcgagggggtcggttgaatgaccaccttggaggggaaatcaggtttccccggcatggttccgtctcccccgtcttgcggagccgcttcttcttgcgcaccccctcgggctgcgacgtcggcgcggccccctccgggcgccgactgctggcacgcgccgccccgccccctcggggaggagatgggggaggtgtacctcccagcttcctcttcccctgggtgtcggcagggcggctgctccccgagcccccgacgcggggcccagaagcacgaccccctcctggggcaggtcgttccccccggcggcgctcgcccgcgccgtcgtggcccttaggggctctctcctctgaggccccgacccccatcataatggttagaatggagacgcggtcgggatcgctgcagagggggaggatctcctgaggaaggcgagacgcctccgcggagctaaggttcagcaccctttggactacgatcttgaagtcctcaggagcccaatcccatctggttccctggtgggtccgcatgtagtcttcaggcccagtgtactcccaggcgctccgggcgcgccgttggagcggcgcaatccggcgacggagataatcgccgtacaccatggccccggtgagcccctgggatcgcaggcccgccaggcgatcgaggacggcgtcgtagtcctcccccagatctaccggcgcccgccagctggagacctgcgccgggggctggcttggaagtcggaggcgcgcttcgtcggcaaggggggtgtagaaccagtcgctcttccagtcgtcccacttcttgcggaggacgcaggggatgtagcggtttaacaccggcccccgcggctggaagtagcagccgccaaccaccgacggcggtgacaccgactgcacggtgaagaaccaccggaacagctgaagagaggggcgcaccccaatgaacatctcgcacaggtgtgcgaagatggccaatgtcatcaccgcattgggggtgagatgcgccatctggagatcgtagaactccaggacatccatgaagaaatgagaaaatggcgggaccagcccagccattgcgaaggggaggaagaagatggaccgctccgggtagtctggtgccgggcgcccctcgcccagcatcactatctcccgaccggtggcggactccggcatgaagcggcgcggcagtccggcatgcctctcgttcacgatgcgggaaggcggcagtacactgccgtcgagcagagcagagccccgtgccatggcggtggaggaagagatgattgagaacgagcgcgtgtggcgaaagtagggcgtagcagagaaagagttagagctcaggcggcgagggcaagaggaacaatggcgaaaggaagggagcaaatccttttctcgatgcttttatacccttgccatcgctaggcctggctcctcgtttctcgcgcccactacctcgctccctcgtatctcgctatctcgctccctcgtttcccgtgcccacgcttccactaatcccatttgcccgcttacggcgcgtgaagtggatatgcggttgtggcaatcgaaacggattgtatcgtgcgcgcgttaattacgctcgccgaccgaagcggcgttaccgtatctccgagcgagataaatctgctcacccagattcgcgcgctgctcaagtggtgtggcagtcttgaatagaccgcccattatggacaaccaaagttaccaataccaatgtgcatggattgagaccgttgggtattttgcccaactatggagaccggtcccacctgtcaccaggctttaagggtggcgtcacacctgaccgcttcccttgggaagggaaattgctctggcataacgccgggggctactgtcggtgatatgggaccgggagtatcataaccagaggcttgaggcagacataatcgcccacgtggcctggcaccttcggggacgtcgggcccgagggtgaggtgtccgccctcctcctgatttcccccgagggggggtcggggtgcgcttgccccgaccccgagggccgaggtgccccgaccccctgaggggtttgcactatgtacgtaggttgggtgagcacagcagggctcacctaaccacatttattgcacatcggctaagcgtgtcacgccgcacggagtgcagtgcagtgcactcgattatccggtctgtgaccagtcacagaccggtcaaatcgcgagttaggtggcggcaggcggtctgacgcacgccttgccccatcccgtcaaggtgtgagcttctaagcactcgtccccagctggagctagcgtgttacatcccaaagatggcacgttaaccccgatcgatatataccaggcttcatcctaaccattacaggcaaggtgttacacgaagaagggcaaacatgcacgttgttaaaccgacgcgtggtggacaagaatgaccggtctgacactggtcgcatcagcaacgggcagccacgatcccacgttgcgcctgtctccgccgggagtggaagcaggtatgggctgtcccatcaaagtgtcatttggacggcaaccataccgatctccgtccataaagagaagaaaagtccagtttggaaagggaagggtgcatgtggtatccccttgaagtataaaaggaggaccttgcccatagagagggggttggttgattctttcccggattgagagcttagaacgggggagaagtcagctcacactttgtaactcattcatacacagatccaccaaaacacaggagtagggtattacgcttcgcagcggcccgaacctgtatacatcgctgtgtctcgtgtgtcttgcgggcagacaatctttccacatacagagagaaagagagcttgagatctcaccctaagcccccggccgaactggcaaaggggggcctgcgcggtctcccggtgaggagccaggagctccgtcacccgcgttatcactgttttatttagccatgcctatttacctttgttatgaccttattattgttattgttattattaccttgttcaccctagaataaacaaaaccccaactagtgggcactctactcatggttcccctagtatgaatttaggtagatgcttcgctgattaataagacaacattaggtggttttataactttagactttgggaatattcatatcccttggactttatggaatggttgaactattgtggaattggatgcacacctctccctcttttcaaaactctcaaaatggttttaggctgggcttggggtgcatggttttgatagtagcacctcggccatataaggaccggtcttcggacctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgatctgcggccggtagtcgagatgtcctggcacagggccggtgtcctgctgctaggggctcagtcctgcctacctatcccggagattccggccgtaggtggggttgggtcggtactcttgtctatgtctaggattggttggaaactatgtcatgtcttccttccatatgccgtggtggtatgtggcacgtggttgcacgtgaggaagacgtgtcttgtgggtaaagatgtacacctctgatcagagtaaaacctattcgaatagccgcgccctcggttatgggcaagcctagcaatgtacccaagttagtgtttttaattcttaaaacctgcttaataactaaaatgtggaatggttggcctgggttggcttgggacgagctgggacctagggtcgggttgccagttcggtctgaatcatcgtaggccttgggttaaggcaggttcatgtgggttcacggccttgtttaataatattacatagttctaggatcgtgttttaaatttggctttgagcaactaagagtcttttaaatgctgcttattgcaaaacctaacccctatactataactccattgtactcctttgcatttatgctgcacttgtgggtgtgtcttgttgagtacggtggttgtactcagtcttgctcaatttttcccaaacccagaagaggagctcctggatgatgaagggcctgccgtcaagcgcctgtggtcgtcgccctagtcttccgctgtttcccgtttgtctttgtgtgtgctgggccttcgcggcccatgtaataaattaactatttacgcttccgcttgttagcctctgaattgtatcaacttttggtgtaacttgcctcctgggacaaggaataatacacgcacgtaaggaacgcccgttgggttatttccggtcgtgacagttttgttatatattagtgaaatgaaaagtatggtggataatcttatctaatcttaccatctgcaatttactcatattgctaaacatggacggtggcctatgtaacgtctactagacactcaatgtgatagctaaatatttgttaatgtcaggctagccggagtcggcgtgaccagggttctggttcggccgaaccagggctagcccagcaggcctccagatttggcagggtcactgacaggtgggtccttatggcggtttccaggacggttacacctgacatgtgggcacatcttatctttaagcttgcttaggagtgagttttcctcgtttcttctccatttatgtattaatctctgcaaacaaaatatacttcaagtacaagtggaattatattattctagaacaaatatgcattgcaagcatagtaagttctcctttattttagttatattgacagtcgaaattggttcgtaacgaccgtcaaacctaccgtatatttgcaagggatacgattgatttggcggtggccgcagcagcgccagccagggtggatcaggcggcggggagaaggtggtggaggcgcagtgaagggcggcggcaagaggctcctcggctcctccttcaccactaccgggcgggagcagccgggtgggggatggagcggcgggcgggagtaggagccgcaagtagctcagcagcggtggatacggcggtagggagcacagaggcagtagatctgtcaacggggagggcggcggcaattgggagggacgccggcggtggggacctcagtggcagctgatctggtaatggggagggcggtggcggttgggaggtgcgacaaaggtggattcggcggcggggaattccatgggaaggggactcggaaacaccgatgacaacgaggagctgtcgggctttgacgacaacgatgatgagctgtgctcggcttcggcaatggcgacggcggatgtgattttttggattttcacttttttgtgaaattaatttttgcgtgcgggtgcaccaaccgtaggaaaagtattgatttttacaaacatcttcgggcagacggacagtcttatcgcgtgaaaaaataggttttggttgtatgcaaaaatgctttcttttgagtagcgtcacatatgcttggttcgttcagtccacgtgctgaatagtgtaggtagagcgagagatggagcatccagtattccagtggctccaaccggctgccagcaatgagaataccgtcatatttgtaaggatgatgtaattaattaagacactttctgataaaaataaaggccaaatagatcatcttggctcagtaatgcaaggttgggttgataattgaagctagtttgactttgtgtcttggagactcttaaggatgccgtctaataatcctacccgacactgccgaacatgagaaaacgtttgatgtccattacattacattgcccttttcacatcgttacaatttcaggctcagctcagacattcagtagaacaaagcggttcctaataatgcagcttttttgttattgttttattattagacatgttatggaagagaaaaaaaaactcacaaccgagaaacacaagcaaaccatacaccaaaataggttggcacccacaaagcacacacatatatctagcgttggtataatatttataagcggatcaatttcttccgtggccaagctgcagcaggagttgtccatgccccctcccaacagcgtttccatgatcgttgtccgatatcttaagcttgcgaacgacttcatgcatgtctatcaataagacaattatacttttccccgaaacaaaaggacaatccatgttcatctgtgaggagactgatcattctcttgattagagaacaacggacaatattattatcatttttttactgttacaagcttgataagctgattagacaattggcttgcaatttgcctcacaggcttgcaagctagggtagcatacatttctacagcagaccttcgattgggagaaaatgttgcatggtacgggcaccaaaccatttatattgacattgttgcgtccttcattcagggatgcactccaggtgtaatccagatttgtacctaaaaaataaaaaatattttactaggaaagcatgaaagataaagaaaaaccgtatgcaatacatggatatgtgaagatggatgtccataagaaaattggaaacacaaattgtactctgaaagatatgtttcttaaatacatcgtgattaccacagaacaattgaataattgtgaagtcaaaataaaccttggattcaccattgagattgaatattagatagtagattaccatacacgtggccaggaatgcaaaaacagcctagaatggccaacaacagaagcagaagtccccggctacatttcggcatctgcttgcccatttgtgtgattgctttgtatgaagctatggcttgtgttttttctttgttttaccatggttatatagacagcacaactgaaataaataggcaaaagtaatccaataattaatagtatccaaatataaggcttgtcctaaacatatatacagttttgttatatattagtgaaatgaaggatggtggataatcttgtctaatcttgccatatgcagtttacttatattgctaaacatggacggtggcctatgtaacatgtactagacactctatgtgatagctaaatatttgttaatgtcaggccagccggagtcggcgtcaccagggtcctggttcggccgaaccagggccggcccagctggcctccagatttgttctgaatatttaaaaatgagaaggaagtcagagataagtgcaagattgaactagctagttctgaatatttgttctgcttcaagcacaacatctccatgtgttctgaacttaaatactgagattcctgaagaacagattctggaagacgagtgcattccatctgaatacgcggtttgcagacgtcggctcggtgacgacacatgagtcagaagcaaatcaggattcgataacgttcatgctttccttgacttgacctataaagtaacgtccttattactcccgtcaatgaatatgtatatcgtcgtattaagaagatagtgcgctgcatcatgcacctaaccggcctgatgttctttttcaatacgggtgaatccgaagagaatgatgactctctgaatagtggatgaattattagatcggagggattgtggttagggaatcttttaaaacatagacactattttacaggatttttatagaaattaggaagcaaacactacttaaaaaaagtatttttgcggacgttgggtttcttttttcgcaggtggatatgaccctcggagccaaatatctgttagaaatttgatcataatttggcatattttaatccaaaataacaagataataaacatattttttacaatgggatttaatccagtgatagtagcatgtaatcaacatgagcatgcttaatgtagaataagcatcaacaatcacatagtaacacaatgttgacattgcgatgaatattaaccataaaacttctaattgaaataatgtaaaaaggttataccccaagaatggttctccgctggagtttgagatagtattgcctctgttggtgttgaccggagcctccttctccttgtcttgccgttacctccagtgttcgacatgttagtgaagacgaagtagatattgatgaacagtgagtagttgcgccttgcgctctccaaaaacctgatcgcccacccgtccgtgcaaacatcgtagcagtgcgtggtttcgaaggcctattctcccaaagcgtgtgcacacactcgtcgggatgggattatcgtagcagcaatagccttggaaatggatgaaagtgtgtctcacttctccttagagagatcaaatccattctcattttataggaggaatgaaagatgaagagtaatagaataggaagaggaatagagtaactaattctcatcaattacccatcaaccatcctctactacacaattatcaaccaaccatcaattaggagtaattgatgtaggttaccaacgaaataggaagaggaatagagcagctaattgtcatcaactaacaattagccatgaaccatccttcaccacacaaccatttaccatccatcaattaggagtaattgatataagttaccaattcacttatcaaatggattaattctcaaaactcttcatcccattgatatcccataagagaatgaatacacatgaattcctagcataatgagccttaaaattaatttgatttaattgatttaaatggatcaattacccaattaaatctaacaatatccgcttatgaaaatgtaaaccgaggtggattttcatcatcctcctacgaaaatcaatttttctaggcggaccacttaagaggtctgcctgcgaaaataccgttatttcgcaggcggacctcttaagtggtccacctgaaaaaaatatgatttttgcaggaggaatattatgtggtccgcctacaaaaactcatgcctacaaaaaaaaactaagtcctatcttatgttctcctcttccatcttatcctctccccaccactcattccctcaactctctctcgcatttccctctagctccctcccctccgcttccttccttccttccttccttccggc

SEQ ID NO: 43786 - DNA, 35806 bp, Oryza sativa
cgcccaccagatcccgcgcctccaccgctggaggggctcgccgtgcaccggagagcgtgcagtaggccggcgctaggcgtcgcccaccccttccgtcgctgccgcctacgacaaccgccgccgccgttgtcgccgccaggagggaggagaggagaggagtgtggccgggagagagaggagaggagtgaagccaggagatgaagtgtgaggtgggagagacaaagatagggggagggtagaataaaaaatggggtggacgaatatttcacatacgtgtgggtgagttaagagacccgcttgcgaaaatacccttatttttgcgtgcggatgttttaagtgagccatttggaaacatcgatttttttcgtacgggtctcttatggagccgtattcgaaaatgagggctgatttttatagacgcggacacttatggcccatctgcaacctattagattgcttgtccaggaaaatcatttttgaactagtggggaaacattgttagtaccgggtttggttctgaagatcctgtctagattcgttatactagtatgtgttacatatagtacaaggttgctatattttggtacggagagtaaagtctatcgacccaacaacaagctacaagctataaaaagataaagaaattgttaaatatgtgatccgaattttgggcccataatatattcggattgattttctaggagaactccatgtctatcctacgtttgtaatcaactcctctgcagtgatcattgccggtcggcgcccgtggtttttttctgcaagggtttttcacataaaacttcgtatctctgttgtacatctttttttcataacagaaatgacaagtaaaagtttacacgaactaaaagtacgggtctcccattcccatgtgtcacatggttagcgccatgtgaccgtactttgcttccattctccgtttctcccccaacccattactgtattgtttactctatttgagactagtccaatagctaataattatagttcggaaccctgtgcttacttgtctatatattgtatcgaagactgatctgatcttaccgtaactagaagggaacgcagcatgcatccgcgcacacagacatgactataaacatgacttgagcataaattttattagttaaattcagagtaagtatattattggttgaaaatttcctataattccatttaacataaaatggtgattttagaacattgtgtgataaagaaagcattccacaaactaattcaaaagataagaaaaattaactaattgcccatagggtgccaatttccccgctggggctaggaccccagcctaatgggggcagaggccaagtcaggtttcacacccatgggtgagcggcggtgggggaggttatattcaccctcgggtgacccagcggggccccaggctattagcgcgcgatgctgcaaccaccctccgtctctccttctccttcgagtcgtcggcttgccctgcctatcaaagcatgacgccgcaaccacccttcgtcccttcccctcatcggagctgcggggcccactcaactgtcgggtcctctacaggggcgggggtggctcaggttattcacccggtggccaatgtgaggccgggagcggggagaaatgtgggggcgttcctgcccaacctggccccgccccaccccgctgccactcctaattgccattggaatattgtactccatgttcataccattacttgcctggtatcgcacatgtacattaattaaaatataaccatcaggtttataccatggtcgctaatagtatgtaaataggttcacctaatttgtcattttttatagaatcaactgattaaaaagatagatcaggttagcttcgaacgtgggctataagcctgttgagctaatgaaatgtaaagcacgtgcatagacgctgattaaatgtaaagcacatgcataaactacattaccactaagtttagatcttgtcctgtgttgttctttcagttgtagcttccaagctgtgcatatctcaaacattgtttggttcactctcaaacattgccaaacctaaggggttgtttggttcactctcaaacattgccaaacctccatgccaaacatagccaaatctgtggcttataaattgatggctacaccttaggcaacttttggctataagatgggtgtatgacatgtgagcctttgaattgaaaaactttggcatgccacaactttggaagtgaaacaaacaagtatcctagaaagtgtggtaaagtttggcaaagtgagggagtgaaccaaacagcctctcagtgcaatcgtgcaacctcctttgtgtaccgttggattgaagatggatggtccagatcgagcacctcatccctatcgcacattttgcaaaaaaaccgcccgcctctcattgtctttttatgttttggttcttggactcaacttcctttctctttgtatcgtcccactcttctcaccaagtaaaaaaatttactcacaccagtatccaggagtaaaaatttactcacgcttaaagtcgggagtgaaaattttagtcatgcttaaaaccaaagatttactcacatctataatcagagtaaaaaatttactcatgcctaaagtcgggagtgaaaattttactcatgcttaaaaccaataacaaatttactcatgccccaaacttccatgcttgaactttgtcaatatcttgcctcgataaagagaagaacaatggctgattgagcggagtgccagaactaatactgaattaatcacggttggatctcgttggtcttttcctattagaaggtggaggcaagctccaaatggtgtttaaatgagctcttgttggtgtggagctcgagcacgggtggatgcgtgcaatcggcggatcgagcttgtgtggtagaccaagctcgagtgtggatggacgaccaccttagcctgtggatcggtggatgtagatcaagaagtggagtggcttggtcggagaaaagggaaggaagaagaagatgaggcagaggagagcgaagagggcaaaattgacttttcagctgtctccactgttcctcagctagttggatacattattttagtacccactgtgtcttgtagcaaatatccacacaattatagtgcccataagcaaaaaccggttttcattgtgtcttctagtaaatatcacattattaagtgttcactagcaaattttacataaaaaaaattgtgggagttagatcgatctcaactacccatagaaactgcacgtacgttgcctggagaaacaatataaacttccattggctctaaatgattaattccaaaacctaaacaggctgtagcgcatatttatagtgttgattactcggcgtatcgatcggagctcttcatactagcaagctagcttgtgtcgttaggatcgaattgcacaattcgtgcagtccaacctaagatggcctgcctgcagctgcaggttcttctcctcctcgcctgcctgctgcttgatgctcctcatcttagtagtgctgcagccacagttccaacaccacccttctccttcaacttcgacttctccaacatgtccacatacaagccggatgacttgagatttgagggcaacgcgactgtgcacggcagcttcgtcgacctcacctgcaacgcatatgggctggacatctctcagtgcacggctgggcggatgtcgtacaatcacccggtgcccttctacgaccaaaccaccaaggaggttgccagcttctccacacagttcaccttcaagattattgtaccaagatttaacaacgacaaggagaagggagatggtatggctttcttccttgcacgttacccatcaagaatgcctccagattcaggcggcggcagccttggtctcatcaccaacaacaactatagtagctttggcccggaccagttcgtatccgtcgagtttgacacgtacaacaacacctgggagcagcctaagcagactggtgaccatatgggcatcaacatcaacacagtcactttttcgactaacacaacaagtgtatccagcttcagcccgaatgagagcatgatgaaggcgtccatcacctttgacagcaagacctcgatgctggtcgcctctctgcagtataccggtaattattctaactatgcccctgttaacgtcagtgcgaaactcccagatcctacgaccttgctcccgtcggaggtggcagtgggattttctgcagccaccggggcagccttcgagctccatcaaatacactcatggtctttcaactcaactattgctgccccggtacaaaaaggtatatatgcagttactacatctcttgaattgattgttggattaatgcattgtactcgttggaggtacttctgacgcagcaattgacaccttagtagtttgtattttttttgaatgaatttgtaatgcagcaattgacaccgatctgccgtaacatcgatgcagatcacaagaaagccattgccgtaggggtctcaattggaggaggtctcatattggtgctcctggtgtggtctattctctcatggtggaagtggagaaaaacaaaccgtgaatttgacaagggaactcgtggggcttgtcggttcaactaccaccgcttggctgctgcaacaaaccatttttcaatggataataggattggagcaggtacgttcggtgaagtacacaaaggtttcttgacacaattgggccgtgaagtggctgttaagaagatcttgagggaatccagagcaggaaacaaggacttttttgacgaagtccagaccatcagtagagcaaagcagaagaatcttgttgaacttcttggttggggaatgaagggcagctcgatcattgatttcgtcatgtgctggcgtaggcagaagaacaccgaccttttcctggtatatgaatttgtggataacggcaacctacatatgcacctgtatgagaaggaggccctgctgtcatggagaataaggtacatgctgcgagctgagcaatataatttatattcaaattttaagaacctagctaggtattattatattactaccgcacacataaccccaaaaattattgtctaataatgttttacaaaactccaccatgtccatgttgagcataatttttctaaaaataaaatatagattgtatatgaaaattgtaattactgatttcttgactaaggttgatagtttaacttttcactgctttaaaaaaattattttagatatgtttaaattaaatgacatttcaataatacctatatatgggttttctgccacatagaccctaaaacatgttgtttcctggaagtaactattttgaatatggaagtttgaaaaaacgagctagtaatgttgacaatcattatgtacgttcctcggaacaagaaaatgattatgcatgcaaatgttgtcttttcaggtataaaatagtgaagggcattatcagcgctcttgtttaccttcaccatgatagacatccatacattcttcacagggatatcaaaccgagcaacatactcttggacaaaaatttcaatgctagattagcagatttcgggctgtcgagaactgccgacaatggaacaatacaatcgtcaatggttgtaggaacggaaaattacttggatccagagtgcaggaagacgggaaagttcaaccgtagctcagatgtcttcagcttcgggctcgttctgctagagattgcttgcaagaaagacgagaatagctatgcacaagtctgggaaaggtacatcgacaaaactctgatgcaggctgctgacgataggttacaaggtgcgttcgataagaggcagatggagcgtgtgatcgtcttggggctgtggtgttgtcagcctaatattgagatgcgacctacgatggagaaagcaatggatttcctggagagtgatgggccgttgcctaaactggccaaacccgaaattacctcctcaagtgcgccaagcaattgaactgaacaggatcagtcgaaatgtataagttgaaagtaagcaagtcacaccagatatattgtgttttacattggatttttttttctttccttttaattagtttgggcatgtggaagttatcacgtacatagaggggttgcagttgtgttaatttgcttgtggctgtagtcatcgtacatgtacatgtggagtcagtttttgtatagccacagactattcagagtttcagacgtgggatgttgtgttatttgccgccgtggcatcaggagtcttttgtacgtttgttttggattcacgattgagtataaaagaaaacaagaaaacgccgcagtcgttgtgcggcaccatatttttttttccctcgctttcctttttttcccactcccagctggtgaaaggatgacgatcttttcactcaccattctctccctcgaaacccccagcttgtttagcaactcgaggaaaggggattgggagtttacacgaggaaattgatggtgaggttaagatgggaatttgatttttaatcccagtatcttgtttggaagaggtggtggaaattgatagggagtttagggcttgtttggtacagctccaactcctaaatataactccaagagttgagtctggagtggagttgtggagctgcctacattttgtgagagagctccacccaactccacttctagttttggtggagctgaaactgtttagctgagctctagctccaggagaggtggagttggagctggagttatgccaaacaggcccttagttagagattaggtcattaatgaaaatagatggctgagatttgtttacgcagagtaaaggaggaatttcctcccaattaccaccccctaccgagtattgaaaaggagggagttcctccctcaattccccatcctcatcccaccaaaatttccatgtaacccaaccaaacaaaacagttaatagcctcatccctctaaactcccaatccctcctaaaaactccctccaaccaatcgaggtgacgttcagcctcatagccaagaacccaatattcggtgccacatcggcaatactcggtgccaaaacaggtactcggagccaaacttggatactcgttcttcgaatgaaaaaagtagggagaagctgggagaaagtgtcatggagggcggagcctcgcgcgagtggcttcgcgcaggcatcggcggtgagcgcgtagtactccagtgacaaggatgggagctcgtcgaacggcgtcatcaccgcgtgaccgtccagatgcccccaccgtccatcgctcccgtgctagaggaggaggaggaggagaaggaggggaggtgcggcggaggagaagagaagaggacatccggcgtcgattcggagctggcgagctcaatctgccgacggcgccgtcgctgctagggccgcccgacgttgttatcaccgctcgcgcctcgcgccgccctcgatccgccaccgcgtcgtcgcctttagggctgcctggtgccgctcgggctgtcctggcacttgcaccgcccttgatccgtgttatctaggtcgccgctagggctgcccagcgccgttcgggccgtcccgctgcttgcgcctcgcgctgcccgactgctccatcactgctcatctccgtctcgccatcagcctcggttcctctggtgggggatgaaaagagaggagaaagaggggacttcctctggtgaggaataaaaaaagggcgaggagagagggagagttaaaaataaaaaagatggtacctgtgggacccattacaagcaacttgcactgtggaacatatagcttaacacgttcttggtctatgtggcatgtgagaaacggcaaaaacgagcaacgcactgctaatgccataagataatcgattctaagaaacttccggaggggattttgtagtgcgattctctctttgtaggtgatggtgcacatagaggatgatcgcctgcaataccttttgtatcaagtgaactcactcaactacaccgactgctcaagaaaatcataagtaatataaaatcagtcttaaataaataacttcaataaaccagtagaaagaaataaactaaatcgtaactgatcattaatagaaaacggagacttctccaattctgtgtgcagatctctgtatggccacaacgaatgtcagagcacgattaatgcgagacttggtgggtgggctcatcccgtcaagtttgaatatcatcgccaactcggccaaaacttttactccttaggcagcatgccctattgaagctacgagccgcgttgcacgagtagcgtcctcctgcaaatggtccgggggagagtggaaagaacagaaacacttgaggacgggagagaagggcctacccagcaacgtctagagcatatctgccgttgatgagcacctccacgccatgaggttgataggatggcgggtgaaggagagctcaccttcattgcctccacaaccatcatcccaatcatcacaatttgtggcctcctcgagtgagagagagagacagctagttccggcgttcgttggtgggacggggagaagatggtactggaagaggagcggtaaggggtttgcggggagtgagagagtgccatttttttgacaaattatcttttcaaaaacttatttcaaaactagaccttgctaaaacttcaaccaaaaatgcttagtgaccttagcgccaggcccattggcaccgaacccccgccaatatggtgcccaagaagatccgctcgccgacgggccaggatcatagtgccgaccaccacgacgctaaggtgcccaacctcagcaccaagcatgttggcgctaaggtaatggaattaaccccatgcgcggccacacccagccgccttcttcctctcctctcctctcctctgcctaggatttgtacgacggagccaccctcttctctctttcccaaatgtacgcaaatccaccccaaatcgaaggggaatttatgggtagtgcgttagagattgatttgcacggtgaagtccctctgaaaaccctaatttccctaatgtttgcccatgtattgagtattttgattgaaaccgtggttaatttgttaaacgtggcacaggatgcgttgtgaattacggaatgtgggtcggcatgtaaccatgtgatgttgaggttgactagtgcagcactacgtggctgcccaacaaaagagttgtgttaggcagatcggtaacgtggcaaaatcctaaaccttagcgctaatgcggctggcgctatggttgagctgagtagcgccatttaggcttgggggcctcacttcacgaacctaccacatcagcgaggcgatgggctcaagctatatgtggacaggggattcaggaccaacatgcctagcattgagctgtaggacctcagggccgaggctgctggcgttgaggtcacggatcatttctagttaaataagtttttgaaaagggctaaattgtcaaaaaggaagagagtggtggcggggagagtggggatcaaaacagcgagggattatggatatatatgcaggtcttttttatcacaatgtctaaattatatgaagtttcaataattatctaatagagagtattacatgggttgaaaaatagtgtctaggggctaaaacgaaaaaaaaacactaaaatgtggtttgaagaggtggcggatatcggttctagtgaaaataagttactgaccattgttcaatagaaaaacaaaatgtttcctaatagcaaaaaatgagatgataattttcgttactagtgcaaatgaaagttatttgtatacaaaaatataatactcttgaaaatgatgattcttctagatctaagaatgtttgttttgatccaaccaacggtatatgtacatacaatatctacttaatttacatattatcagcgaagaaattgggggtacaattaattataccctcgtgtcctagagggtgggctcgtcccatgcggcacaacttttcttcatgaggacctccattaattgtccatgccctactttatttggatcttccactgcctctttgccgaccgattaacttctcttttccttttctttttcaaatcggaagttaaccgagtactggtcagtacatgtaatttcataaaacagggtaatatagtcaagggtttcactttgatgtcattttcaaccatatctttttttttttgcaaagttgccaaaaaaatatcgaacgtttagtttgttgtcaaatttgctaaatacattagaaatcctgtcaaaattttagcaatattgctatcctgctaaaatttggtaaggtttattttggttacaacctgaacaggccccaaatcattcgcaaatgtcctaagttatttgaggagacggagtgcttgctaatgcacatgtcacttgtgcacacagagtaacctttgggaaaagctcccaattgaatactcgagggattcatgcccaagtggatatatacgatcccaagctgcatcgtaattaatctctatagatatactatatcaaactaccaacgaggccagcccgattgacgaagttgcattataagttggtacttgggactgtataggcattaagaaaggtttcatctggaaggttagaagtaacagatcaatcacaggcatgcattatcttgattagatttgggcaattactatatgcatacttcaagggagataattattaaggacgagagagctacaggaagcaaagtacaagataagaactactgtagtgtattgaaccaattagggaccaaattaggcaatgctcataaaacaaggcaagatttgcatcatagctgtctgtacatcctcctcaacttccatgaaaccgtgagcgccgttgcattgcagggaagcgtaaggctagcagcctaccaaagctaggcagatatattagacgaacgcagagacgatggtgaaatgtgatgatcgatatatgtcgagtgtctctgataaggtaatcgcttattcaaatacgcaaaagttatctaggaaaattatgaaatagagtagaatttgcggtgggtccataaagttagaccgtaatatcactttggtccgcagtctttaaattgctctcatctatatccgtaatctagatttgatgttacaatatatccataacacctttggttgtccacggtagctggaacaaacttgtatagctatagtgcacatagctattcatctatctcttctcaattctcctcctttatattagcacggcggctctaggacgaggtattctgaaggggactaaggtggccagaagtgctctaaaaactgggtgtccactgttagggttggaggaaatttgttgctacagtgtctaagagagagctgaaaagtagcaaaactatggtcagcatggatatccacgtaggcagttcatcatagcaaatcaatatacacctttggatctgttgtgatacattaagcctgggttgggatgtagacaagcaatttataataatttacaagattatatctcagtccaactttaagatatataagggccgcatgaacttttataatattaccgaccatgaacttttaactatcatatataagtgcaccgcgtgacaactcaactataatatgatcttgtttcaggagttgtatggtttccttttttttaaaaaaagaacagatcactacgtaattttgtaaattagaaaattaaaaaaattctacgttctaacatatatataagcatttcaatatgttccatagaaaaaaaatctaagataaagagaaaatattttgttttagtcacttcagtcgtaaaaaaattgctttggattttcgtgcatgttggaaaccaatgcttagaattggatatattgtaataccaattttaaatctgagaaatgttaatattttacataggagagtgtaattgatctacggcgtgtgaattaccttggtacttctgattgattctaaatttctattttgttcaattacttcggaacatgggccttcagaactggcccgcacgtgattaccaaatcctttgagaattagcaatatagaacgatatcaacgaaccggcacatcactaaggccgcgttcgatagcgtgagattgaggggattgggtgaaagcagcactgtagtccaccgaataatttattcatcgtgaaatgcagtctagactgtccagtgacaggtgttagacagcagtagacggcgccgtttgctactgcacagatgccattcatttgggcttaggtagctgtagcgtctttttttttctacttgcaagatgatagatatttttgctgtgtcaaatagtagttacagcgttctattaaaagtagtgacgacaaatgcagaaaaaaaaatattgcaatttgacatatgggaaaaaattgttggaaaaataaaatatactccctccgttttttaatagatgacgccgttgactttttctcacatgtttgaccattcgtcttattcaaaaaatttacataattataatttattttgtgatgagttgttatatcactcataatactttaagtgtgatttatatcttatacatttgcataaaatttttgaataagatgaatggttaaacatgtgagaaaaagtcaacggcgttatctattaaaaaacggaggtagtagcaatttgagcaaagtaatgaaaaaaattattgaatacgagttggcacagtccaaagacttgaatgcagtacataatacatatatccatcacgaaatggatttcttattaaatcgtacatctaataaaaagctcgtacactgtacaggagatagttcatgtacttctacaggttctccaccgaattggcaatggcatcacggtatgcgttcatcgcttgtgcgctattgccggcgtaatacatattggagaaggggggtgccattggtgctataggattaccattatacagagggttattggcctggaagtcattttgcttgctgtcgattcggaagttgtgcaaacaaaacgctgccaatattatgtcgctctggacattcttgtatgggttgtacggtatgccttttaagattttccactgttttttcacaattccaaattgcctctcaattatattacgtagcttggcatgtatgtagttgaacttctcttcccttccttctggcggtggagcgtgtggccccttgaattgatccttgtggtaccgtacacgtgggtacggtgccaggaagcccatcctactcggatatccggagtcaacaagaagatattttcctacaaaataataaggaagttatacatgaaaactatcagtgcacaattaatgaagtgctatatggtgtacaaatgtagtacttacgaaaaggtagtcttggaaactcctctggataagagtcaatagcttcgtttaggactcgattgtcatgcactgatcctggccatccggcatcggcaaatataactctaccatcgaatccaacaattgttaggacattttttgttgtctcgtcatggcgattcatgtgttctatggcactatccacaccaacagtgaccggaatgtgtgtgccgtcaacagcacctacagcaaactggaatggtccaaaacgactatcttgtagtaggcgacgagggatgtccgtaaaattcggatcaattggcttgagtattttcgaccctaacataaccattcggctaagaacccttcgaaaatagatagacaccgtcgagttcgaccggacccaacgattgttcgactcccttgcagaattatttcctgccattgtgaacaagaagattcctagtgcctccaaagaacttacatcattactcccatgcaggttgtaaggggcattttccaaaattacatgtagagtgtatatctgatattccgttaaacggaaaatcgcacggcactgtgcagaattcgccattgtctctagcatccaagttattccaaattgggttgggacacgatgaggagctcttggaggagcagctaaaatctcttgcatcattgcaataatagtgtcatccttatcgctcgtgtattgcccttcagtaccatacgaactccacgatgaaccgtcgctcattgtgtgattccttcgaaacaagaaaaatatttagcttacattaaccattacaacattatttgtaaaaaaatgcacgcatggtgttcaataaaaaaattaactgcataaaaaatttcacagtgacataccacaagtaccagttcagactacaagcattagaaatgagtaaagcagatgctaaaaatcatacaacaagatgctaaaatcatacaacaagagggtacaaatcatacaagaaaaaaacagttaagcagatgctaaaatcctactgcaaacagtatggtgagcattattttttatgcctctcatatgaatctcctcctctcagtgagctccaagcaactgaccaagcaagagcaactcaatagaacccattaccatctacgctaccaggacccccacctccaccagggccacccccctaccaacctccaaaccctgtatgacctcctgaacaagttggcgggggtactcctccaccataaccctgctggccagttggcgggggtgctcctacaccataacactgctgcccagttcctccttcgtatccaggctgtccacctccttggccaccagctccttttccgccaaattgcttttgccatgtctgtactatgtaatgggaccgtgactcgggtgtagggcagtaatcaatgaaccattgacgccaataagcacgctcaaatacatccagtgccataaagaataaatcactccctgggttatgtccatcagctaccaccaactggatgcaagctgctgcacttctagccctgtcctcttccaccttccgggaacggctctccatcaactccactcgcaaatcagctagccggtgcagggcatcaccggctgagtcacttcgactcttctttgaagccgatcccctcgaagtgccagcttcatctgctagcctcttgccttttcctgcacttgaaactcctggagtcgcaatgttttgttgttgagctagcagctgtgagatattgatgttgggccttggagttggctgctgaggaggtgctggtgctgcgcctgcaacagcagagtggttccctaccactgtgcgccccgaaaaaatagcacagtgaaggtcgatgtgcttgagaggggaatctttgaagacacgagctccgtcctttttctgcaaaaatggttgagtaacaaaataaatttacattgaaatgaacataagtagtttcttaaatcgattttcatttttgcattttgttgacgctttttgaactaaaaaagcagcagcatacaagtacataactaatgtacgcagtaacatagctattattggtggcaccatgttttaacatctgcagactgcaggtaacattttacctagattttacggtctaactaattcaagaaaatggaggaagtactatatgatattgatatgcattgacaataatagcagatgatgagcagactaaaaatcaaaaaactttatgccatgtaagcaatgtgacatgtcacatagaggttgatgtcatgtcaaactatggcatcaacaatagcataggaataccaaatatctcaagatatggctcagttttgttgaaaagacctacaagagaataataaaaatagtaccaaccatgcatttgctgcttcctaatcaatttattggaaggtagtgaatagaacagagaaattgtacccccattcattatagcaaaaaaattacattctgattttgtagcctagaaacacaaggttttacaaaggtacataacactttctatgaacaatatgtatgattatacctaaaaatagataactgtggagatttcatgaactaaacaaatgtcatgggtccttgtgttaatgcaaatcagtatggaaatcactatcttcctagttcgaccgaacacaacataagggtaggtgacatacctggtccttgtcttcccaccaatcgtcgtcagcaacaatggcttgagttatcgggtcacggccaatgccggtagcctttgattccagccacgtccaaagcatccaccttttacgacattgacgccatatgtacttcacttgatccttggtgaggtttcttccgattctctccttcatcttctgtatgaggttcttgtagccttgcggctttggacaagtggatgttatggtcattgcggacaactcctccaagcatgcctcaagaaatatgccaatttcatcgtcgctccatcggattttaccctccgccatctaccacccaatgttaacaaagcacaaatgcaatggatcaaaaacaaattacaatgggcattaccttttgtggcgagatgggccggatcaggtccaaatcgagggaccgaacaaccgtcgccggcaacacacgacggacgaaagagcgaacgccttctggggaggtcgcacaaacggctgttaggaagcgggcggccacattgatgtcattgtcacaaggaggggcagagctggcgtcagatttgccagaggcgctcgaccccgtccccgaatccagattgatgagcagtccgtgaggagccggtgcggcgaacgccaaaggcacagcctaccccttggctgcagtcgacggatggatgtcctcccctctcttccactttgttcccctggtgcccattgtccacccggagaaggaggcctcaaataggaggccggaggcgagaagaaagcttccaactctgccgaatcttgacgacactgtgacacccgagagcactccaccgagtacagccgcatgcggccaaagctgcagagcctgatgagcagctaggtgacgcagacaacaccggcagcgctccccgacttccgcctggcttgatggcagctccgccagagaatcccctttctccggcctcgattcgccttttcagcagctcccgtgacgagtggtcgatttctccgtgtgcctaacagccccaggctgaccacgacgaccaccggacgaggctcagcagtagggcacaacgattccagccacgacgactgcgcgtggagccgtcgacgaccgagaaaatttggcgaaggaagaaggggatcgatgggagagagagagagcgagcatggctgcttgcgctggtggtgggttggggacggatgggccgacgaatcgatccatccaaatgccgtctgtgccgtttgtacaggtgccacgtttagtcaccaacgccatttaatatgcagtaaattattcagacatatacagtgctgaacagtgcacaattcaccaaatcccctcgatctctcgctatcgaacgcggcctaagttcacacatcctatacacataaatttccttgcacatgattaatgcacaccaactaagaaatatcgtaaaaaattctagaaaaagtacaaataatacggaaactcaggactgcgtttaaaatgggatggagttagcactttgctaattagttgctccttacctagcatagttattggtatttatctctttcatcaaaagccgtaagtagttaatattactatttcttatcccaccaaaacttcccccctaagctcctgggtaacggcgagcttgtctgttatagctagtagcgaagcaagggtgcaacaaaatcaagataaaaatctataacaatttaccagctattggggagataaagtacaatcgtacaacatattaatgttatcgttagttacaaattattgcaagttgcagcatgggtcagtttctagaaggtatagtaggaatttcacttcaaattttgtattatatattttctaggaactgttttagctcttatcggaacttggatatatattatgtgtggcaagaatagttagaaataggaatatatagggtgtatatatattgtgaaataagatcagaattcaagattaaatatgttgaagttaaaataccttcaatttctttatccttatccccaactttcattctaatcctaatgacagactctttgatattacataaatactagctagagtaattaatttaatttaactgatgtgctgtgatgaaggtgctgttcaatcccatgcatcaggttggatccgcccctagtttctcactatcaccattcgaggtagatacctcctagggtaccggatctaggctagaagccctagagaatattcataagattattaatttgtaatggagaacaaagtatggaatataccctagaatatacactcatataatatatactgtagctaattacttccacttgcctaaaaaaatatctctatttatacaaacatcttagtgttagagttagttaattcattatctagaaaaaaagagttagttcattcattgccatatagatgaagatgatagacgattataaatgaattgaacgttacaaagttgaaaatttacaatgttaaaaaggttaaataagaaatgatggtgaagaaagttacggaaagatcgcaataatctattacatatcccagacatcgtccgcggatccctatttgaagactttttaattcctctaaaaaaactatgcgtatgtgtacatatctattttttcaacatacaatataatcacagtattaatttactcaagagccactttagatttaagtgtataatcctatttatcgtcgtaaacacggggaacaaaacatgacacgtatgggataattggcatctaagattaatcgtttaatttcataactgaactagtgttttaattttttttttgaattaaactagtgttttaattaagatgggtcgtctagagatttggttttataggaatctttttttccatgtagtcatgtattatccgtttcaacatataagtatttactagaaaaatacccgtgcattgcgacgggtaaatactgttttaattttattattgttatacagtttagttatggtaaaattcactgtgggaattcgtttcgatttatttttaaaaaatcatgagctgcagttaggagtccgacttttcatctcaagttagtaggtggagttttctaaagagatttcttatatgactgattttgtatttttaaaagcaaacgagcttaaaatcgaattcaaacacgcatatatattttcccaaagcaaatgatcttaaaagccggcttaaacacggatgacataccaaaataacgacaaaaacatattcaaattttacaatagtcactactggagaaccccacaatactcccggttcgcaaccctctcttttcctgggtatgcaaccagatactcaatctttagttccggttaaaataaacgagactaaagatatatagatctttagtgctggtttgtgggctaaatgtttttctattgtttttttctgtttgcatattgattttaagccaaactcatcacaaatcgtagatcacaaattaattcacatatcaaaataacaacacaaattcacatttcattgacatcacaaaatcacatactcaataaaattcacagattcatacacaacatcaccacacatcgcagattcacataaacaacaacaaaaaaaaaaacaagcgctgggagggagacgagctgtcaccgcccgcggctgcctaggtagccgcggccctctgcccggccgtaattgccgcggctcttcgaggccgccgcctcccgccgccacccacagctaccccttgtgccaccctcgtgccgccgccgccgccgcccctcgtgcgggcccacgtgaggccgccgcccagccgcctgtcgcggggccggctcactccgctgccgcccgccggaaggggaggggaggagggggaagagagggggccggatctgaggagaagaggaggagaaaagagataaggtgttgaagggatcgagacgagggattatatcggagagaaagaaggctgccaggaagtgcgccgatcagggttgattttaatttccggttgtttaacaactgggactaaatatagatctttagtcccgattggtagcaccctcttcctgcggcaggctgcatccaagatgacgacagtgactgccccaatccctctcgggtgcggtgggcggtgaggcggacgacggtggaggtagcggcagtggtgacaacattgactcgggagctagggtttctacgggttgtgggctagggtttcgatcggtttggagttctgaattttttaagtgggtgcatgcaggccgcctagccacatgcatgtccatctgaaaattgatttctgtactagtgaagtattaaaaatttgataaatcgatttatttgatttatttttaatatatatatatatataatatttctttaaaagaacaaaccttttatcggtttgagaggtgtgttcataataaacaagcgaatcacaaaatccaaactcaggttatagtaagtacgtaccgtaccatgagttgtcctgctgtgcatataaaactgccatgactctaaacaatttcccaacaaaaacggcttataaaagcacgtaggctctctatatatagccgatcagcttccagctcttcatcccagcttgcatcgttaccaattccaccttcactcgaccactccaacaaaacatggacatctctcacctcctcctacgcttcttcctcctcctcctcctcctcctcctcgccttctcgctcgacgatgctccccatcaccattgcactgaagctgcagcaacaactcttcctccaccaccaccaccaccattctccttcaaattcgacttctccaacacctacacctaccgcctagaagacctccgattcgagggcacggccgccgtgcacggcgccaccgtcgacctcacctgcaacgtcgcccagtgcacgacggggcgcatgtcctacggccgcgctgtgccactctgggacagagccaccaacgaggtggccagcttcgccaccgagttcgccttcaagatcgtcaccccggacaacgtggccaggggagacggcatggccttcttcctctccagctacccctcacgcgtcccccccaaccccagcggccagagcttcggcctcatcgccggcgacgccgaccacgccggcgacggcccggaccggttcatcgccgtcgagttcgacacatacgatgacaccttcgaacggccgaggccggccggagaccacatcggcatcgatgtcagcagcgtcgccgactcgattaacacgacgagcttgaacttcagcaggaacggggccatgagggcgtccatcaccttcgacaatgtcaccaggatgctggtcgccaccgtgcagtttactgatcagactactgcttcgcgtgctgcccctgttcaggtgagtgcgaaacttggagatcccagggcgttgctgccatcggaggtggccgtgggattttctacggcgaacggcgcaacattccagctcgatcagatactgtcatggtcgttcaactccactcttgcgtctccacatcccgtaaccaaaggtaagcaacagcgactctctccataccaaaatatataagaagttttagaattggatacggttattaagaataggcatagaattaaacgggaagatgttgtgattggttgagaagtagaggtaagtgagaaaaataaatgttggagggttctgattggttgggaagagaatgctgatggaaaaattgttatattttgggacggatgaagtataactttgaatagtttcagttttatttttgggtaaaaaagaaagtcgacatgttcttttctgccaagaaaatattttttattttccaaaatctggaaaactaacgaattcgtgaatttcaaatatcttcattcaaaaattcacaaatacttttagctatagtaagatttagaacagatagcacatttatttggtatatatacagcttgttttttatcccgttaaatttgttgttgattaatccgcggttacatgcattatgcctaggtgtgttagcggcattgatatttgtgatcacttgcatccatgttcattttccacgtgatgtgccggtatattgggaatctattcagctcaggattatttttttattgatgcaatttgcactgatattgatgcacatgcaaatgcaagtcattattccattccaaattacacacgctttcgtggcttatccatatttttctgcattttgctcctactatagaaaccacatgttttacagatggctagatataaacaaaaggaaaatgccacattctttagttacgaatgcaacacttttttccaatggccaaatgccttttttttcttagttatctttatttatttcctatggagaatgtaagggtagaattgacattttaaatgttgaatttgcatatgcaggtgatgtggcatgtacacgtggcatttagcctttgcatctgaccgaacaccattaattgttgcatttatgtatgcagcctttggaaatcaatttccacgcatcgagtttttctatacaaaagaggggaaaataatttgtatattcaaatgattttgtgtgaaatacatgtgcgtacagcgtattcaaacccagaacctccggttgcccgcgtagcctccatagcatctgacctacaaaagcacttcctacttcaatggacatgctacctggtcacatagaaaaaatatcatcaacaaaaaaaaatatggatctcgtcaaagtctacaacttttatgtataacactgtgtccatctaaggtagtttaaaactctcttaaaaatcagtgatccaaatagatatgaaactgctaacgtaatttggagtatgtaattgatctataatttttaatataaagtttttatttatccgatttcatagaaaaaattatgtaaaaaatgcacgtatgagtggaatcattttcagagagacacagtcactcaaaacaactgtcccaacaaataaggctatatttattcattttcaaagagaagaacttaaaacaaccgtatctgagagtcaattttcatcttaatagagtcaattttaaaggtcttccatgaccgcgggcccctgacatagtgcatagtagtgtaacaaaagagtcgacccacttcaaaaaatagttatttttgttggtgtgcatgaaccgattattggcacatgctggacttaggaataaccagtccccatttttaaatccatagggcgactccccatcattgaatatggtctcaccgatcacttatccattttatatctctcctcctatggacctacatctttcaatattcctagcattgaggtcaaattatatagctacaaagcaaattcattttgcacctcatgttattatcatttattttcaataacgcacatctagctaattactaataaatacctgtaaatctgttatcatggcaccatggatatgcaggtcatcacaaaaagaaaggggcagcaggaaagtttgcgattgttggagctcccatatttttgcttctggtgtggtctatcctatcatggtggaaatggagaagctcaagccgcgacattgacaagagaactggaggtgttaggcagttcaagtacaacgagttggctgctgcaacgaatcagttctcctctgagaataggctgattggagctggtccgttcggtgaaggctacaagggtttcttcaaggaaatgggccgtcatgttgcgattaagaagatttcgaaggagagcagatcagaaggaagtaataaggacttctatgacgaagtgaaaaccatcagcagtgcaaagcacaagaatctcgttgaacttgtcggttggtgcgtgaagcgtagatggaacatgtttgatttcatgtgctggtgtagggagaaggcccataccattttcttggtgtatgaatttgtggataacagtaacctccgtgttcacctgcacgagaaggaggctgtgcttccatggacaacgaggtacctgtacatctacttgatgagcgatgctgtttaatttcctttttgaaacatggaagtaaataattaaagtggtatcaaaattaagtctttaacatgagatattttacgttgcttgagaaagtacacttaaaattttggtacgtcgagatactaataggtaccaagttttaaactagaaaatttggtacgatcccggtgtcttcttaaggttgtaaaattgtctctttaatttaacatattgtctatgcatgtatcatctgtcaggtataaaatagtgaaggacatttgcgcagctctggttcacctccaccatgaaagacgtccattcgtccttcacagaaatatcaaaccaaacaacatactcctggacaaagagttcaacgccaagctagcagacttcgggctgtccagaactgctgacaaggtaggcaaggccagatacctggatccagaatgcaaaaagacgggaaagttcaagcgcagctcggatgtctacagctttgggattgttctgctagagattgcgtgcaagaaggatgaaaatagctttgcgaaagtgtggagccggtatctagagaagtctctgatgcaggtagctgatgacaggttaagaggtgagtttgatgagaggcagatggagcgtgtcatcatcttggggttatggtgttgtcagcccaatattgacatgcggcctaccgtgcaacaagcaatggatttcctggagagtgatgggccattgcctgaattggctgaaccggagacctcctcaagtaaaattggtaactaagagtagtattagtcctgctctaccagcaggatcaggcgaagaactgctggacttagttaataaatgcttggattaatacgagcataattttttattgttgtgattcctgcaagttattgtatcttctacatccatttatgtttctaatcagttgtgtcattgcctacttcgctttgagatttggatagatagcagcattttgggtaaactatgaaataagcccgcccacatactccccactactgtgctctatttatattaccaccctagttagtggtaggataaatgtggagggatattattttttaaaaaatggtctggagaggtataagcatcatttagcaatgaccaagctttcactactacagaaagggtaaaaggtgccggtcgaaaccctagctaataagtgccggttttccgaaccggcattaaggaggcgttttgacctaaaaaccggtacctatatggtttaaataggtgccagttctaagccagattgcaacgtaactgttaaataggtgccggtttttagtttaaaaccggcaccaatacggtcctaataggcgtcggttcaagcctaaaaactggcacctatttattgggtcaaaaaaattatagtaaattcatccacacaaccccaattccatataaacccaaatttatccccacagccccacatccatacagcacattcattcacattcacattcatcaacacaaataaaaacctacgagccattaatcacaacatataaaaacctacaagcctaagtcaaaattcgaaagtccaaaatttcctatctttaaatcctaaacatttgcatatataacctaactcaaaatatacctagtttaaaattcctaagtcaaaagattgtaagtctaaaatttttaagtccaaaaaattctaagtctaaattgtgaacattaatttgcacatatatccttaggtcagaaattcaaaagtctaaaattcatcagtccagaaaagtataagtgtaaattctagacatttccatataatttacattcatatcctcgagtaaagagcaaaagagatattgctgggactcagcgtgccagtcaactttagcctgagacgtgcccgtcaaaccacacgaaggcagcgaccggatgtgttacacatcccaggagacttgactaaatcgctagagctctataacatctcaaatgctttaaacatttacatatatatcgtaactgaaaaattcctaggtctagaatatctaagaattcataagtgcaaaaatataaacgtgattgttttttacctccaacatggggtgagcatatgattttaaaagtttcttgtcctcaagtcatcgagcctataatagaaagcataaaatagaatccataataatagtaaatattgaaatgcattacacataaagtacacttccatagttcattcataaagactaattaaatacattttttcacataaatctagctagttggtttttcttttcctaggagttaatttcttcgtggcttggtcccgagggggagggacagaagattgcactcgttgtgggaccttgtcgatgttgtattcgccacttttgccctgaaaaaactttgaactcatttttttaaaactttcacctaaacttaataaacattcatatcaaatttaataaaaccttcaactcgattttttgaaattttcagctcaaattttatgaaattttcaactcgattgtttagaatctgagcttgtttagaatctaaaacagaaacttcataggatggtaaatagcaaccaaaatggacaaaataaaattacacaaaatttatcttagatgccacttggtttaccatactagacttgccattttcctatgacgggaactcagcgaccacttcaaaataaactggagcgtctgaactgccggagtctaaacgacaaacaaggcacacaataaatacaagctataaagctactaaaacagcaaaacaaaccaattttaatggattcttggcattttaacgaattcactgcaatttgaatgggttaaaacggagcgcagattatttagttatgaattttacaagatactttgtgttattactaataacaaaaaaccttagttaatttacagagattagagcccaaaaggaatgtaggatcaaaggatagattgactggcaaacgagcctcacgagatacggactcaacaagtcacttccacgtgacacgggatcacccaaatcatcaactgagaccggcgagcggaatcggtggctctaaacggctctaacttaaggacgattcgggatggacgaacgaacgaaccacaggggacaccttgttcgaacgaacgagcggacgactcaacaacgactgcacgctagacacgattcacgataaagcctcggtacggcaaacaataggctggtaagaacctagggttgcaccgacggctaggcaactcaactacggagctacggctaaagcggcggctaggcaaagacgcacggcggaggcatggcacgtggcgcaacggcagcggctcggcagcagcggaggctaggcggctcttctcggtggcggcagcggcccagcatggcggcgataggagcggcggtgcggcggcggcacttggcagcaacgcagcacaacggctagggagcggcagcggctagggcacggcaatggctcggctagggcgcaacagctgcgacgcagctactatgacacacgggaaccaaataccaacaggagggagcttctcaccggggtgcaaaaccggcgagggaacacgacgacggcggcggtggtctggcagcaagcacaagatcgatgacggtgcggcgctagagaggacacaacgggctaggttagacagcgagacaatcgacattgggtttaaccaattcaattgagagggataatggattactggcgacgcgagggcgacgacggcgacggtggcggcgcgacagctagggcagcagtggtgatggcgcgctagggcggcggtggcacctagctaggacggcggcggcggcgggctagggcggcgcggcagctaggggaggaaaatgaaagaaaacagtgagggaacacttaaataggggaggactagattaggaaaggaggagtcctagagggagttggactagaaggaggggagggagaccgactcgggcaaggggagggaaggcgtgcgtggcatgacgtgggagagggtgcggccggctgggggaggggaaggaaaaaaggaaactaggggagactaggactttcccaaaaaggaaaaacaatccggtgctgttttaggaaaagaaaggaaacagtcctgcgaactgacactgatacggttcgtcatgcaaaacgaaactgcggactgagagggaagtgaattgtgcacaactcacgaccaaaggcaaaggaaggaaattattatcttgacacttttaacttagcaacattgcctccagtgatcgaatatttactctttaagtcctgttagtgattttcagagtaaagagaattcgaagaaaattctctctggcaattccgattattaaatgcattgttaactggggttttctcttggttaacccaagcaaattcttgaagtcattttttagcgatttggaacctaagggaagggaaaactccaggtgtgacacgacggctagggtttgacgacgtaggaaaatagaaaaaaggagggggtatgatgacttatataggtggaggtggagttggattaggttagggtgggttcggcggtaatgcgcgcaaagagagggagggcgcggcggcttcggcagccaagtaggagagggtgcgggcgcgcaggccaagagggagagggggaaagaattatggtgggagggggaatccaaataggaaatgagagggaaacggtgccatttcgggaaaggaaaagaattaggagtcatcttgtcataaaaaacgaaaccgcggcgacaaaggggttggcggatacgaggaaccgcgaacgaggagagtgaatcgggaatgattcacgaccaaaggaaagagagaggaaacaattttgaattcaaatcctggcatttttctttaagttaacattattacttcctctgctctgactattccttttaaagtcctgctattgatttaaagcaaaaataatttgaaaaaaatactccctgactattctaattattaaccgtattgttaattagggttttcctcctggttaaacatagtgttttctatagacgatttgtcaatgatttagaaactttctccctaactattccaattatattgttaattagggtattcctcctgactgtattgctaattagggttttcctcctggttaattaaacatagtgttttctatagacgatttgtcaatgatttagaaaaactttctccctgactattccaattatattgctaattagggtttcctcctggttaaacatagcgtgatttgtcaatgatttagaaaaactttctccctgactattccaattatattgctaattagggttttcctcctggttaaacatagtgttttctatagacgatttctcctagttaaacatagtgttttctatagatgatttctcctggttaaacatagtgttttctatagacgatttatcaatgatttagaaactacggaaaagggaaaaactccgagtgtgaccttttgacacgtgtgacgtgcacacgcgcctcacgatgcgaggccggagagcgcccgcttgtgttccctttgttctcttcatctcatctcagatgcctgaagtggccaagagacaatcctcccttataaggaggtctctatctcctagaatagccaatgtggtactaaagtcatcatgcatgccatcctataatgtaggattttgtgatttttcgaacaattaatcgttgaatgtactaaggcacatccattaattccaacattagaaacgtagcaatacctccattttcataaaaagtaaaacttctactttgatcgaaatgaaaaaaaaatccatttgcttcatcgaatcagccgaaattgcatgtttccatgttggaatttcttagtttggactttaccctattatattttttacgttttttactctttttgagtttttcgtttctttgtttcgaacagggcctaatgactagagaaccaaatagtctaacacactacatccatcttaaaatatagttcatccatcacaaaataattaaacctattatgagatgtgacacgaagactacaaatctagacaaagccctccgttctggtttaatactaatttgtatcattatattagatttgtttatatggcatcgaaagaaaaagatttgtttatatgggatagagggagtaagatataagggagtactcttatactactcgtcccaaactatagcaacctaaaaccagataagatatattctactattataaatctggacatggacatgttcagaatcctagtagtaaaatatgtcaattaagttttagtaattgtttagaggaagtatatattttaatcagagattgaaatttcggtttgaaaattttgaaatttcggtaatttcggacccccacggcatgacaatatctcagcagaaatttttggtttttctcaattttttgtgaatttagtcaaaatttagtcaaattcagttaaattatgtcaaattttcagaaaatttcggccgaaaaattactgatattttggaaatttcagttctactggaatggcgagaatttgagccaaaatcgaaattgaaaaccctgattttaataaggaagttaatactatgttggtactcaattatattcatggggtgggcacacaggacgtacggtgtgcacctggcggcagaacagcccattaatgggcttgtttactggctttcttctctttgtgggctcgaccatgtcgcttgtgtggaattgaagcgtacaacaaattcctctgtactaatataaactcatttatatatataggaataggacagaacccactataaaaaatcttacttaagaaatgaatgtaactctccaagcgattatttcctatattttccccactttttcaatcatctgttttatgcatgcaattcatattaatttctatatttccttattcctgtgtttgcattttttgcgttctaaagaagcccttgatctcttcaaaagtacagtttcttatatttttccatcgagggaggaccaatcatgcatgtctaggttttgagctggcattattcatctatatgtacactagagaatcggtccaaaactccaaattaaagcttccaatcaatttgcgtcactgtgtcatagtcacttataaatgcatatacatgttatgagactagcatattgttgaatcaatagttgatggcaggtgcagattagatggagctgtttggtgaaactgctgacaggtgcagcttctatcagaatgttcagattccaatttatcatccacaaatctattatataaaaatccatcaaactttatataaacactcctaaaacgtcacgtagtacatttaacaacgcttctaaaccatcacttggtaacattataataagtcggcccattgttttttcctaaaaaaaaaccgatgatccactattaatatctatagatgtcataggttgaattggttaatatagcaattctttgaaccatgattaaatatttgtgcatatctgtgcaaatatgtgaaatttccatttttactatacctgcatgatttgcacagagatgtttccatataagtttgcatgcatctactttccaaattatatgtacataatcaaatccactaatttcggtgtaattgctttattctattcttcgtgtatatatatatgggcagcgatgacattccattttttacacactctagtttcatctgtccgttctgttacactccggatgtcgaccacgagattcgatgcaaccactcgtccatgagcatcattgttgacaacggtcatccgtgaccttcatcgcaactagtccttcacaatattcgtcccgatgccattgtcccaccggacgtgcccgagcttcttcgtcgcgggctgctggtcgtctgcgagatctgtggatgacattgttcgtccacgagcttcattgccacagtcaggccaccacaatcttcgtagtcaagctgttacgccaccagacatccaagagtttcttcgttgccaccactggtcatctatgagcttaatttgccgcagccactggttgtcgcgaccttctcgtcctcaagctcgttagtcggcccaatacattgttggttttgttcatggcttgggattgttttttcaaacccaaaatttgggtatacatactgttccaaagttcgattcaaattttgttaggttcgttaagatctaattcacttccaaaagtattttccatgcatcagaattacttttgggttcatgcccaatatttggatatatgcacatattcacgcgcaaaattgggtatatacaaaatacttgactatatacccaatatttgagtatatacccaatatttggttatatgtacagttctaaatttacacgtaaattgggtatatactgaatatttaagaatatacccaatatttgggtatatgtacggttctaaacttacacgtaaattgggtacatacccagttttacatgctttttttccgtttccacctaattccaaaaaaaaaaaccacgcatgtataaatgcgccaaaatgtgtgccccaaaaatcacgggtgtggtgtactttttgtctgtaagattgaaagtgagccgtactacagtaataccaaaactaatgacattataaacgataaaattagctacatctacattaccatatattcagctgcaaaatatatatacacaaataacatatttccaaatacttagtttctatgtcgccaaatactgagtttcaatattccaaaatacttcgtttctaaaatttgtttatatttttccaaataattattttccatattccaaaatgcgacattttccatgatgttagagatatataaccatttattcaaacgcgtacgtgagttttcatatttacatgatattattaccaattacatggacatgcaagatttccattctgaactttaaacacacatatggaaagtctagtaaatgggtttacacctgttaagataactaggaaggtagcccgcgcatatgcgcgtgcatcttatttaatgtacgtaaaattttatacgaatatccatgtgtggatgactttgtcttaaaatattcttttactatatctaaacaaaaaaaaagaacttgctagttataatttttcatatttacatgatattattaccaattacatgcacataaattctaaactaaaattactcgagagagtacacttctcaatttatgagaaagtattatgtcgaaacaatatatgtagttcctatgagataattttgggtattttgatttcctacagagataacttacccccaaacatttgctcacaatatccatttttttttgttagatgctatttgaagttttacatattttcattccattaccgctgctaaaagtttgaatatttctatttagaatgggtttttaaaccatttcaaaaaaaacagataaattttgtttgttttcatgtccattttttaaagaaatttggagaattccattctatgaagcatctttgaaatcttttgatctctgcaatttaggttgaaaacataagtgggttgagcctacaacttgacatggggtaaagtcatctcttctaaattatctcacttcaatagagtaagaaatattaaaatagaggtcatgtaataaatacacatttctagattgttctatactaaatgttaggagtttacaatgtagcgtagcaagtactaccaaaatgaaataaatgacatgatttttaattcctatatggaagtgactcattatattggtaaggccacctcatcattgtttcactactaagattctttgttgcaacccacatgcttatatgatcaatatgatgttcaacttagcatgtttttattttcattatgttgtctataaaaaaataactctagatggggtacacattatgactaaaaacaatatcatttaaagtttttctctaatttagtagtgacttcatagatcatatacataatttagatgctatgatcatctaaagattatttatttatctcctaagtggatcatttattgataaaaagctcaaatatcaaattgtatgggcaaatagcccccatatacatgttgagagaatttaattaagttgatagaaagttgttaggtgtccaactagatataactaatgggtgtaccagctttattaaaaattaaggtgggatatttcaattttcaatgacgaattttaatatcttctttatttagtgttggcctcaagatggatgtaggtctgcaatgtaatttttatgttggcatttaaatatggtcaatatgaatatgaaagtattgatttcactaaaaatataatagttcaaacagatcgtaagttgaatttatgatttgaaaagttataattattttaatttatgttgttccaagttatagtaagagaagaaagagaagaacagtgcgatacctggctagaccatatatgtggaaggttcatttatggtttttttctccataaagataattttaattttagttatcataaataaagataaaaataggagaaaaggaataacacacaccggacggggacagaccggaagggagggggtgtttttttataaaaaaaatgattgatctaacaacttaaaataatgtgttttgatgtttaagtcgaaaccaatggtcggatgttttgttttttctctcataattttgtatgtttttttaaacttaaaagagacccctagtggtttagaaatatttataggatgtttaatgtagttttaagtcttaaacattgtaggggcagggaggaaggaaataaggtttgggagtttttttaaataaaaatctaataacaacctaaatgataatgtctgtttaatatagttttaagtctttaacattgtaggggcagggaggaaggaaatgaggtttgggagttttttaaaataaaaatctaataacaacctaaatgatatgtccatcgatttaagtcgaaaccaatagttggatgttttgtttttaaatttttatgattttctcaaatttagaagtgtcacggggtggtttttaacgttgcatgggaacgcggagggagatttgtgattttttttgaaaagattttattttttttagattttctctaatttaagagtgctatacactccctccgtcccataaaaactcaaattagaatatgatgtgacatccaagaacaacaaatctcgacatatgtttagaaatatttatatgatgttgaataaactatttattaggagagaatatataaagagttggctatatctaataggttgatgggctttttaggcccataaaaaagtatttaattttaattgttttggggattaaaaaaagaaaggaacggtggttggagggatcgtacatatgtgcgcaccaaggctgacgtccggactccggacatagattttttttccttcgattgaagataaatctaactatcaaaattaatgagtccacctatttaaatgaaaatcaatggtcatatttttactattttattaaagtgacacatggtgactcgagagcgtttataagatgtcacatggcagtttaggagcgtttgaagaaagtttaatggacttttaatatataataagagttgtacctcacatgatcacaccgatcctgtggctcgcaaccaatgagctccacatacacgcacttgtgtttctctatgtatgtatgtatgtaaacactataccgcacccagggtatattttagaaaaacgctccataatgtctttgttcctaaggacgcttaagctgggtttgggaggtggagttaggaactccacctacccgcacgggaaacaatgttgctcattaacacatgattaa

SEQ ID NO: 43787 - DNA, 8598 bp, Oryza sativa
aaaagtatacgcgaggaaaaagagagaggtgagataggaaaggaggaacaacataaccttaggagagcgggggcctctgtcaaacagtacaactaggtaggccatgcggtacatggccatggacatcaacctcctcacttgcaagttgcaactaggtaggccacgagacaagttgcagagcatgagttgttgcagcaatcaatcttttatagtatatatatactccctccgtccaaaaaaagacaaaccctggtttccgtgtccaatgtttgaccgtccgtcttatttgaaaaaattatgaaaaaaattaaaaagataagtcacgcataaagtattcatcatgttttatcatctaacaataatgaaaatactaattataaaaaaattacatataagacggacagtcaaacgttggcacgcaaacccgtggtttgccttttttttgacggagggagtatgtgtgcaacacccttacaagtaggaggtaatgtcgatgatgggggcatgatgtttacaggagacctgttttgctatcaagagagaatcaagtggatggaggttttacacgataagaaatggaagtgcattcatggtactacacctgtactacgtactccctcggtcccaaaatatttgcttcatccttaataccacaatggtaggtcaaatttgggatgatgggagtatagaagatagagcacgccgagcgagccggcattacttttagccgatcgacttttattattttcttccttttagattagttttatccgataatgctattattagtagcctgaatatatcaaaacatggcagcaatgattgctcaaaaaatatgacaatatttaataatttagttcttgagattaacaaatggcacaacccgtattctataatggatattcagacccaacaagagtgttcagcacctagctaaagattagatgtctaagttatcccaagaatcaggtcttttcacgacatgtagaaaattgtttgggcactatcaaatgtttcaacttacttgataaaatgctttagagaaatgtaacatttaaaaaatagtgattgcaacaccaacagccacgtgaaacatcgagtcccaatggttattaacaatacactggtcaaggtcacctgtgacgggcccaaaccctcacctttgatggttttgggcttggtcaatgatcagtggtcactggtaagtccagtcacctttgacgggtggccggccgtcagtggtgacatccacctctgacgggcaagttaatagaaggccgtcagaggtgttggtctaagctagactagggcttgttaggacccgtcacaggtgtctcatctctgacgagcccctaaataaaggcccgtcagaggtgatgatctccggtatatagtaagccgtcacaggtgggtcacctgtgacggtccgacgtttgcgagtccgtcacaggtgaggttacctgtgacggatgtttcttccgaaccgtcactgatgagttaattccagaaaaaaaataaatgctaaatattggctagcctcaggaattgctagccatgccctctgaaaaacagaaacatcacaggtgccagtcaccccccctccatatcacatattccccaactgcccaacatcacagatgcatcacatatcacagatccatcacaaagcaacaatttacaacatcacatatgcaacaatttaatttattatagcacacaattcataccccatgaaagtcctcaaatgattacgaaaatttcttgtattctgttcgttgtgaacctccacaacctgtcaataagggaaaaaaaaaaggagaaaacagatgaatagtacaacataaatcgtagttgatcaaatgtgatgacaatttagtaaagtaccataaatattgcacatatgaaagtaaattacattgcactctataaaaacataattttttacattgctagaaattataaaaacatcttttttacatcacaataaattatctagccaagttcatgagtctatttggcatgaaaacgtcctttcttgttcattatttctgtaagaataaaggcgcacacttcgcctctgatagcgggggggttgatgggtgagatcttgaggccagctctacctttctgtttaataaataagaggttaattagcacgttttgaatatcaatgtagatattgaaatgagcttattcgccattagcaacaacctcagggtcgaaatctttcacctctcttagaagtgttgacatgttgtggcacacgtggaaaccatattggtctccgatctgtcgtgcgcatgcaaacttggtgtcatgataaagttcgttcttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacatgaagggtattgtcctcttactcttggttgtgtgtgcacatgatgtactccttgtcttcatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcaaagaggtcatcaaaacctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcaccaactccccgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgcccaaagtcatgatttcatcatttgagggcacgggcagcggatagcctgaccaggtgttctttactgtatcgatggacaccttggcatacccagctagcagatctgtgccgtggaccttgtctgtaaccgagggcttgaaagccatgccctcagcgacttcaggagcgaaagttgggtggactctcgctagtaggacacactgtgctgcgccctgcataaggtgaaagtttgaatataatattggaatgtgtacatgtcttttattagatatggatcggataacaacaattacctcgatgtggtccactgcagctagtggtgcgatcgggagaccaggggccggcacctctgtggatgcacaactactcctatgctgtgacggactcgtgtcgtgttgtacacgaggagttagttgcacagcaggtgttgtgactcggggtatattcatgtcggcgaggaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatgcttccagggcacatcgctaccaatttcccgagttcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccatccgggttgaccttaccccttgcccgcgcccagttgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtacgcgatgtgcctcgcttgattccctaaactcttgggtggtcttgagagagcagaattcctcccacaccgcttcggttatttgagggtattcatcgaacggcgtatgattgccgggcgggttgacaaactcggtgaagagcttcgacttccaattcttccaagctttgcccatcttttggaatgccttccgcttgagcctatcctttgcttcggttggaaatgtgaaccatttctccattgccgtccaagctcgctctttctcggcttctgtgaccttcccgatatctttatggaggatcccgaagttctcacgtgctgctagcccgcagcagttagaccatcttccaatgacagtcctgggcgccgtgggcctaccactagcgtcaacctctcttataacttgcactatggtcggccatatattttgtgaccgcgaatttctactagacctacttgcacttgtcccgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgctgggcattgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcagctactaggaggaaaaagcaacccaaagaaaatagaacaagtgtagttcatctgttcttatccataaaatagaacaagtgtagttcatctgttcttatccataaagaaaagagcaagtgcaggaaattagagcagtagcaacagcatggccatataatagcagcaataagagcagtagcagggccatataacagcagtaggggtatatatgccacaggggcagcaacagcagggggagattcacataaacagcaacagcagggtggaaattcacataaacagcaacagcagagggaaatttacatagacagcaagggtatataaatcaacaagtgtagataatctgttcttatccataaagaaaagaacaggtatagatagaatgttattaagcaattcatccttggccatttaacaagaagtacaggggcaacaacagcagtggtatataaatcatgcatatattattgtagataaaaaaatgaacaagtgcagaaaatctgttcttatgcataaaaaaagagcaagtgcacaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactcctcttatcaatccagaagaaaagagcaagtgcagaaaatctgttcttatgcataaaaaaagagcaagtgcacaaaatctgttctaatgcataaaaaaagaacaagtgtagaggtatataaccactctacactggccatttaataaggaacaagtgaacaagtgtaggggcaaaaaaataaacaagtgtagataatctgttcttattgagcaattcatcactggccatttaataaggaacacattgggcagcagcagcaagggtatataaatcatcaaagaatgacagaaaacaaaatgcatggagaactttggtgtctaggtcggttccgtcggttcagctaaatataaacatgatccacaaaattcaataggtctagcaacatatatagcagtacacactccatgaatggttatatgtccaaatggcacttaaatccacattcaagttgcacttaactaacagttgcaaccataggcagcagcatgggcaaacatagacagcaagggcaaacatagacagcagcagttgcacttaaatccacattcaagattcacttattgagcaattcatcacttattgagccacaacaggggcaaaaagaagaatagataaaaaaatgaacaagtgtagataatctgttcttattgagcaattcatcactggccatttaacaaggaacacattgggcagcagaagcaggggcaaagatactccacaggggcagcaacaacataaaacaaggaaaaggtgtattaacaagtagcccacaataacagcagtagcaggggtgtagataaaaaaggagacagtactactaacttcatgtaaacagcaattcatccattcaattcaagcaagtctagataataaaacagcccacaatcattgtggcagcagcagcatgggtatataaatcatgtatataaacaacaattcatacaattgacctattcatagacaaaaagggtatataaatcaacaagtttagataatctgcaaagttccttaatcatcaaattatgacagaaaacaaaatgcatggagaattttggtgtctaggtcggttccgtccatggactacactggcctatccaccaaaattccccatgcattttgtattctgtgatggtttgataacctcggaactacattaaatctgcggccaatctatcaattcttcccttgtaactagatttcaaaccctacacctaataaaggtccttaattatcaaagaattatagaaaacaaaatgcattgaaaattttggtgtgtaggtcggttccgtccgtggactacactgaccaaaccaccaaaattccccatgcattttgtattttgtgatggtttgataacccttaactagctagcttaataaactatttctagctagctaccctacctagctagaaacactattgccaatctatcaatccatcctttttcagctaaatataaacatgatccacaaaattcaataggtctagcaaaagggaacaaaacaacatatatagcagtacacactccatgaatggttatatgtccaaatggcacttaaatccacatccaagttgcaaactagctacacattcaagttttaactaacagttgcaaccataggcagcagcatgggcaaacatagacagcaaggggcaagtgtagataataaaatagcccacaataatttatgtggcagcagcagcaggggtatataaatcatgtatataaacaacaattcaactattcatagacaacaagggtatataaatcaataagtgtagataatctgttcttatccataaagaaaagaacatccactgcagcaaaattcatgctaagatcctctattgatgctaagattcactgcaccaaaatcatgtatataaaatctagcccctacattcatccaaaacatccacagacaacaaatcacatttaattcatctatacagcagcaccaataatcgaaacaacaaatcacatttcattcatctaaacaatgcaattcatccatcggaaaaaaggaggaatgggggagggtggcggcatacttggagaagcggcgtacttggagacggcggcgcaggccgtagtcgtcctggatcctggtggcggcggcggagaggcagtggcgaagaggtcgaggcggtcggcggtggtcggggatcccggcgtcggggaggtcagggtcggggaggtcggggaagtcgatggacggacggcggagaggacgaccggcggcgagggcggcggtggaggcagcggcggagagggcggagatggcggcagagagggcagcagagatggcggcggagagggaggaggagaggttgaggcggcgacggcggagatggcggtggagaggacggcggagatggcggcagagagggcagcggagatggcggcggagagggcggaggagaggttgaggcggcgacggtggagatggcggtggagaggacggcggcggtc

SEQ ID NO: 43788 - DNA, 18284 bp, Oryza sativa
  unsure (1)..(18284): unsure at all n locations
gtggcctcacctgtgacgggcgccaaccgtggagccgtcacaggtaagaccacctgtgacgggcccaacactctgggccgtcccaggtgaggtcacctgtgacggccctacagatagagcccgtcacaggtgagtttgcctagaacaattttattttattttatttcacttagttcttttattttccttaacatattttcacatacactacatatttttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaaattcatcttcttcttcctcctcttctagaggtatttcttgacctatgccgtggacgtgctggttgtaatcatcctcgtctgcaatgttgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggactttgaacttcaagtaatctagctccaatattttctcaactttaccatagtattgatcacgacgaccaccgtcactagcagcctcgatgcgtaacccactgttctgcactgtgcatttgctgtcttgctttaccgtgtgaaaggtgtatccatttatgtcatatccttgccaggtggtggcactccattcaggaccctgtgacaaccactgaagtgtttcactagacaagttctgcaacctggcaattcagttcttcagccactcgttgaaagaagacatgtgcttattcctgacccaactctctgatcggcctgggttctcttgtcggataactgcaaggtgttcgtcaacgtacggcaccacctcagtcatatgctgtagtaccgtgaaatgagctttatcgtacaccttccgatccaacctaatagtctttcttccaacagtaccaacaccgtcaagcctcccttcgtgatgagatcgtggtaatccaattgaagatgtttctgacatgtagtccacataaaattcgatggcctcttcggtggtgtaactctcgatgatactcccctcggggtgtgaacggttccgtacataacccttaaggatccctaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctggccaattgcatggaagaaggaacacaaccgctggatcgtgtgtcgcaccttaggaggcaaaatattccttattgcaacgggcaacagctgtgtgataagaacgtggcaatcatgcgacttcattccaatcaacttaagatcttgcagtgaaacgagtctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatccttccagtatggtagtctccaaaatattgacttttttttccacatgctcttctcttttgtcttttgtttttccacatgctcctttgttttttccttcgatgtgctcttctcttttcgctttccaactttcctcttttttccaaactcgttggttattcccatcactaagttgtgcacctctgtccctgttagctctgtcggggttccggctgtatctctgtgtccattgaaattctttctcatattcctatacgggtgataccttgggagaaatctcctgtgacccatgtagaccgtcttgtgtcaatgcttcaaccatttgcttcttgtttcctccatacactccgaacacgcccatttccctttcacagtttggccagaaaggttgccaagggccggataatcgttgatggtacaaaacagcatcgcatggaggttgaaatactcttgtgcatatgcatcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatttgagaattcctggtaaatcctatcgattgtcctccactgtactgaatctgctgggtgcctcagcatagtatcgactttccgttcttcggcatgccagcgtacaagcttagcttgttccttgttcgcaaacattctcttcatgcgctccgcaattgggagataccacaccacctttgctgggcctcccctctttgacttacttccttcaccttcactctttgctcgtttgtatcttgatgccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatgagttccaacacgcatgacaacttgctgtgcttcgacttgcatccatcatacaacggcatctggcaatcttccaccaacttactaaacttctcataatctatgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatctatctacgatccatctgaaatcaacaacatacgaagaaaaataaatcatgatcgatatgttgagaatgaatggagaataatgtgttttttaccttgaattttagcaaaaaatcgccccccttgccctcccaaccgatttgtgaacagtacaatggtcgggatggaaagcagttggcagtttgggggtattttatagacccaacacacctcaaacgggttagataaaaaaaaacccgtcaaaggtattgctcatacctttgacgggcttctattcaacggcccgtcactggtatccgctcacctgtgacgggccagaaatgaaagccgtcacaggtggcggcccatcacctctgacggcttctaatgtatcggcccgtcacaggtgaggggataccagtgacgggttggaagcaaaactcgtcactggtatacctctgacgggttttcctttcggcccgtcacaagtgaggggatacctgtgacggtccgcggccggatggctcaccggtgacgttatcccgtctgacccgtcagaggtaatggtcactagtgaccaaatcgtttgcccgtcacaggtatcccgtcagaggtgtgaggatctggcgtagtgattacattgaaaattgttaaaaaatatatcaaaacatgaaatgtgcaacaaagttttattccaactgaaacatcaaatttcaacatttcaatcatattattttttcatcagaatatcatcatgtgaggtctttttctaaagatttaattggagtaaatacaatagtgcaactggatcctagatcatataagttttttatcagacaagtcatttaatattttccaaagcacttatgcatgcatggacaaaggcgtaggacaagcaataccaacattgagagaagctagcgaccactgcctgatcgatgcaccagcagaggattacgacacgatggtggtcatcacgtgctacacgaccgagatacagagtactattagagagcgtagaccagctcatcaaccgttggttacacaggttatattgggcctgattcaccactggtccgaccaacaccacaactctaggtcctcgaacctacacaacccaaatgagtaggtgataggtgcagaatgccctcatattttgagtcgtgctctcgtatcgtcggttacgactaaaattaacaatctcctccatcaccagcagccctaacaatctcctccgtcacatcaaaccatgtggcctcgaagacttatttcggtctaggcccaacaatctcttttgttgtatcatagcctatgcgacctaggcccttgacttttagcaacatagaactaaacccaatagagaggaaggattggagagttatggtaatggcatttctcctactctccgctcgaagactatggcaccaccgccaccaaatacctttcctgcctccgggcgcaaactttgctagttagatctgctgctgtcggctagccatcattgcatcgctaggtctggatttgcaatcatcatctagtccttatcaccgccctttgaactgatggcattgtggatgagatcggtagctcaagtcatggggcagggaacgaggtcgccggcgtcacattgccattggggaagcgtccaagtgcagaaatctcaatgacatcgggggattattgttgggaccctcagtggaagaaggcagcctaagcatgcctaggattgtgcagttgttggcacgtggcggtggtggccacagcggaggagacgaggataggtcttcgtcgttgatgggttgaggaggatagcttgatgtggaggcaaatgccctcagcctaatcaggcggagagggagagtggcgttgccattaaggatgctcctcccaagttgtcccaacaatgctgagagctccaatttagaaaagattggctaccggtgatctatggaggtggcagattcgaagccaggtatgtgcggggtaggacaatggaagtctccagtctctgggcggtgtagccaaccgtcttctctggcatgctcccttccacctcatggtttcttcctcaccatttgctcctcctatgcttatcgcaggtaaaggggaagctgaagggaaaatgaacggcctcttccctcggtcaatttctatccagtgcagcaagatccaaaaattactggagtggttttggcagaaagagttggtcagatacatagtataagatatgaacacgatagttgaagagagttacaatgggagaagtgtgaagaggatgggaaggggaaacatgaccttgggatgctagtgttgtgggatggtggaagggtgtgatgcacgtcgtttagttcaagtaactcgcaaagtgctagatagtccttgcccttttgacaatgtaagatatttcaaaaaaaatgaaaatatatcttttttcattggttttacataaatatacatgtactgaagaaatttgcagaagtataccactgtcgcagggcggtccggcgagatcgcaagagtcaccacggtctcgctctgcgagggcgtgagaccgacttcccatccatactctgtgattaataaattaactagcataattagaaattaattaattaatattattgtaattagcattattaataatcaattaacattaattaggataattaatcactaattaactattttttgaagcgctgtcgcttttttgcatgcgagatcgcatggtctcagctcagactcgcgttgtggttgtgtgagaccgcgcggtctcacgctcccaccccgcgagaccacccacatcgtcattctcacgcaatggttcagcgtgtcttatcgatctcgcactctcatatagcgatgacagtatatttgtgccaaaagaattacagcccgaatatttcttagaaaaaatgaacagtatatactctaagaaggataactacgtagatctccactgacgtggatttaatgaaatccgttataatgggtcctatgcctagaaggatgtatagatttattcactatttctggactaacatgaatgtttctcgggactgtccaacaattctacaatctacatatatatagacagacatatatacgcatatattgatagattggttggtacgctaacaaccgcagcaaccagcatatatacgcgaggcgacctgccctcggttggcctaagctcaaaattcacaacagagaactcgtcataatgtctctagtggatttttggaacaaatggggtgtggagattatgggtaccccatacccacacggcatggttatccgactagttataggggataacttatatatataaaatatgtaacagatcatgacttgggtattacgtttccctgtatattatgaaacggcctaaagtcctggtttgataagattgtaaagtagatttaggaaaccgataccgtattggttaaggtttctatcttgtaatcctgccccccatcctatataaggtgggcaggaggccctctagggggcatgagacaactagatcgtcagatctataatacacccggcggattcaaatccccaaacaggagtagggtattacctctcattgagagggcctgaacctgtctaaatcctttgtctccacatccatccacttttaggtctcgtgcgttaccccgttttattattgccgaattcatgtttcgacagttggcgcgccaggtaggggttcgccgagtttcctgtcaacaagtgtgatggaatcaatttcatgattcgtcggcttcgtctttgattcgtgagttttcacttcctcgctgccgacgacttcaacaatctctctttctccgacttgggttttaaccagtcgagagaacggcgatcaaagatctgtgtcatcaagttggaagcttcaaaccgtcatcgtcaccgatatctcctgtatctccgcaaaaatctccgcttcgggagctacactttgtggttacaacaatgaccaggttcgccgttccaatctaccaattattagattggtctcagatttaactactaattaaatcaatctatgtcttgcatgcactgattgttggctgtgccctccgagtcccctgatcgtcacgagagacaaccacggctggctagttgcataagacagctgattggatcaatctcggactcggctgactcaacatggaaaatcaaaaacacggagcagtacatacaagcagcaattttcactttgtcagctcgagtattttttaatgaagacgtatggctgcgggcacacgcgagctatatcaatgctcaaacttatccagcaattactggtcatcgcatgcgtttgtacgtgcctggaacaactatgtacctgtatgcataaacacataccaacagaagatctgcacatgcatatgatttttgctacgagagtctgggccatatatgtcgccgacgactttgtcaagtttctcttcaactcggactggaacacgacagacaaccttcaatctaggatacaaaacgggctggactaccatgtcaatattggtggccatcatcatcaccggcttaccttcaccgccgccgactggtgtctctgcctacacagctggcctattatgccaccgttgttggacgtctacgacttcaccctgggcctgcctccgtcgccgccgactggtgccctcgcctatacggttggttggtcacaccaccgttcatgggcgtccacgtcttcactgatcggccggacttcgccaccgccgactgttgtccacgcctaagcggttggttggtcacaccaccgttcatgggcgtccacgtcttcaccgaccggctggactccgccgccgcctactggtgtttccgcctgcacggccggcctattatgccgccgttgtcgggcgtccacgacttcaccgccggcctgcctccgtcgccgccgactggtgtcctcgccttcacgattggtgtactccgtcgccgttgctgatgtcaaccatgtcttcactactggctgcagtcatcgccgccgaccggtgttttcattgctattgatggacgacttgttcccgcatcggctacttctgccatcaccaagggaatattgaaaagctaagtcatcatttattttattctttatatgatatttttccttttcctctacctcactacaccaattggtcttccattgagtagtgagtcgggggctacagatgttatatcatatttttcataatatttatcttgattgcttgcgacataatctgagtacaaaagtgcctatcgagttatggagttccatcttcctatgctttccgtttggtttgccaatggatagttgcctttaggccgattcgtagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattaacaagagaagaaatacgtatttataaactgcttgaatttttctcgagtattatatttacatcagatactactcatcctatatatttgttctgcaggatccaaatccagatatgcataaaagggattcatggctttgagcttatctcttacgctccaggaatggatcagtcagaacatcaccaccggctcgccgtcgtcgccgccgactggtgtcttcgcctatacggttggttggtcacaacaccgttgtcaggcgtctacattttcaccgccggtttgctttcgccgccgccgactggtgtcaccgcctacacggctggcctattatgccgctgttgttgggcgtctacctcttcaccgactggccgcctcgtccgccgccgactagtgtttccgcctgcacgctggcctattatgccaccgctgatgggcgtctacgtcttcaccgaccggcttgccttcgccgccgccgactggtgtctccgtctgcacggctggcctattatgccgtcgttgttgggcgtatacgactccaccatcggcctgcctccatcgccgccgactggtgtttccgcctgcacgctggcctattatgccaccgttgatgggcgtctacgtcttcaccgaccggcttgccttcgccgccgccgactggtgtctccgtctgcacggctggcctattatgccgtcgttgttgggcgtctacgactccaccaccggcctgcctccatcgccgccgactggtgtttccgtctgcacggctggcctattatgccgccgttgttgggcgtctacgtcttcaccgaccggccgcctcgtccgtcgccgactggtgtttccgcctgcacggctggcctattatgccgccgttgttgggcatctacatcttaatcgccggtcgtctcgtctgttgctgactagtgcccttacctctacgtctggtttatacagctaccactactgatggacatcatcatcttctgtcgccgactgattatgccgccgccgactggtgcttttatcttcacaactgcgcgtcttcactaccggtttgcttctgttgccgccgacttgtgttcacttcattacggcaatacaactttgtcaccatggtggagcgacttcatctttattatcttcggcaccggcaaactctattgttgctacttcgcaagttttactacttcaccaaccacgacgtctttgtgaacctcgacatctcggcatgcaatgccatgttattttactacaacaagtggctctccaatattcaggatttctacttggacatcttcaacacatatcttcaatcaagcaatgactattcgacgacaagaagctacagttctcgactctatgttcagttgtttcccaactaatcaaagagtcgggggctacacaaatataaggctcaaaatttgacaaattttatgtcaagctgaagaaatcaattcatcaacccacgagtcaactccaggagtcattatcttcatctttgcttcggagcagacattctacttcaacaacttcaaatatttcggtttagacgagttgggcaacaacatcaactctcctccaagtgaagcatctacaacagttataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagtgtcttcgtcattatcattggttgctacactgctattgactggatcaccgacatcgtcatctttatcaatatcctgccaagcctcttcaacatagcctattctactgctgtttgatgggcaacttcgtcctcatagtcgatcatctctgttgctgcttatcatcattactgtcggttgtgtttgtcgtcgccgactattttcttcatcttcatgattggtggatttcgtcatcgcctttgatgcgtgtctacatcttcactgtcggcttgctttcgtcaccaccgactggtatcctcgccttcacggatggcttattatgtcgccactaatgggcatctttatcttcttcaccagctgcctcgtctgtcaccgactgattatttcgttgccatggctacacaactttatcactgggcgccttcatattcattgctggctgacctgactgctaccgactggtttcttcgcttccacggctgtgcaacttcatcactttagattggtatcactatcttcactaccatcaatatttttgccacctctggtagacaatattatctctatattggtcgtcttgtctctatgccaactgcgccagctaccatcaatggacaattgtgactacgacagaaggacaagctatatgctcaggggcttactagctcaaacacaagtatcatacctccaatttggacttgttccggatacatgcaacatgaattcataatcatgggtctattttctatgctcaaagactggactatttattattccccgtaagggttatcaaccgaatacttgcgccagtcgggatttaattattatatttattttggaatatcctataagggataatcactcagatcagaagcgattgatatgagctacacttggtctatatcacccgttccaaatttattactcggaagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtagaaccatgtgtcttctagggacttaagcacatctgttaaagcagtgtgcgcatggcgtatgctcaatactttggaaatttctttattcacaacatacaagcttctttatagctgttttgctatgtgaattttcaatgatgtagccaactttaggttacactcatcatattttacaaagcagtcggtatattacttggatcatattattcagggattcacaccgcatatgctacatattaatattaagtcgcttggttgaatacaattatcgaaaccactcggtgcatctagtcgatgcacctgactttattttttcagccctccacagtcttctgatttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatataaaatatgtaacagatcatgacttgggtattacgtttccctgtatattatgaaacggcctaaagtcctggtttgataagattgtaaagtagatttaggaaaccgataccgtattggttaaggtttctatcttgtaatcctgccccccatcctatataaggtgggcaggaggccctctagggggcatgagacaactagatcgtcagatctataatacacccggcggattcaaatccccaaacaggagtagggtattacctctcattgagagggcctgaacctgtctaaatcctttgtctccacatccatccacttttaggtctcgtgcgttaccccgttttattattgccgaattcatgtttcgacatgggggatacaattctttgtactcctcagcctcgcgctgcaggtcattctcctcctcctggctggtactcgccggcgtaaagtactcgtgccaaagatcatcctgtggatagcttaccagctggccgactcgacggcgatatacgcccttgggaacctctccttcggcagcgtggcaattgaagagcaccgtctggcagcattttgggcaccattcttgttgctgcacctcggtggcccagacaacatcacggcctatgcactagaggacaacaaactctggttgcgccacgcactgaatcttattttccaggtaatcggagcttgctatgtggtctacaagcatattatcgttcgcagggaggccacaatccttagagtggccaccggattgatctccgccgtgggcgttgtcaagtattgtgagagaacatgggcgctctatcgcagcaattttagcagcatcgggagctctctcgaggagttacagggtaaccaactccattggtaccaagggtacctacacaatgaggatcataacaacactaacaatgaattccttctgcaacgtgctcactccctgtttcacatatgtaagcgtgggatagtagactccgtgatcaatgaggatactgagaatgctgaggcggaaaccaccaaggaaataatcaacaatcttagtgaagagccccagcggatgtataaggtaatggagatggaactgtccctgatgtacgatattctctataccaaggcagccgtagtccacacttggattggctactgcatccgagccttgtcaccctttgctattgccacctcctttctgctgttctatttctgcggcagcgaggtcaaggatggccagaatggagtcgacaccgctgttacctatgtcctgttaggcggtgccctcttgatggaaacaacgtccctcctcagcgctctggggtcaagctggacgctttccttcttgtgcgccaggaggtggagttggcttcaacatgtcgctctatgtgtcggaagatggtaccagctccgacgggcagtcctggctgttcgcaagcgcgtcgcagccttgacgggaggccttctcggtggatcaagaaactggtcgggcaccataggacagttcaatttgctctacttccgtgccacgcaggtcaacccaaccaacaagcaattcggtaggctcattaagaagctagggtatggtgacgagtgggacaccggttgttatttgtgggacatcacaattcccgagctggtgaagcagaaagcattgagaatggtctccaagtatgatctcaacaccatgggcttgctcaggcataattggggtgaactggcactgaaaaagcatactgaaccctcaaaaaaaaataaaaattgtactgaactgctggaagagctagagaaattgtggggtgacgacttccacgggagcatcatcatctgccacattgccacagaccttatcctcgctgagatagaaaagaacaaggccggcgaagacgacgcagcacaactccagtgtgtcggctcgatcagggcactatccaactacttgatgttcctccttgtggctcacccggatatgcttcgaggccttccccaaaaatggttgtaccagcggacctgtgagaacgttgatcaaaactgcaaagagcatcgtgaagaactcatttcttctggtggaaaggctaataatgtgatctttatggtgctcatgaagctgttcggtggccatagtaatagctcaacatctattgggctcaggcagacgaatgcactcgctaaaatcctatacaagagcctgcccagccaatttgaccccgcaattcctcgccttacttatgcaaggttggttgccaaggaaataataaattggaaagatgaagatggtcaattgaagaagccagatgcaatattgaaggtgctgcttaacctgtggacagattttctcctctatgctgccaacaggtgtaacagggagtctcatgccaagaagctcaacactggtggtgagtttattactattgtgtggctaatggttgaacacatatacaaaacaaaatcaaaaggaaaaaaagttgtacctgtcgggccatgataatatctattgttagtgttatatattctctctatattcaatcttaaaggatattactgtaacattcccaaaacgtgtaaacttcaaaccatctgttctcagcaatataattgtttccctttgcgtgctttttttttgttatgttgctggattttcttgcatggcatatatagttgcatctgatgtgcattatcaaattgtcttagaagaattcatacaacttatatgtgcataaaaaaatttgacattccaaaaaaaaactaaattttcgccaattttgtcaactcatttgatacgtcgattgaatcagtcaaagttgataaaacaggaattaaaccataaattttagggttgggaaatcaaaaaaatgccactctattcgctttattggctgggtgccactgaaattttgtaaaattagagatatgccactccgtcacagcaactgccaatacctccgttagctctgttatcgcagatccctttcttctccaactcaggcaaaaatctggcggcgctcaggctcgtcgacgacggggtagagagggcttctccggtgagggtggagggaagcgccgagcccgagccccgcgctggaggagaggggcggtgacggatcccgcgccaccgatggaagctggacgggagcagctcaacccccgcgctggaggaagacggcgtgcagaggatacgcgggtcgccggcgacggcggtggtgatgtcagcggcggagaggccgaggtcggcgaggaagacgacgacggcgtctggcctagacggcgatttgaggtgtgagatggtcttggaggcagcgcgaggcagcgcaggtcgttgacggtgtggaggaagcgctcgtcttcgtcgccgacgaaccggagaaagatgaggtgtgagatagccttggaggcggcgcgaggcagcgcaggtcgttgacggtgtggaggaagtgctcgtcttcgtcaccgtcaaaccggagcaagataaggtgtgagatggtcttggatgtgcgaggcagcgcaggttgtcgatggtgtggaggaagcgctcgtctttgtcgctgtcaatctccgaggtcgagccgcagcagcagcgccgcctcgtccgcctctccgtcgagctcagcatgccggatatgagaaaggtgggaggggatgaggatggaaacagagacggcatgagagaggagatgaaaaaatggtttggagtggcatggttctaattttagtaattcccagtggcatataaccgatatgatgaatagtagtggtatttttttaatttcacaaagttttagtggcatggatctaattaaccctaaatttcaaccctcttcagtcttcacaattttgccacattcaaaccatagcaaatatgtctaccaaacctctcacatatgttgtatacattagttactcggcttgctgtattaaacccagaatttttgggcaagctagctagccatgcaagaacttcccaacccaataactaggatgatgtttataagatgatgtttatagcattaaagaagctaccacctaggatgaataatgatgtggcaagtgaataaataaaaaaagagaaggaaaccatgtctcgcataagacatgatttctacacaatatctaagacatcatgtgagataagtagcattaaatttaagtatgaaatagtggtgtttgtattggaagaaaattactacctccgtcctatattacttgtcgctttgagtttttgtttgtaaaatttgattattcgtcttatttcaaaaaattttgaaattattatttattttatctgtgacttgcttaattatcaaaagtactttaagtattacttatccttttttatatttgcataaatttttcaaataaaatgaatggtcaaacgttgaaagaaaaaagttaaagcgacaactattacgggacagaggtagtatctagtactagtttcttgatgatgtagagtttataaaaactatagctatgtctagtgtattgggttaggaatggccttaaactatccgtttttaactcagtatgctaccgctttgtccatctccggtttccagcgaaagaggtcccgcaccgacactttgatctcctcctgtgattccacttgacctggatcaacttgttatgcgcatgaatgttggccatcatcttgcttagttccgaaagttgtttctccgcctcgtctgtcatgatctgtgctcctgaatgatagcgtggcttgccagaaaacctctaggtcgataggtcgactgctctgatacaggatgttatgtttcttgatacaaagaagacaagggaaatgcgaacagagaaacgacttgcattggaagaagaagcagttggaagcggtgtggaaaaaatctaattattgtattttgtttgttttctgatctattacatcgaacctttcatggggtatatataaaagtacacaggggatagagaatataagtaagagtagatttatctctaggactctatcttatctctaggattatatctctaggaaatatcttacctctatatttgtatttgactgttatctctaaccgacatagctatcttttcaacaagcggtaaaattttggattggggagatagagcccgtgtttagcttgtacaagttcagcgagattgctaaggggcgatcgatcgcccctagcgatcgcccatagcacgccccccctctccacctccacgtggtttcttttttagcactgcattatttttctattttagtaaannnnnnnnnnnnnnnnnnnnnnnnnnnnnnnn

SEQ ID NO: 43789 - DNA, 2191 bp, Oryza sativa
cgtctgtcatgatctgtgctcctgaatgatagcgtggcttgccagaaaacctctaggtcgataggtcgactgctctgatacaggatgttatgtttcttgatacaaagaagacaagggaaatgcgaacagagaaacgacttgcattggaagaagaagcagttggaagcggtgtggaaaaaatctaattattgtattttgtttgttttctgatctattacatcgaacctttcatggggtatatataaaagtacacaggggatagagaatataagtaagagtagatttatctctaggactctatcttatctctaggattatatctctaggaaatatcttacctctatatttgtatttgactgttatctctaaccgacatagctatcttttcaacaagcggtaaaattttggattggggagatagagcccgtgtttagcttgtacaagttcagcgagattgctaaggggcgatcgatcgcccctagcgatcgcccatagcacgccccccctctccacctccacgtggtttcttttttagcactgcattatttttctattttagtaaatttatacacctaaagtttgtacacctcagtttacacatctaaagtttagagacccaaagtttataaatcaaaagtttatatatccgtacagtatttctatacatctaaagtttataaacctaaagtttatagacccaaaatttataagtcaaaagtttacatacccaattcaaatttaaatttgaattatatccgattcaaatttgaatttgaattcaaatattttttatatatagtatttctatacatctaaagtttatacacctaaagtttatagacccaaaatttataagtcaaaagtttacatacccgattcaaatttaaattcgaattcaaatattagttcataagtcaaaagtttacacacccgttttaaatttgaatttgaattcaaattttttttatatatagtatttatatgcataattttttttaactttatgttttttatttaaatttatggtgtagtaggaaaagaagaaggggaataggaaagaagaaagtagtgtatagggggattggggtgatatgagcgatcacccgcccattagccgcccccaagttcagagagaaccagtcagttgcctggtagcagaagaaaaacacgattttctattctgcagtcacctgcaaaattcgtaattggtcagtcgatttctttgtctatccgattcgcttcatgatacgtgcatgttatatatgcttttaggttagtttattgtatctttgaaaaagtacgaattacctccttaactgtcgcagtcgtccgaattatcccctgaaccacaaaactggacattctttacccctaactatacaaaccggacgaattacccacctcgatccaatccgcagtggttttggtctacgtggcgtacacgtggcagtccagtcagcattctatgcataaaaaatatgagacccacctgtcatatcctcttccactattcccccctctctcttcctcttttctctctcttctatgtgggacccacctgccatatcctcttccacctgtcatgtctcattcttcccctctctctcacacacccacacggcggcaggcggggaacacaaagtggcggcggcgcgcgcgaacgcacgcgggcgggggccgaaggtggcggcgaggacggcagcacgcacggcgcggggcgtgcacgcatgcaaacaggggcggcggcggcgaggacggcggcacgcacgcggccaaacgctcgaggcgtcgacctccctctgccccgcgcgctcttgtcctcctcgacgcgccgccccatcaacgccttcaacaagagggtgggcgacctccggcacgtcgccgtagacgcgttcgcgcggcttaaggcgcggtgggcgtgcctccagaatcgcacggaggtgaagctccaagacctccccgtcgtgcttggcacctgatgcgtcgtccacaacatctgcgagacacgcggcgaggagctcgagccggtgctccaatatgagctcatcgatgacgagacctcgccggagacccacgtcggctctgaggccgtcaagcgcgacagggacaacatcgcccaaaacctcctccaccgcggcttcgcctgaacccaccttcttatgaagatcgattcgataacaccaccgccgct

SEQ ID NO: 43790 - DNA, 14830 bp, Oryza sativa
tacggtatcggtttcctaaatctactttacaatattatcaaaccaggactttaggccgttccgtaatatacaaggaaacgtaacacccaagtcatgatctgttacatattacataaatataagttatcccctataactagtcggataaccatgccgtgtgggtatgggatacccataatctccacagtagcccctgagaccttcacagtcggaaagataatcttctctcgaactagattactccaaagccgagtgcttcaatcatcttcgccatgatctcccgagtactttttccaaatcagaagactgtggagggctgaaaaaataaagtcagatgcatcgaatagatgcacctgataggtgtaacccccgactatgtggttagctgaacaaaccaaacatatagtcaaggaataagttatccaattaaccgaatggtttttgataattatagtcaaccaagtgacttgataccaatatatagcatatgcggtgtgaatccccgaataatatgatccaagtgatataccgactgttttgtaaaatatgatgaatgtaacctaaagttggctacattatcgaaaattcacatagcaaaacaattataaagaagcttgaatgctgtgaataaagaaatttccaaagtattgggcatacgccatgcgcacactgctttaacagatgtgcttaagtccctaaaagacacatggtttcaccacacctggaaatatatggcatatgtggtgtaaaatctgagtaagtaaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgtgcactttggcctaagcaaaaagtgcctaagtccctaaaagaacgtgacaggccacacctgaaaatatgggctgcagacatattaggcctaggccaaaaaatatgccttcgataccctttaaaggatgacgcatgtaacatgctcccgggtgatatagaccatgtgatctgagtgattatcccttatgggatactccaaaatagatataaaaattgaatcccgactggcgcaagtattcagttgataacccttacggggaataataaatagtccagtctttgagcatataaaatagacccatgatcatgaattcatgttgcatgtatccggagcaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacgaaagaacagtcggtgatgacaaaagcaaaccgacgatgaagacgtagacgcgcatcaacagtgatggcgaaatccaccaatcatgaagatgaagaaaataatcggcggcgacaaacgcatccgacggtaatgatgattagcggcaacagagatagccgactatgatgacgaagtttcccatcaacgacagcagagtaggctatgttgaagaggcttgacaagatgttgatgaagatgacgatgtcggtgatccagtcaatagcgatgtagcagccgatgataacgatgagatcctctatcggcagttgcgtagtaggccaaccgagaagacaaataattggaggagagttgatgttgttgcccaactcgtctaaaccgaaatatttgaagttgttgaagtagaatgtctgctctgaatcaaagatgaagataatgactcctggagttgactcgttggttgatgaattgatttcttcagcttgacataaaatttgtcaaattttgagccttgtatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaagataaaagcactagtcggcgacagcataaccagtcggcgacggaagacgatgatgttcatcagtagtggtagctgtataaaccagatgtagaggcgagggcactagtcagcagcagacgagacgaaaggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagctgtgaagaagatagcatcagttggcgttataacaagccagccgtgcaggcggtgacaccagtcagcggcggatgcggcggccggtcggtgaagacgtagacgcccaacaacggcagcataataggccagccgtgcaggcagaaacaccagtcggcggcggtcgaggcggccggtcggtgaagacgtagacgcccaacaacggcggcataaaggccagccgtgcaggcgaggacatcagtcggcggcgacgaaggcaagccggtcggtgaagacgtaggcgcccaacaacggcggcataaaggccagccgtgcaagcggaaacaccagtcggcggcggcgaaggcaagcccgttggtgaagacgtagacgcccaacaacggcggcataaaggccagccgtgcaggcggggacaccagtcggcggcgacgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcgaggacatcgatcggcggcgacgaaggcaagccggtcggtgaagacgtaggcgcccaacaacggcggcataataggccagccgtgcaggcgaggacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttctccgagcagatgactcattacgtttaaacactctgcccgactagtcatagccaccaagcactgggagtcggcctaagcacttcccaaacatgcatatgagtgacatgagttcgtcattaatggaacaaggtttcacggatcggagtttactactcgggtacttttgcaattattaagagcagaaaataaattatcttatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcaaaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccatgtaggcggaggcaccactcggcggcgacggaggcaggccggcggtgaagtcgtagacgcccaacagcggcggcataataggccagccgtgtaggcggaggaaccaatcggcggcgacggagtcaggccggcggtgaagacgtagacgcccaacagcagcggcataataggccagccgtgtaggcggaggcaccaatcggcggcgacggaggcaggccggcggtgaagacgtagacgcccaacggcggcggcataataggccagccgtgtaggcggaggcaccactcggcggcgacggaggcaggccggcggtgaagtcgtagacgcccaacagcagcggaataataggccagccgtgtaggcggaggcaccagtcggcggtgacagaggcaggccggtggtgaagacgtagacgcccaacaacggtggtgtgaccaaccaaccatataggcggaggcaccagtcggcggcgaagtcgtagacgcccaacagcagcggcataataggccagccgtgtaggcggaggcaccagtcggcggcgacggaggcaggccggtggtgaagacgtagacgcccaacaacggtggtgtgaccaaccaaccatataggcggaggcaccagtcggcggcgacggaggcaggccggcggtgaagtcgtagacgcccaacggcggcggcataatagaccagccgtgcaggcggaaacaccagtcggcggcggcgaaggccagccggtcagtgaagacatggacgcccatgaacggtggtgtgaccgaccaaccgtataggcgatgacaccagtcggcggcgacggaggcaagccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccaagtgtgtattgatctgacgatcaggttgtctcatctgccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattacataaatataagttatcccctataactagtcggataaccatgccgtgtgggtatgggatacccataatctccacaacatgtgtgcgtgctgccacgccgtgcgtgccgccgtcctcgtcgcggtgcgcgtctcggccacgtcgccgtcctcgccgccgcctccggccccattccgcgtgcgtgtgcaccgccgccgccacttcgtgtcccccgcctggcgccgtgcgcgtgagagagagaggggaagagtgagagagaagagagagaagagaggaagggagagagagggcaacagtggaagaggatatgataggtgggtcccatatttttttataaatagaatgctgactgcactgccacacgtacgtcacgtaaacgaaaaccacaaggattgaattgaggggggtaattcgtccggtttgcatagttggagatgaagaatgtccgattttgtgattcagaggataattcggatgaccgtgatagtttagggggtaatttgtacttttttttttcctagtatctttggtaatgtgctgaattttccctagcacgttaaccatgtgggcttgggaaagctggagagagtttttccagagtcctctccctctctcactctcgctctgtctcttttcccctccatgtttgcgagcacttgctgctagggtttggggagacaggggtgaggaggaaggcgggaggcgcgcaggctgcgacggcgctggatgggttccttgagtggaggaggcagatgcatgcgtggagatccgccggcggaggtgcctgacaagggggaagacgaatgagcaccaggaaaggaggcccagctggcctccaatttctcattttctcccctcatcgttggcttaaagcatcacaagagtttctctgaactattcctagaccctgtttggataagggaaatccatgtttggatactaattagaagtattaaacgtagactaattgtaaatctcattctataactctggactaatttgcgagacgaatcttttgaacctaattaatacatgattagcccgtgcgatgctacagtaaacatatgctaattatggattaattaggcttaaaaaaattatctcatgaattagctatcatttatgtaactaggaaggtagcccgcgtattcacgtgggcatgcatattattttattttggaaatagttccagttgaaattcaagtaaagtatttttcatttttaattgaattttcattgattactttttccttaagaggtctcaaagttttattgctcgtaaatttatttattttaccatcctgatagccctcctttttaattgatcaaatatatatctaatatagtgcctcttttaatatgtgagaccgtacggtattttaaagaaaagacatagtcaacatgaatcataaattaataattcattggaaaagttaacttttaatcatattattaaaagaaagaggctattgattttgtattgccaccttataggcttataaatgcaggttgtagagaaaaccatggagctactttaattcattgctttatcattgacctttgcctcttggtgtgtttaatatgacttatgcagagaaatataaaaattttgaaagaataaaatatcattatgaggttaaatgagctatgcttttccataacgaaaggagtatttattcaatactatcttacaggtttagtgcttcactaaagtagttttatgtgtaaaaacttcaacgctatattgcgggtgaagcattctagtaaaatagttctgtataaaaggattataaaagttattttcaaagatgatccatgagtttgagacaagaggctcactgcataggaggctgcacatttgagccatatgtgaaaagaaggcttgcaaaaatcatttgtgtagtggtgtgatgaaaataattatgcatacaattaaaaatttggaaatacctatatgaaaataatcgtacttgtgctcatattattgtttgccaacaatcaatagaacttgatagtgcgtgagacttcacatagcctacgaatataattacatagctgaaaataactctgcaagagtgaatattattgtattgtggacttttcatgagtgccatcatgatttaaaattttttactctaaaatttataattaaacatcaggaatttatatactccaaacaatcactctttgtaactttcttttagctaatgtgcattaggcatttagtattgcacttatatgtaaagtctgagctgcctaccctattttgtcttctttgtttgaaagaattaggcatttaaacaataatggtagtttattatgtccattactataagtaaaagttgtaatcacgatgtcctgggtaaatctcaagcttttattttttttatatcatgttatagttttctggtttgcaatatatgtggtttatactacctatttttccttctaattaaatcaccgtttatatgcatcgtgccgccatcggtcctggcggggcacacataaaatcagtttggcacacataaaatcaatttgcttgaactcgccaaaaaacaagttcaccccaagttgtttgttccttatatatagtagtatatatctatggcatgttttacgaatatgctctagtatatatcaattgttggtttgttctaggcaacgaacaatttagcacagtacaatatgaatggagatagatccatcgttataaagttgaagttgtgttgtatacaatataaaggtgtagctcatcagagaaacttgacacggtgatagcgatcgcctgcaatcaccagaggtgcatcgtagaattctttttcttttttttttagtcttgatgctctggttgagtagatcaacctattctaacggtggaggccctagttgttctctttcaataagataaatccaatagcctaaaataacatatcatcaatttaagtgaaaatcaaagatgatatgttttttatcatattttatatgaatttgtaatttatttgagcgtcatgtgatggtttaggagcatatgtaggatgcctcgtagtggtttagaagtgtttctagaaagtttaattgacttttatataaagtcatgcgtttgtgcaactatattatctcccctctattaaatttagaataataatgaacaatgtacatatgtgttcgtagaacatttttgcaccatatatatagcgttatcacatttatgtttttcttttctgtaattaaacaataatttgtcatatatgttggtgcggccttggtacatctgatcattctttgtcatgatatcacataggggcacggagtgaagttcagatgaatttttttttaaagaaagatagatctaacaacctaaaattgattaatttacaaatcgatggttgaatgtattattctttttggattttttctaatttaagagtgctatgtagttatttaaaaatatttgtatgatgtctagctacaataaacagattatacaggttgatgtctatctatggattttttaggcccataaagaaaaaatagtaattttaattatcatggaaataaaaaaaataaaggaacagagcaagggtaggttaggtatatgcgtaagaacgccgcacagaggcatggactgagggcaaatttttcttaagatagatctaacgatgtaaaataatgggttcactgatttaaatgaaaatcgacggtcgtatttctctgttttattagagtgccacttgatgacttgaaagtgtttatagggtgacgcatggaggattaggaatatttgtacgaagtttaatggactatcaattatgatcatcaaggtataaaaaacaatatgtattacatatataaatattgttaatataaatttaatggtagaaaataattgatcgactatgtttaagtggaaatcaatggttttttttgttttttccttcatataatttctatgattttctctaatttattggagtgttacttgatgacttaggagcttatttatttgtcggttattaaaacacaaatgaattaattattaagactatagtttcacgtgacaacttttgtaattaagatatactaatatggatgttatatttttttatagataaaatacatcatatgctttataaaattttaaatagtgaacaactgaagaaaataaagaggtaaggattgatcgcttcttttccaaccgtaggtgcaaaagtgcttacatatatactttttttatttttttttccaatgaatagttttttatttgtttttttagcaaatagtgcctagttatttttctcacgtacgtttttacgttagtatgtatgtgcacgatgcttggatgtgggggataggagagtgtagacccccgattttggaaatcggaaatcttctgtgtttatccgtaccaatccctggatcagtagttggtacacacatacatagttggatcacaacatatcacgaatgaattcaggctaaaagagttaaatacttacattagggccaggtaggccaacaactaccagaggacaacagcggaagacaaaataatataagggtccggttaacatgccacaggcagtcgactagggaacgagacctagaacaagactgcacttcgatcattttgttggatacgcaagcgtacgataagggcttctcttcaacactctcctaaaagatatataaatagcaagggtgagtaccaaccgtacccagcaagccacctcaacaacaatgcatatgatagagggtattttaaggaatggcttcaggttcttttgcataaagctagttttgtaattcttttcataagcctaagacctagcatagactgatcaaattttaataccaattttcacattaaacaacgacggttctgtccaccatccattatgatcccaaggatagcttcccaccattgaatcgtcatggttttctgaggacgtccaccttcccgcctctcaggaagtggctccaacaacataaaatcatcatgcaatatcccatcccacacaagttaagaactttgagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaatttaaatcctcatgcactctaggcgtctatatttatagcagtgagaggagttctggcgctcccgggaaagagaagtctcacacacatattaaattatggttcaagttaagttctctatcacacacactcatgacagtcctaccaatggcgacaccgatgtagggcacgcctctcggccctacctcaacggctgccccaccgtagcgcacttgccacactcaggggtgaaccatctatgcagggatactgcctccgctcggctatctaatccgctaggtctatacccattcgagaagtacggttgtacgggggtcgtttcatgcttaacttcatggctcggtccttaattgaccgaggacggtactagccttttccagataccacccaaatcctccgtccaccccagtcgaaaacagttgtttatttttatttctcctttcgcaaatcatgtcatcaatatcatggcaatgtggtgctcatgtctccacataccatatctcaattaccttcccaaaggtaattgcccaagcatatagcatttgataaatatgagcatgcatgattctagaatagcatttctaagcatttgtcatagttgactagggactcatacgtaaacatggttatgaaggaataaggggtaaacaataatcaaggcatggcataatcgcaagtaggatgttcatcattgcatgcaattttatttgtaaacaaaacaatttcgcaattgggatcaacatgttcaaggaatagtgatgacttgcctgctcaggatagtccttattctcgatataatcttgatcaaccttcacctcctagaagttgcagacgttgcctcacgactaaccgatacacaaagtctataatacgcgagaaaaaccaatattcaaacaacaatcaaatatgcacaacaaaatgtacttgttagggtcgtacctagggttgctcatactattattgcttgctaggggattccaatcatgctaagggctaaagtttcttaatctttctgttgtcatggtggtctatataggagctaaccaatgtagtatgaatgagatacgtatctggctactatgtggtttagtctagcaaatggctattcatgcatctatctaaatagaacggttatacactagaggttctgttgccggatggatttggatcggtcaaataattactgtgaatcatttgtattattattttattgatggaggctttattttaattatgtacatattttacttgtcaaaataaattataaaaggttaacaattacccatgctttgtatgttagaactgtttaggttaatcatattatggttacagactatcccatcacataattttataatgaataatcctaatttacaattatattaggtcaagatttataactagtattttatccactatagatgtttgtcatagactcattagtttactatacacaaaagggtaggtttttgatataccgtacatctaaattgggatgtacaatgtacgtgtacgcaacaatatttaatcattggatcatttactgaatggttgctatttactagaagctatacgatatatgtgattaagatggctctgttttgttaactaatggatgtcaaccgaactatatttattccacttcacatgacattataccgactaacttttaagcggtccaattacaactagctcagttattattctccttagacaagttgaaggttcatctaagtgtgtttatattttagttacaaagtatgaggctaaacttatgtaaataatttataagtcataggtttagttatatttggacatagactaattaatggcactaatatttcctatgctttaatcaatttgaaacaatgcacctagttagtttacataggttttatagtgagaaagcatgttaaagacaattatttgacatctactttacagtacaatatcaattttcttattagcacatttttaagttaactattatgcatcatcttgatattaattattaataattataaatatattttattaaatagtgaattatataccattggaaagcttgtgaatttagatgaatttaggttcaagtttcagtcaaatcggagctaaaatgaataagttatgctagtgtaaagattcaaatttgaattaattctaataattgcgaaatggtactgttcctaatccatttatttttaatacaaccttatccacaggctatagtgacttacaggtggggtcttcctattttctttccttttcttttatttttcttcctaaaggaatcatacgggcaaatgacgagtgggcccgattcctttgactagggtcaaactggccatttaacgcggtagggcccgcatgttgtagactcgagattataaaacctttataattagatttttaaccacccggacccacatgtaatagactcaactaataaagattaagaagggaattactattcactaaacacgtggggcccactctaatctctcctctcctttctcttttctctctctcttctctgttttctctcttctctccctcccagcttcttctccctcctctctctctcggctctttggcgatgacgaccgaccaaggggaggaggcggcggcttaccgacgatggcggcggcgacggcggcacgacgacggcgcacggcgcggcggcacgaaggcggcggtgcggcggcgcgagggcgacgcgacgacggcgcacggtgcggcggcacgaaggcggcggcgcggcgcggtggaggggaagggggaaaaaggaggggaaggaggggggaaatggcgtggggagggaagggaaaggggagggggtatttatagggctcgggggaggggtggccggctttaaacgatgacggaacggcgtggcgacgcggggctcgggcgatggcgacgcgcggcgatgggacggcgcggcgcgacggcgacagtgcgcggcgcgggcggggctcgaggcgctgatggcgacagcggtgacgcgatggcgcggtagcggcacggggctcggggcgcggcagcggctcatggcttggaggcgcggcagcggcgcaaggcgacggcgacgggatggcgggtgacgcaacggcgacggcgggtgacgcaacggcgacagcgcgcggcgtcttaaggcgctaggccgacggcgacggtcgagcggcgcggcatcgacagggcgcggggctcgaaggcgtggcaacgcg

SEQ ID NO: 43791 - DNA, 18669 bp, Oryza sativa
  unsure (1)..(18669): unsure at all n locations
tggttagggaaccaaatcagacacctagagggctaatgaacagtgctagccaactatttttgattttatagggtattttgcaattaggaaaaatatactattgccactaattttgtcacaatgtaaaatacaccaagcctaacataatccatcgaaatttgtattcaaatttaatattgaacatatttttatttttattatatatttttctaagtattcctatttttagggctttggtttatttataaattgagaaaagttgccaattaaatttgtatttactcctaagcagttgagtgactatattaagtgctcaaatgtgaattttcccaaaatttaatattgtccaatatttaatatatatcctagatttttataatttcctatatttggggattttggtatttatctgtttccacacatattggttcatctttttggattggttttaccactacatggatttctataatttagcatttgtgattcagttcaaattatataatatctaattaatttttcccagtaaaactattctatagatagagttccatttatttgaatgattatcatttcctaagtgtttatatttcatagcacgcatcacatggttcaagtattcaatatttgatccataaattaaattagtaattaacctttcctttgtttggatttgctttctttgtgattatttacggtttggcaagcaatagtaatcataacaatcagcatggtgcaaaagttttaaaaagtttgaaattttagtgatttttattgtcgggaattttcaggatgttacacagagggaggtggaaaaaacaattctaatatagtaataattaaacatagtgggtctagttgtttatttaagtgacacatggtggtttaggagtatttgtaggacttccacatggtagtttaggagtgtttgtaggaaatttcatggacttctagtatataactaggaaggtagcacgcacatttgcgcagggaggcatcataagctacggttgacacttatgagtgcggaataccaatcaaagaatatctggcacgctttaaaagtataatttctccataaattttattctcagcattgcttaggtaaattttctaacctattagttaattatttcaattatctaacacaattgttatggcaatagccttttcaatctaagtgaaaagtaacaagcaaaattttctaactttttcctccaattggttagatttactctctaataatatttttctattttatttaatacaagtgcaaatataagttcaaaatttgtgatattatgaatagtgatagagcattacacctttcatctcaactttgagaaaatttcaatcacacttggtgatgtattaagtagttaagactgatgtgggtcctcattctttattaacaataaacatatgaattggatggtatggatttctagagttcaataagattccgtgctgtgaaacacatctatgaatgtatcatgtagagtgtgcgaggcttcatgcagccgattgtaaacacgatcttacaactaaatatatctaactgtgcatgcatcattattttggaatgtgatgtattacatgcttctatgatttgtttggttactattgatttagtttagctatatatgtttatatatatgtttatagagtgacttataatgatataatatatgctggcaatttttttctcgtatttcattgctatttggatgacatgcaaagtgcatgggtcaactgtagccaaataatatattatatagcaaaatataggcatgtggatcttaaatcgtcagttttgttataaatatatcaatagttagattagaagtaagacatgtatcttaaaaaaaatatcatcgtttcaatatacaattatcagttgtttcttctttagtttaatagttaaataattcaaaagggtagagaaatgaagaacgcagagttcgaggcatggagagggggtggattgtgatgtgcacatgtgaggggagaagattacacgcaccttccatgttttctttatcgccaacccaatttacttcaaaataaaatgaaggctccacacacacaagggccaagtacaatttagagaaagcagcatggcaagctatatggttggtacgccaaatcgaggtgctgataaagcagtgctgtccgacaggttggtggagaaatgttatgcaaactatatggcggaggaatgttaacgatgccgtctgataattagggggcttttaactatttgccactcttacgaatggtgcttaacgatttgccactaggcccacatgtcatagacacatgagggcccatgtgtcattgacagagcatggcaaaatcgttaattgccaagtcacaagagtggcaaatagttaaatttcccgataattagtggcccctactccccagcctgactgttgagcgcgcacgagaaaatgtatcaaggcttcacaatttacacatgctctcttcaaataatttcacaattcaagttcagactttcagtaccagaaaatggttctcaataatgcagctttatttattatgctagaacatcacaacaaacagagagaaaactccaagaaaggcaagtaaaccacacacaaacatagcacaaaccacgtcagcacacatatgtatatagttttggtaggaggataaatttaatttcctcagtggtaatattccagcctgggttgttagtgcgccctcctaccatcattctccaatgccatcacattaccgtggtgacgaacctcttgatgcatgtgaaattcatgcctgtgcacctccttatgcactctgtgatgcataccatgatgattatggtccacagattcgaaactgtccaacttagttgaagttgtagttatccatccctgcagttaaaacgcagaccaaaaatcagccgcacgattgccgaaaattatatcagggtttgaaattttggtaatttccgaatcccagcaagctaatatatggtccaagattttcaagtttctttcaaaattttaaataattccgtgcgaaacaccaccaagattcctgaaatccggtgaccaccgaaatttctaaccgatatacttctgtccatttcagtccaaatcaagtgtttagcaacagacaaaaaccttctgcatttcctgtagatccttgatttttcgctgcaatttcttgttttcctcatcgaggcgcttgttctcttccctctttgtctcaagttttgtgttgagatattccttctctctctttgtgattttgagttcttccttggcatctttggtctcctttgtctttttttcgagctttgagttgagattttctttgtctctcttccattttcgttgttcttgctggagaagcttgtatccttcctcttgtttgatttgctttgactcgacagcttccttctgtttcttcatgttctgaaggtcctttttgtatcgatccattttcgccattagatcatcctgaaataaatgatgaagttagcaaaggaaatataatcagaaagattgaggcattaatcttgcaattaattaaaatctctgcatttagcacataccggcacaactgattcaatcttgacactggatgacattttcttgaggcgctcatagagcttcccgacgtcgacagtccctggcacgtccaccttcaaactgctgccatctacttttactttgaaattatcctggtcgacagattctaaaagtaaaaaaccaagatgatgagtactattagttattttctgcataattcacccttccgaacatctctgtccatttgatttggactgaaatccaacagcaggcaggattattgatccacaatttgtgaaatttccatcacccggagacaagaaaatacgagatgttaaatggggagtatatctgctacgatcattacaacctttgaactcttgacgaagtacgctcttgacctctacgtcgtttgcaccccgaaccttgagcttcgtaagtttcttgtctccctgccaagagttcgatcgtacataagaagaaatccttcaaacgtttgttgatttgaaccagcaaaacaaacgagtgcagaaacaaaattcaagaacagcacataccatttgcttcagatatatatggtgaaaagagatggggaggaagtcagagactagagcaagatctagtactgctgctccaagaacaacatcgccatgggctaccaacttaaataccgtgattcctgaggaacagaatctggaaaacgtgttcgtcgttccatctgaatacgcgttctttcatgcagatgtcctcgtctccgtgtaagatgcaaatatggatttgattacattcatctcgaaaggtaagaaggatgatcatcgcatctgtatcttttcccttgacttatcgtagcttcattccgtcaatgaatataatatatactccttctctttctaaatatttaacgcaattgactttttaaaatatatttaatcattcgtcttatcttaactaattaaaagattcgtatttttcctttagtcacatcatccgtgcggtgtttttttcgtccgtctaggtttttttttgcgcgcgtggtttttttcgtacgtggtcttttactgagtccgtctgcttttttttccgcacgcagttttttataggcccgctcggtttttttgcgcttacggtttttttaagttgtccgtctccagttctcacatgatgttttttttgggcccacagcccaggaattacatacagagtctaacctatataggaattacatggagtccaaacatagaaattacatgacaagtagtatacaaacaacttctcaacctatatagaaaaactgaaagcacatagaagactaatatatgctcctagaatttgatgtggatactaagcaatctctcgctcgacgctactcatacatgcacccagatttttttaaaaaaactgagaaattcctgttcgccgtgagacttaatgttcttttactgcatttacgatgatagaaggtaattcttcagtccttaatgatgtacacattattaatggcatatagcgaacaattagcacaaatcaatcgatcttagagggaaaaaaatacatggaaataaaactaccaagctcagcaaggaataaatatcaaaaaccagattgattggatctcataccttatttaagtggcaaccatattttattagtaatttcgaagaaaaaaaaccagccatcttatattagtaaaaaaaaactttatcacacaaaactattaacccaaataataccactattacttcattatatttttatttgctacacttatttttgatttcagatgtataataagccccagtctgtcaatcaatttcccttaactaagggcgcgcaaaaaaaaaagacctacatatataattgtgcttgaggtcccctatttattcctagggccgtaacgtgaaatgtatttcatataacataagtaaagcattaaaaaaaaacttacagtatttatatatatagagtatataaaagagtattatggaacattagtaaaaaaacaagaacaaagatacttgcctagaaaattcagtggaacctctctcgcatattaggacaactaaagtttctaaacttcagatcaaataaaagcatcttgcataacaaactaagacttgaaagctcagacaagaactgtattttaaacaacaagattactgattactactatgcaagatgatcccaaaatttcacatggacagcatgatatattgtcttaaagcaaataaagcacctgggcagcaatggctggaactgacggcgagtcaaggacgtcggtcgttggtgagcacggcgtgggtaaactcttctcgaactctgccgtccgcagcccggcctcgaaagaagtttagtataatgtggacattgtttctctcataagctctcgcctatcagtacagctccagtaagccagatgatgtttatgaacagttgaagaatctagattaataccgactagaaggggatgcgcggcataatgctgtgctcagctgtgcatacaaaacaaatacggtttaagcaaaattttaattccaaatagtttttattgatcgagtgtttcccttcgttcatttgatttgaaaaggtaatatcaaatgtattaggtacataattagaagcttgtaattcgaaagatgacaaacttgaaatgcttggacactctgactacattaccaccataacaattttatttaagcagcatatctagcaaccaataaagagcttataaaacaaagcactatttctttttttttcatttttacagattgcatgctaaaaccagaaccttctccaatcacccgtcacatatgaatctgagcacttcagaatattagtttcttccactttctaggaaaaccgaaggttcttaacaatgacaacaggtgagtgataaatcatcctaagtacgacttcacaggtgagtgataaaccggcacctttgtttctctgcatcggtgccacctatggggttcccaaccggctcccatttatgagcaactaggtcccgatcttttgataggtattgataactctcgatatggtgaaaacttgacaaacacgatccggctttttgatcagcacgatccaaaccctacaatcgcagcaccacatcttatctggttatcaaccgtgcactacccagttaaccccgccgataaagctaatccttgcatgtgaatttgaagaacacaagaaagacacaaggtacactgcaattcaattaagctctcaaatttggggttacataaaccgaactagcatgaaactacaacaataaaaataatataagaaaacttcagtataagctatgacgactactggataaatatgattagggatattctagggttgccctagggcgccaaccccttgggcttagctcatgacccaattacaaggctcgaggcctaaattagattcggactggataaggtacgtagattgttttgcagatttctgatagcctaggaggaattttgatgtgggactaaaaccatatgaaagtagaatccataagctttccaataagtccttatgggccccaagttttcttctagcacgagatcaacggctagtctcgaatccgaatataaaacgtgcgaaatttcatctcttgctttctatggactaaaagtgacgtggtgagttaagactagacttggagaaagtcttggtttggcccccagtgaactttttttgatcatccattattcctttgcccaaataagtacctctacaaatggaacacataaaactcatggtgcagtatcgtctgtttaaatatataacatgtaaattgtacatagaaaacatgcacctttggttgctgaatgaataaggtatccatggtcatatccgatctagtgatatcctaatcatttagttttatgtagtagtgagagagtgcgcaacagaagaccgagccatggatctgccgagccagttcaccatctcctgtagggcagcctatatgttgcactgtatgtacaccgctgtctgtacaaggtgtgacaccaacacataagtcttattggattttataggagcagttatacccaagtacaacataaacgttagaggtgaacaacgtttgcagaattctttgccacattagccaaattatctttttcaacgcatatccaattttagatacggcaccattgtagcatacatttaacaaacttgtttcctaagcaatcctgattgccagagagggtagccacactttactgcttttcgtgaactttcaaggtgtggagattatggatatcccatatctacacggcgatggtatttggactgagtacaggataccaaatatagatagaatatcttatttgtgtctcgggtttgtttcttaacttgtacatcaaggaaataccttgagacttagtcggttacgactgtatttaatctgtatctgcatattccgttagggatatatattatcttttgtaacacggactccttcccatatataaggggggtccgggtgcctctaggggcatatgttgattttcccaaatcatacaatcaataatacactcggcggatccatccccggacaggagtagggtattacttcttgaataagaaggcctgaacctgtataaatccattgtctccaaacccatacacttctcaagcttgatagccacccccttttattattgccgaaatctagtttcgacagttggcgcgccaggtaggggttgcgtcaagcttttcgccgatcagtgcaatgggttccatctccggcatcgacgacctcgtcttcccacccgggcagatgtttcggttcggcagcctcgacttcgtcaccaacaacttcggcaagatctctctccttgactcggagtcataccagtcgggagagaaccggatttcagtcccgtttggactcccaaacgcggctgaaagttacttcaagaccatctcaatcgagtcggcttcaaaccactcgggagagatcgcatcttctccaacgtcaccagatcaagatgatggggcttacccaccgatcctgatggagctccctgacgatttggcgaccgtctccatcatgacagcgccttcatcccgtaggcctaggcggaagtcggcttcaacaccgatttcgcctagcttcagggaagtcggcgtcatcctccaaccactcggcacggtttcgacggatcagctggatggctactacagctctcccaccgtcgactcgcgtcccaccgacatcgtggaatacgacgagtttggctctcgctactacaacgacccggatctcgacgacttcgacggaagcctagaagacaactacacccctctctacttcggcgtcttcatggccgacaatgagacggaggagcaatgccaagcccgggaaaccgaagcacgtcgcgagattgagcgtcgccgactggagcaggagcgtcaagcacaagaacaagaacggctacggcgtgaccagcatgagcgtgagcgaaccgcgaaggaggctgaggaccgacggcagcgagccttggaagcagggcgccgagcgcgtgatttcattggccagcaagatgttgaagggataccggttttccgcacccctcagcagaatgcggttgccgcgatcaccctcctcgacaccctcctcaaggaaaacgagcacaatcaatctgatcacgtcgtcaacatcttgaaccagacaaagaccatgattgcggcttcggttccagttaactccgaaagcgtccacacgccgactggcagccgactcccccacttccgatctcatgattatcgtcatctgagcctcagcatcaccggcgcaggatccaaccgcaggagcaggggccacgacgagcggtccgtccactcgcctcccgaccaccatggggagcgccgagtggaatggcctcgctcaccacctcgtcgccgccccgtcgatcttcgtgacacaatcatacagcgccgagcagctcgaggccgtcatcattattcgccagaccgccacgacgacgaccttgatggagtagcagccttcaccgacgacctgcgtcgagtggattggccagccggcttcaagccgactggaatagagaagtacgacggtaccactaacccagaatcgtggcttaccgtctacggtctcgcaatccgcgcagcaggaggagacagcaaggccatggcgaactatttaccagtggctttagcggattccgcccgatcttggctccatggattgccccgtggtacgattggatcttgggccgaattacgcgaccgcttcatcgccaacttccaaggcaccttcgagcgtcctggcacacaatacgacctttacaacgttattcagaagtccggagaatcccttcgagagtatatccgacgattttctgaacaacgtaacaagatctccgatatcaccgacgatgtcattatcgccgcattcaccaaagggattcgccacgaagagttggtcggcaagttcggacgtaaacctcccagaacagtcaagcttatgtttgaaaaagccaacgagtatgccaaagccgaagacgccgtcaccgcatcaaagcagtcgggtcctagttggaagccaaaaaatacgccggctacgggaggaggtggaagtaacaatcataaggaccgcaagcgtaagcctgaggaacttgttgcaaccgccactcattcttctcgacagcgttcgcgcgtcaacacgttcgacaagatcatgaactcccaatgcccgcaccatcctaactccaaccacgtggccaaagattgtttcgtttacaagcagttcgcggagcaatacaccaagcctacacggaagaactccgacgaagaacaaagcacgtcgaggaagaaggacgacggcgacaccccggcaggatttcaagaccaccgcaaggagctcaaccatatcttcggcggccccctggcttatgagtctaaaaggaaacaaaagttgaccgaacgggaaatcaatgctgttcagcccgacacgcctcaatatcttcgatggtcagagattgcaatcaagtttgaccgctcggatcatcctgaccgagtggtccacccggggcggtatcccctggtactagacccagtggtccgtaatgtcaagcttcgcagaaccctcatcgatggtggcagtgcactcaatatcctcttcgccaagaccttagatgatatgcagatcccgcgctccgagttaaaaccaagcaatacgccttttcacggagtaattccaggattatccgcaactccactcggccagatcaccctcccggtcacttttggcactcgggaaaacttccgcacagagaatatcagctttgaagtcgccgatttcgagacagcataccatgccatactcggacgcccggcgttagccaagttcatggctgtcccgcactacacttacatgatgatgaagatgccgggtctccgaggagtcctaaccctacggagcgacatcaagcaagccgtcacatgcgacaaggagagttgcgacatggcccaaacccgcgagatagcgtctgcccgagaggatatccgactggctgcaaccacggtgagcgaaggagaagtgcccgctaccaagatttcaaaaagtggagaaagcgaagccaagactaagaagattcccctagatccttctgatcctactaaaactgctgtaataggcgccgagttagattgtaaataggaaagcgcgctcatcacctttcttcagaacaataaagatatctttgcgtggaaaccatctgatatgcctggtattcctagagaggtgattgagcactccttacaagttaaagaagatgccaagcgtattaaacaacgactccgccgattcgcacaagacaggaaggacgcgatcaaggaggaattgaccaagctgttagcggcaggcttcatcaaagaagtccatcatcccgactggctggtaaacccggttttagttcggaagaaaacggggcaatggcgcatgtgtgttgattatactgatctcaacaaatcttgccctaaagatccttttgggttgcctcgcattgaccaggtagttgactcaaccgccggctgtgagcttctcagttttttggattgctactcggggtatcatcagatctgactgaaggaatcagactgcttgaaggcttcattcatcacgccctttggagcatactgctatgtcaccatgccgttcggactaaaaaacgcaggagcaacttatcaacgtatgatccagagatgcttctcaacacagatcggccgcaacgttgaagcctatgtggatgacgtagttgtcaaaaccaagcaaaaggatgatttgatcttggatctagaagaaaccttcgcaagcatccgcgccttcaggatgaaattaaaccctgaaaagtgcaccttcggagtaccgtcaggaaagctgcttggttttatggtatctcataggggtatccaagccaacccggagaaagttactgccatcctcaacatgaaaccgccaagtacccagaaagatgttcagaagctgactggatgcatggcggcgctcagccgattcgtttcaagacttggcgagcgggggatgcccttctttaagctactgaagaaaacagatgatttccaatggggacccgaagcacagaaggcctttgaagattttaagaaactcctcaccaagccgccggtcttagcctcaccatacccgcaggagccgttgttgctgtatgtgtcagccacctcccaggttgtgagcacagtcttggtcgttgagcgtgaggaagaaggccatgtccagaaagtccagcgaccgatttactttgtcagcgaggtcctagccgactccaaaacgaggtaccctcaggttcagaagctgttatatggtattctaattactaccaggaagctatctcactactttcaaggtcactcggtaacggtggtcacatcatttccacttggcgatatactgcacaaccgtgaagcaaacggacggattgctaagtgggctttggagttgatgtctttggacatatcattcaagcctcgaacttcaatcaagtctcaagcgttggctgactttgtcgctgaatggaccgagtgccaggaggatgcccccacggagaagatagagcactggaccatgcattttgatggatcaaaaagactttcgggcactggagctggagtggttttaatttccccaactggagaaagattaagctatgtgctttggatacatttttcggcgtcccataacgtcgccgagtatgaagcgctccttcatggactgcggattgcaatttccctagggataaagcgtctaatagttcgaggcgattcacagttggttgtcaaccaagttatgaaagagtggacctgccttgatgacaacatgatggcatatcgacaagaggtacgcaaattggaagacaagtttgatggactcgagctcaatcacgttcttcgacacaataatgaagccgccgacagacttgccaactttggatccaagcgctaggcggcgccctctgatgtctttgtcgaacacctttatacgccgacagtacctcacaaagatgctactcaagttgcgggcacccatgacgtagctatggttgaagccgactggcgagagcccctcatacgatttttgacttctcaagaactcccccaagacaaagatgaagccgagcggatttcaaggcggagcaaactttatgttatgcatgaagctgagttatacaagaaaaacccttcaggaatcctgcaacgctgcgtatctttagaggaagggagacagttgctgaaagacatacattctgggatatgcggaaatcatgctgccgcacgtaccattgtcggcaaagcttaccggcagggttttttctggcctactgccgtgtccgacgccgacaaaattgtgcgcacgtgcgaaggttgccaatttttcgccagacaaattcatctaccagctcaagagttacagaccatcccactgtcttggccgtttgcggtttgggggctcgacatggttggcccgttcaaaaaggcagtcggcggttacacacacctctttgtggccattgacaaattctccaagtggattgaagctaaaccggttgtcacaatcacagcagataacgctcgagacttcttcctcaacattgtacatagatttggagtgcccaatcggatcatcactgataatggcaggcaattcactggcggagtttttaaagacttttgtgaagactttggaattaagatttgctatgcctcagtagcacatcccatgagcaatggacaggtggagcgagccaatggcatgatacttcaagggattaaagcgcgagtttttgaccggctaaaaccttatgccggcaaatgggtggcacagctgccatcagtactttggtctttgcgtactacacccagtcgggccacaggccagtcaccttttttccttctctatggggcagaagcaatgttgccgagtgaagtcgaattcgaatctttgcgctttcgtaatttccgcgaagaacgctacgaagaggactgagtggatgacttgcatcgactggaagaagtccgcgaagcagctttgattcagtcggctcgatacttacaagggttgcgacgttatcataatcgcaatgttcgatctcgtgcctttctagtcggcgacctggttttgaggaaaattcaaactacacgagatcggcacaagttatctcctctatgggaagggccatttatcatctccgaagtcacccggccaggttcctatcgactcaagcgcgaagacggcactctcatcgacaactcttggaacattgaacatcttcgtcgcttctacgcttaagcttatcattgtacttatctatcttgactgtcaacatcaagttttcttcttgaagttgtcagtcgggggctatcatcataataatggagtgtgattttttttttatcaattcaatttgcttacttggtctatcattgccttgtttggtttttctacttagtctgcgaggactgaaagtttttaatagcttctttgggttttaggctcaacaaagctggacaaaagcttttaagaaatcaacgacttggctagaattatcaagcacagcataaatacaccagtaattgtacaagttgagcctccatttgttacatctatgctcagtcagaatcagtcctttcatcatcagagttattgttacttggctgaaggtcgttgttgcggaattgctctacaacgtcacttgcaattttgtcagccgcattttgagcattgctgataagatcaagagcagcctctacgcttgtcccgtctgcaaagccatcaatggcatcaatttcaatcctcgggtacaaggacttggtcatcgccaatgccgtgctagctcccatacttccagctttcttgatgttcttgaaatatacatccggagcaactctcagcttgtcgaagatttcggttgcgtcgagtgcactcggaccactgttattgaggaacatggcttggatgagtggagtagcgacattagcgacttcatctcttgctccttcaagcttcttgatcttaccaaccaggacgtcgaactgagcttgcgatttgattttgcggtctacagaacacatttatgataagaatctgctgcattaaaaagagagaagttcagattgtcagctggcagtaccttcaacctccttcaaggccgagtccctttgtgcagccagttctgccttgtctcttttcagggcttcaatttgtttttccatttgagccatcctggcggcttgcgctgtttgaaatccaaatgattgaggatacagttacgacaacataaattaatgggaccgatctagagattaccttttgacgaaccactcagctcgaagtttgaatcctggagctgagtaattcgctcccttaattccttctccgtctttttggcgagctccttggcctcgtgtagctggtccctaactgcttcaagagttcccaaatgaggaaccagcttttctaaagttacggtcttggcctcattgcgaagatggattctctgcataatggttcatggtttagttctgctaaagagaaaacaaagtcatcaaaggcagtcgcccggaagatttacatttacaatacgagtggcttctccaagcgccttcttcagctggcacacttcctcatcttctttttgacgatttatgacgatgccggcagcttgtgagttctcatcccaccatttgagtaagataggaggacgagagtcatcagccgcctttatgcggagaatttcttcttcgtcatcgcctggtggccctgatgtatttccaagatgttaagcgaataagcaggagttgttcaaatcggcatcacttggaaagatgagttacctgaggatgttcccagctgagcgtgaggtgatccttgttctttatttggagacccaatcatcgagtcgttaccagcttcaggtccttgagaagtcgtcgtctgtgcttcaacttcgggaatttcttgatctggacctacatccgactggtttccagtcgggggctcttgggttgttgtagtttcagttgctgccgactgatttccagtcgggggctggtcactcgaatcggccttatcacctgaagtatgggcgccagtcggctggctctcgccagtcggctggctctcggcagtcggctcagaatccttggaggaatttggctctgtcacagccggatcaggatcttttccagttggatctatgtcagatggtttcctgcaaggtgttctttcaatactcagtattattttcatgaaaaaaacatgccgaagtgaaattataccaagaggttttatacctggaagatgttctaatctttggcattgggcggttagctagttttttcctaagcattgtacgctttgggagtttattaggcgagcccttgtccccagatctgttgtcgtcatcgccttcatcgtcgtcaagcactagttttctcttgcgagaacttgtctgcccagtcggattggaagtttgaggttgtggatctgatctgattgtcgattctccacctccttgaacggtgtgctggcgaggagaccggcgctgagtgattgggggatcagatttcatcaatacatattcctgaatgagatgcatccacggttagctaaatcaacatgaagacaagattatgttttggtcataggttgaatatttcagatacatacctgcggaggcggattgaatgcgttatatggcacaactggcagctgatgtgagtagctgacgacaatagcatttgagaagattttatacattctctccttcatgattttgaaatccagagaatctggttcttcacgattaggatcatgcttgccgtcgaactcgaacgctgtgcgggatctttctttaattggcgccagtcggcatttaatgaaatgccgagtaatctgctctccttgtaagccttgttctttgagttttagcatgcgatccatcaactccaaggcttgggcagcttcatccccaatcggaagagagttccaagtctcttggtataccggaggaaggcaagagtattcaggaagagcaggctcaggattctgaacataaaaccagttcgcatgccattctttgtttgaagtcttgaaaggcatagagaagtatttctggctcagagtgcccctcagctgaaatccggcccccccgactacgcatggcttactcttgttcggttggggcttgagaaagaagattcagcgaaacagagcgaagtggggcttaatccccaagaaggcttcacaaacatggacgaaattggcgatgtgaactatggaatttgggttcaggtgatgcaagctgattccatagaagtttaaaatcccgcggaaaaatttcgaggtcggaagagcgaagccgccatagaagaaatgggagaagactacaacctcatgtgtatcgggggacggaaaagcctcaccgtgcgctggccgccacccgatgatctccttggcagggagaacgccgtgcgccaccatctccttcaggttctcctccgtcacgtcggatgtcgcccattggccttcaaagctttctttctcttccgccattgatttcactcgaatgcgctgatttgattcgagggatggctagggagaggcaaaggattaaggcggtggatcacgggagagattttgatgcacttttcgaaggtggatttgagcggaatggtgaaccctagttcgccggcgctgctttgcactgttgcaaggagtggggaaaatggcgagagttccggcggggaagacgaagcgtcgcttggatctcgggttttcttgttaagggtatcggaggtgcaaatgggcctaggcctgaacagtacctcagcccagtatttttaacagcgtggcccattgtgttccttagggacttaggcattttttgctttggcaatttatgcgcacaatagtattgcccaatgctgataaattcctttttatgcggtcatataattctttggaattaatgctatgcaaattaaaaggtgcccgacagaaaggtattatgctgtttttgtaagcttttttaggctacaaaagctgtcagggttaatttggaatgacttgtttttatcatagtcatttccttggtatgttatatacctgttttcattatggtaaatagtcatagcctaggctattggacttattcattaccataatttttataatacttggtgggtaatttttagagttttttattcggatgcctgtcaagtatgttcattcgtgaaccttttagagtgtaaaccactcggattccttttattacggctaaaaagcagtcggctagaatgcctctttaggcgccgcgtatgcttttgtcatatgatgcataactgtgctattattttgttctcaactatatgtttagtttattaactaatcacatagttgggggctacacctaattaggtgcatctattcgatgcaccatattctttattttttcgccgtttacagtctttgtcttcgctattcagcagatcttggcatgaannnnnnnnnnnnnnnnnnnnnnnnnnnnnnnnnnnnnnnnnn

SEQ ID NO: 43792 - DNA, 9463 bp, Oryza sativa
gaggcggagatgagagggagaaggagccgaggaggaggaggaggaggaggaggccgctggtggatcgagaggaaggggaggaggatgagagactaagaggaaagtggcggtggatttttttaatctgatggggtttttaatatggcaatgttttcacagtgcagtgctcttagtggccgtcagcaaaatatctaatttttgttaggtgtcacttaagaggactgcttgcgaaaatgacatatctttgctggcggttcacgttacacaaccattagcgaaaatagtcacttaataggaccgcttgcaaaaatggcatatcttcgctggcagttcatgtttcacagcagccggtgaaaatgcattttcgctgacggttcttagcctccacccctcgttacatttttgctagcggcgctatcgtctggctgccagtgaaaaaaaaaaggtgccaccttgaaaaaccttttttttagttgtggcaccggcatgatttcatcttccttctttgttttagtttctatttgattcattgtagtttgtgtgttcgaatggaattgctatgaagtgtgtatatgaactgcaagttcttttgatcctgtcctgtgtgtgtgatcgctaaagaaatgtgtatgtatggaactaaattgttgtcgattacctcgggaaaaaaatgttgtcgattaacgataaaaaaaatgtcatataaatcaaattatattttcttttttcctttaaatgagtatcaatggcggtttatggttatcctgcatacactgtatatataaatgtcaccgaacaaaatcgaatgttttgaccatgatgcttatccaaaacgacagtgttcatcaacagatcatcatcagaacggtgaattcctcttacttttttttttttgcctaaaagagtaggttacgttgttgtacgggatcagagaactccggcctctttattctttgcgtatgcaacaattttggatgggcatgtgcgtgaatgaggcgaattttgagctttgggagagaggaagtagataggatcatagaaaacgagacaggttgacgatctctttcggagtccacaaaagtgctgaagacaaatgatccggccggtaggatccacggacggaggaacctaccaggaaatccctcctacgacaatgatttaattcgatctgacaactgtgtcatctggagacatatactagtagtgctccatatgggcccacgtatttgtactctttttcacacatgtgcatgcaaatagtatcaaaatcgttataaccgataataatattagtacggtatcagtttaatgcctcgcaagtactcatgctaattaatcttgttgttgaggcaggtaattcacttgttcgttatttttcctagtcaccaaaaacagagcatttaataatgttagctctactcattgatcaaatcaaacaggaggtcgatcaattttctttatgcttattactgctccctccgttttataatcctccgttttatattataagtggtttgacttttttatagtacctttgtttataagtttatagaaaatttaataacatctaaggtggtgtttggatccagggactaaactgtccctatcatatcggatgaatttggagtataaaacataaactacttataaaactaattatataaacgagagctaattcgtgtgacaaattttttaagcctaattcatccataattagtgcatgtttactgtagcatcacataggttaatcatggattaattaggctcaatagattcgtctcgcgaattagtccaggattatagaataagttttattaatagtctatgtttaatatttataattagtatctgtgataggtagggagttttagtcccatctaaacaaggtcaaaaatataaaattagttttactaaatctaacattaaatatagtttgataatatatttgttttatacgaaaaatatttctgtaaatataatcaatatataagtttgattagaaaaaaaccaaacgacttatatgaaacggagggagtgcgtaattggttgcgtacttagacaatcatgcatattcagaaggtcaagaagtcgtttaccagtgaagtcacgcggttggatttagtaaacagggagctctttaattacttcttcctttttttcaatatatataacaccgttaacattttgaaataaatttaaccactcgtcttattaaaaatatatataattattatttattttgttgtgattgatttatcatcaaatgctttttaagtatgacttaaaatattttatatttgaaaaaaattaaataacacttggttaaacgtttgtcaaaagtcaacaatattaaaaaagtggtagtttttgctaaggctttgtttttccaatatattttttatgagtatgagaggggcggggatttatccgtcccttacttctttttcgcttgtatacatacatgcactcttttccaatagataacacttttaaataatgattttgctatatctcacacgaaagattttttcttatctctcactcgattttctcactcaaatttacagtgcattttcttgtaagttacagtgtaatttatgaaacttacactgtaacttttgtaagttacactgtaatttttgaatcttcgcatgtaaattttaaattttgtattggatttggtctttttcttgaggatatggtaatttagtgtccattatggtgtttcttaattgctttttgctttttattatatctatcggattttaatctaaagattaaaaatctgtgtgatacgatcgtaaaaatctttcgaaagatgtataggtactccctttaaataatatctaatcatttgttttattaaaaaccattgcaaatatgctaaagtgtaggtcatatttatattttttaatgataaaacatgttgcaataaaataaataatatttatatagatattttaattaggaagaatggttaaacatcgtgtcaatagtaaatattttgctcgcacgtcactatggcaaaggccaggataaaatacatcttgtgcaacgataaaatatcttctttacctacaaaaaaacactaaatcggacaggaaggacgcaatttgcagatatagtacagtttggactttggaccaatgattaaatcacaacaatccagtgggtttgctgttggcttccaacttgcaggcagcatttgtgacaactgaaaactaaacataaactgccctctcgtggataatcctgacgtcttgacgcacgtggtggtccatccttcacattggcgtcagttcagatttgttatatcaattgctgatgcttttcttttgtctcgtagtactaaactaaactgaatctggttttgacaatttctttttccaatgcagatagtgtttttcttttttcttttttgatttctttcttcttgatttgttttgcgtggagtacaaatagtgttttctttttctggaggtgaagcactcctttctcaatccgtacgtcaaatcactcaaggcgtatatacattatttattcgtaagattcgcagccaaacgcgttttatgtggtatcatgatggttgtagtctccgcggcgactttgagtaaaaggagaggcaaaatttggctcgttttgatttgattattgaacagatttacagattattgctaagaattagtactatctttgtctcagtgcagttgtgagattccgaattcaacttttaaccgtatgtcttatctgaaaaattatattttttcaaaaaagaatagtcacacataaagtattattcatgttttataatctaataacaacaaaaaaaaatactaatcataaatttttttaaataagacggacggtcaaacgtttgatataaaaaaaatgaaaaactataatctttctaggatggaggttgtcaggttacggataaggtataccctctattcttagatgtacgctatacgacaatataatatatctgcgcgtatacgaacgttctctatatacgctaaggaaattcatcatggagtccacagatggaaagattcctacccggataggaatgggtcgttactgtatcgtgtagggtccgatgtctccgagtcctacttggaaaccacctgacctgcggtataaaagggacccccgggaggacataaggcatcgaatctcataaataagacaaccaccacagcctacgaagtcaaagcctacaggagccaagccgccgggtgatctagccgaaccaactcgactacgatctcgtcagtatcatcgagttctgtcattccctttgtaatttgtggttttcactatataatcccataccaactgaattagggctattacctatcaaggggcctgaaccagtataatctttgtcttccattttcttgatgtcgtactacgtagatcctcgtaccagcgtacccaataccctctatatctggtctacgggtacccactgtcgacagtggcgcgccaggtagggggccttggtgctcaaggttctactgctatgacatcaagcttcgtcgacaacagcgtcaacaccggccccatccaaggagtctctacttcaacaatgctggtgtggactcaagtcggcgaaatcgtcttctcggtttacaccacggtactaatctcggctggtccatcaatgaccggaaacgagaacgccgtggctataaccccgggcgactccatgtcgaaggatcctcccgccgtagcggagaacggaacgtcgacgtcatacgagcccgagaaggttcctagtgcggccaaaccttgtccttccgacaagaaccacgagccgacaaggacaacttccgaggtaacaaagccctggtgtcctatccacaagtccatgaaacacaacttgcaagcttgctgagtttttctcaacgtacaagctgaaattcgtgcctgcaaggagcatggaatccagcgtacttctccaactcgtgatgtctattgtcccattcacaagacgaagaatcacgacttctcaagctgcaaggtccttctccgcgccatgaagacgccgcttcctaaggtccagcaatcagaaatctctcttaaggatgcagataaggaacaaggagcgacgttgatctcgaatcgatttattggagtaatcaacatcgatccccacgagccgtcagtcctacacttgcttgaagactatggctcgtcatcctccagcacaccacgtgacgtgtttgccatcggtgggactagcacgtctatgcacactaacgcagagacggggaaccaggcggtcacgctggcccaacacctcgacaccatcaatgcaatactgagagaaactccctatgatcctatacttaacgatgatctcgcacgatagacagaaccactatgggaatcggtagccaatctcagtaacgcgttcgaggaggccgctaccagagcacaaccagaacatccgacagctggcggtgccgacggcgaaccaccggagcaacggacgtcgcctagacgagctacccctccacctcgcggcaccggcgatctccatgaccatctgaatggctgccgagaagcacgacgcgcgcgagacaacgagaatcgttcccgacatcgtgtctcttcatgacgtcgcgagaacgaagagcgaggaggccgctcgaacgaagaccgactccatgataatcgtcacaaccgccatgaccgcgacgatcgcgaacagcagacgccggacgatactggtcgaggacgccgacatgacggtgatgataatggggatcggcgccaggaaaacaatggtggacgacgacagaattctcgagaacccgaacgtcgctctcggaatcggacaccggagccgagtgacccatcgtcatcatcatcatcgtcatccggtagacatccacggaggacatatgatcgccaacaccccaccgcccccagcgccgggtgtagagctttcaaccgttctctacgtgatgtccgatggcccgagagattccgacccggggcaatagagaagtacgatggcagtaccgacccagaagaattcctccaggtctactccacggtaccatacgctgccggagcagacgacaatgcgttagcaaactatttgccaacggcgttgaaaggttctgcgcgttcgtggctgatgcacctcccgccctactcgatttcttcatgggcagatttgtggcaacaattcgtcggtaacttccaaggaacttacaagcgccacatgatcgaagatgatttacacgcgttaacacagaatccgggcgaatctttgagggactacgttcggcggtttaatgattgcagaaatacaatccccgaaatcaccgacgcctctgtgattcgcgctttcaaaaccggtgtcagagatcgctatactaccctggagttggcaacaaggcaaatcacaactactcgaagattgttcgaggtcgtcgatcgatgcgctcacgcggacgacgcactgagacgcaagaacgacaagccaaaggcggggggagagaagaagccagccaaggacgcacctgaaccaagcaagaagaaaagcggcaagagtgggaaaaggaaagctcaagcggaagtcttcgcgtctgaatacgagcgccctcccaaacacccagacccacaaggcagtgacacgaagagaatatggtgccccatacacaagtcggacagacattctctggaggattgcctcatcttcaaaaagtcgctggaaaagcaattggtattgaagaagggcaagcaagtacgtgtcgtcgagaaagccgttgaggcaaccactcaggactcagactcggcatacccagattccgatcttcatgtcttgcacatcttcggaggttccacggcgtactcctcaaagcgagaatacaagaaagtggagcgtgaagtttgttcgacatggcagggggctgcacccaagatgaagtggtctgaacagaagatcgagttttcatatgaggaccaccccaaggctattgttatcccaggatgatatccgatcgtggtcgaacccactattcggaatatcaaggtagcgtgagtcctcatcaatggcggcagctccatcaatcttctcttcgccagcaccttggacgcaatggggattccacgaagcgagttgacacccaccgatcaacccttccacggaatcactcctcagtcatcgtccaagccattgggaaagattacgcttcctgtgactttcggccaagcgagcaacttccgaacagagcaaatcacatttgatgttgctgagtttgacacagcatacaatgccatcatcgggagaactgcactcgcgaagttcatggccgcatctcactacgcatatcaagtactcaagatgcctgggctgaagggaacaaccactattcaagggaacgcaaagctgacggtccaatgcgacaagcggagcctcgacatggtcgagcacacgcccagcctacccgccacagccgagccacccaagaaagtgagcaaaacaactaagacgccaaaaccagacggcgcaatcaaaatcgttccactctccagtgccaatcctgacaacacagttaagatcggggcatcactaaacgagaaataggaattcacgctcatcaacttcctctgcgacaatgctgatgtgttcgcttggcagccgtccgacatgccgggggttcccagggaggtgattgagcacaaactcatggtgcgacccgatgccaagccagtaaaacaaaaactgcggagatttgcaccagatcggaaacaggccatacgagaagagctcgacaaacttctcaaagctggtttcatcagagaagtactccacccagagtggctagccaacccagttatggtgcggaaggccaacgggaagtggaggatgtgcgtcgacttcaccgacctcaacaagacgtgccccaaggatcacttccctctccctcgaggtccgacacgtataccaaaaggacaacattgaaccagacgatctggcacggcgtgcgtccagacgagagccactcgaacccggcacctttctagacatcctgacaaagccatcagtgaaagaggcaaacgacgaagatagcccagtcgcccccgacatcagctcgggggctacagaggcagagcgcgccgttgccgacatcgagaccacggacgactggcggaccccactcattaaattcataagcagtgacgagttgcccgaggacgatgcagaagccgagaaaataacccgtcaagcaaaaatctactgtatgatcggcaacgatctatacaagaaggcgccaaacggggtacttctcaaatgcgtctcgtccgacgatggcaaacacctcctcctcgatatacatgaagggatctgtggatcgcatgccgctagtcgtacattggtcggaaaagcctttcgacaaggatttttctggccaactgccctcaaagatgcttgcgacatggtacaacggtgtgaagcttgtcaatttcgtagcaaacacacaaagctaccagcataagcactgcaaaccatccctctcacttggccgttctcatgctggaggctcgatatactcggtccattcccacgaggacagggcggctacaaattcctgttcgtggcgatcgacaaattcaccaaatggaccgaagcaacacccacgggggaaatcagggccgataacgccatcaaattcattaaagggatattttgcagatatggattgcctcaccgcatcttaacggataacggctcccagttcatcagcgccgatttccaggattactgcatcggactaggagtcaagatctgcttcgcctcagtttctcaccctcagagcaacggacaggtcgagagggcaaaaggtatagtactacaagggatcaaaacccgagtctacgacagactcatgtcacatgacaagaagtgggtcgaagaactcccctcggtactttgggccgtgcgcaccacaccgacaacgtccaacaaggagacacccttctttctcgtgtacttctcagaagccatgctccctaccgagttacgacatcagagtacacgagtacagaagtactccgatgaggatcaggaggaatagcgaaacgatgacgtgaacctaatcgaggaacatcgagaacgagttgccgtcagggcagctagctaccaacaggctgtcacatcctgattttcgtttcaggatttataaattatttaataaaataataatagaatttatattaaatgacctttaatttacaagtgaagttaaatgtgggaaataaaatttcctaaatataaagcatggatggatttaattttttttattaaattctccatgattaagtcaactctctgaaattttctcggatttttcagagctcaattcctaaatgttacaaagaacagttcagtaataatttgatcattaatgatctaattataattgttaagagtttttcttgt

SEQ ID NO: 43793 - DNA, 29111 bp, Oryza sativa
gagcctatactatgccatcctctggtatccttgagcacttgcatatttgctgtgtggcttgctgagtatgtcatatgctcatccttgcaataatcaatcatcctcagttgaagtcaagttgcgaaggagaagacgtttggcttataccccagttgagctgcctgtgggagtggagccggagcttcgctagattttatttttccgctgcagttttcttcttggtgaggactaagtgcctcttaagtaagtatttatcgttttagttaatttgatgaatctgtatattaaattgtcaatttgtgtacctcggctgattcctggacgaggattttatgcacaaataagtttggaaattactagtgaatttccgggcgtgacaagttggtatcagagccatctcgactgtaggataagccaaatggtcaaaccttaaggactaattttccgaaaacatgatttttgaaaattttcctttcttccttctctagaattctctataaatcattttatcatcctcttccctcctgctttcaacttgagtagttctaagacattgaaacttgaagacgccaatgaggtctacttatggaggttaagtaaagtggatcgaggaagaactgaagtgcccagatgtcaagatggaatgaagttggcatcctaccttagaacctatgccgccaaagtgtccttggagaatagttagtagggtagaacgcttgttgcttgcttgtgtgtaggtatggttgcattcccgtcattggagtagttcagtgatgagcgtgtaactatactaggttgcttgcttaatcaacttaaacaatataatggtctacacacatcagatcagtgttaacctggttaaggtcttgtctttagtgtaactcctctcctcctatcttctctaatctgcaacagatggtgaacactcgtgccagtggaagtggaaacaataacaatgaagggaacccaactcttgctcaagttctggctcaacagactcagttaatgaacatgatgatacagcagatgcaaaaccagctcaaccaagggaacaacaatgctccaccgccgcagaacaagttagctgattttcttcgtgtgaggccacctaccttttctagcactaccaacccagtagaagcaggtgattggctacacgctgttgagaagaagttggaattgctccagtgcacagatcaggagaaagtcgtgttcgtttcacatcagttgcaaggatctgcttcagaatggtgggatcatttccggataaacagagcagaaggacaaccaatcacttgggcggacttcacggaggcattcaagaagacacacatacctgtaggagttgtttctttgaagaaacgtgagtttagggcattgaagcaaaaggatcataccgtggcagagtatcttcatgagttcaatcgtctggcacgttatgctccagaagatgtacgtactgacgaggaaaggcaggagaagttcttggaaggcttaaaggatgaactgtcagttacgttgatctcccatgactatgtggattttcagcagctagttgacaaagcaattcgccttgaagacaagaagaacaggatggataaccgtaaaaggaaaatgactgtattccaggaggcacaaggtagtagccagaggcagcgtatcaagccactccaaattggtggatcttcttccgctggtcaaggacagtcgcaaccgttgaacatcggtggtgagatcaaattagagactaatgaaagcaatgaagttaacattgagcaagctaatcagccggtgccagttcagcaggatcagtctcaagagaataacagtagtggaagggagcagcaggtatgtttcaactgttacaagccaggccactttgcaagagagtgtccgaagccgaagcatcagcagccgcaagtcaacaacattgtcgtcacaggagccaatgcagtgccagttgcgtcttcaagagttgcgttttcaagtgttacagctcagccaccagtttcaaagcggcagtagttttctttaaagccttagaataattatcggagttatggaataagatagattgcagtttacctatgcccttttctttctagccgttccgaatctcgggacgagattctttgtaaggggggtagtttgtcacatcctgattttcgtttcaggatttataaattatttaataaaataataatagaatttatattaaatgacctttaatttacaagtgaagttaaatgtgggaaataaaatttcctaaatataaagcatggatggatttaattgttttattaaattctccatgattaagtcaactctctgaaattttctcggatttttcagagctcaattcctaaatgttacaaagaacagttcagtaataatttgatcattaatgatctaattataattgttaagagtttttcttgtttaaaaatccttaaattataaattgttgtttaaaaggaattattagaaatgattttaaaagcctagaagagaagatctaattttaatttgttaaatctcaatataaaattgggctagataaaatttcattaaatactttgcttaattctataattcctagatttttctgggatttatttgagctaaggaagtatttttaataaatgggattgcatttcatgaataatttaaattgaaaaaggttttaaaaagtcttcttttggctttgggccgaaagccggcccaaaaccctctctctctctccctcggcccagtccggcccaatccgccgagccgccgctctcctctctctctcagccgctgacaggtggggcccgtttgtcggagccgtcttcctccttcggccgccgccgcccgaaaccctagccgagcgccgccgccgtctccttccaaaattcggtcgatcctttccttctccggccgaattgatagaggggaaatgatccttgagatctcctcttccttttctcttttggaatcatcgcctaattcggtttggaaatccgtggattcgagttcgattcggatcgacctctctcctccgaaccctagctttccttcgccgtctccggtcgccgtgggccttcgtcgccgcctcctagcccctttaaaaggacccccgagctctcctctacccgctgcctctctcgccttcgcccgccgtcgtgtgtagcgccctagcctcgtgagcttttgcgccgccgtcgccgccgttcgtccagccgtgcgccgccgtcgctacggtcgtcgtcgtcactcgggaaggccaccgtcgggatcgccaagtcgtcgccgtcctcgtccgccgcttcgccgccgccgaagaccgccggagcaccgtcgccgccgtcgacccgatctccgccgccgcttcttcctcgtcgccggcgctgtccgttgcccttccgccgtggttttggtcaccggtgagttcgccgcgtcgccctctacccgttggtgccctccgttcgcgtcgtcgagccgtcgttcgccggcgagcttgcgctcccgagccgccgccggagctgacgtcatcgctgacgtcgtcgctgacgtcatcgtcgtcgccctctcccgtgagccggtcgtggaccgatcgatctcggccgtccgttttcgtgaaccgccgtcgtgcgcccggtccaccgaaaccctagcccgctgacgcaataatccttcttttccttttcaaaaataattcattattgcgtcataattcaattaaaatccatataaaggttttaatccgatttaatctttaaaaattcataactaattctttgtaactcagtttaatgtggttcaagttgcaaaagttgtataaaataaagatctacatattaaaattgtccataaattgaattaaatttatttaattctttttaaatgggctttaattatatttaatcttgtaaaattcataataaattcatttgaagtgagaatgaggccgttcaagtctcataattcatctaaaattatgatctacatgtttgtttactttttatgtattgtttatttggttttttattagtctttttcttcgttttgcgtgttagcttgtcgtttccgtcgttgcgaaggttcgcgagtgcgccggaagtgttcaagaagattaattgaagaccgattattgcaaggcaagtcacacagatcctaaacacaatcctttaagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagatatgattgcttagccatgcttagaaacattagcacacaattgggataactaatgtttcactatcacttatggttatatttaatgatagttcacgatggtcaatcgtgattgattaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatggttcattgcggagcacccgactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacgcatggttgacatgatgttgaggctgtgtcttgtgggtacagtggtacacctctggccagagtaaaactattcgaatagccgtgcccgcggttatgggcgggttgagcaatgtttttcgtgattagtcccacacctctcacaatattttttgatgttatacctggtaataatttgcttagctcctggtttggagattagatctgtacagccgggtatggttgttcaggatggttgggcctgtgcagcatgggtgtgctgttcagtgttgattaaaatttctgattaattactccactgttttatttctcttaaatattttgctaaacgctgcttttgcaaatgagcctatactatgccatcctctggtatccttgagcacttgcatatttgctgtgtggcttgctgagtatgtcatatgctcatccttgcaataatcaatcatcctcagttgaagtcaagttgcgaaggagaagacgtttggcttataccccagttgagctgcctgtgggagtggagccggagcttcgctagattttatttttccgctgcagttttcttcttggtgaggactaagtgcctcttaagtaagtatttatcgttttagttaatttgatgaatctgtatattaaattgtcaatttgtgtacctcggctgattcctggacgaggattttatgcacaaataagtttggaaattactagtgaatttccgggcgtgacacaggcctccgccggtatcacgagaagcgcatccgagcacgcatactttcgatcggcgactacgtcctccggcgagttcaaagccaagcagggcgaaacaaactctcgcccaaatgggaaggaccgtacacgatcacacaagtcttgcggctaggcgcattcaagattgcagacggtgatggtcgcgagttagcaaattcttggaacattgaccaattgcgtaagttccatgtataagtcaatagtatccatacttgtaagacatcttacaacttcaataaagcctgttttcaggtacagatttcaatcaaagtgtcccttcccgatgatcccttacccagatgacacctagcgttgaaacctgtagacccccgattttggaaatcggaaatcttctgtgtttatccatatcaatccctggatcagtagttggtacacacatacatagttggatcacaacatatcatgaatgaattcaggctaaaagagttaaatacttacattagggccaggtaggccaacaactatcagagaacaacagcggaagacaaaataatataagggcccggttaacatgccacaggcagtcgactggggaacgagacctagaacaagaccgcactccgatcatcttgttggatacgcaagcgtaccaacaagggcttctcttcaacactattctaaaagatatataaatagcaagggtgagtaccaactgcactcagcaagccaccacaacaacaatgcatatgatagagggtatttcaaggaagggctccaggttcttttgcgtaaagcaagcttttgcaaatcttttcacaagcctgagacctagcatagactgatcaagttttaataccagtgttcacattaaacaacgacggttctatccaccatccattgtaattccaaggatagcttcccgccattgagtcgtcatggttttctgaggacgtccaccttccctcctctcaggaagtggctccatcagcataaaatcatcatgcaataacccatcccacacaagttaagaatttagagtctagccaagtgtaatacacgtcccggtgctcagtaaccgtgagcacggctattcgaatagatttggtttactcacactgcagtggatgtacacttcacccgcgctctgcgactgcccaacacatgagccttgtcccaacacatgaaacacgtcacggcaaagctttcgataacctcgcattggcagtacccgctccatgaactttagccctcatgcactctaggcgtcatacgtttctagcagtgagaggagttctggcgctcccggaaagggaaaaacacacacattcctacgttgcttcttgtcgttgaacccagtccatcatgattgttctcttatgggtatcctcatgtactattgccaagccagcctctgaccatccggaacgggcatccgccatccacctggccatccgaactgggcatccgctagcagactgcttgccgcatcacacacctaaaagaagaccactacgcatggatactgcctccgctcagctatctactccgctaggtctatacccatacgagaagtgcggttgtacgggggtcgtttcatgcttaacttcatggctcggtccttaactgaccagggacggcactagccttttccggacaccacccaaatcctctagccaccccagtcgaaaacaattgtttcactttattttcctttcacaaatcatgtcatcaatatcatggcaatgtggcgctcatgtctccacatgccgcatctcaattaccttcccaaaggtaattgcccaagcatatagcatttgataaatatgagtatgcatgattctagaatacatttctaagcaatggtcatagttgactggggactcatacgtaatcatggttacaaagatttaagggtaaacaataatcaaggcatggcatattaacaagtaggatgttcattattgcatgcaattttatttgtaaacaaaacaatttcgcaattgggttcaacatgttcaaggaatagtgatgacttgcctgctcaggataattcttattattgatataatcttgatcaaccttcacctcctggaagttgcagacgttgcctcacgactaaccgatacacaaggtctataatacgcgagaaaaaccaatattcaaacaacaagcaaatatgcacaagcaaaatacaatgtcggggtcgaacctagggttgctcgtactattattgcttgccaggggatttcaatcatgctaagggctaaaattcctttaatctctttctatcgtcatcgttgtctatttaggagttaaccaacatagcatttatgggatacatatttggctaatatgtggtttagtctagcaaatggctatatatgcatctatctaaatagaacagttatacactagaggttctgttgccggatggattttggatcggtcaaataattactgtgaatcatttgtattattattttattgatggaggctttattttaattatgtacgtattttacttgtcaaaataaattataaaaggttaacaattacccatgctttgtatgttagaattgtttaggttaatcatattatggttacggattatcccatcacataattttacaataaataatcctgatttacagttgagctataattatatgaggtcaagatttataactagtatttatctaatatacatgtttatcatatattcctttaatttaatacatgcaacaagcaaattgatactataccgtatagctataatgtgatgtacagtatatgtgtatgcacaatatctatcttaatattgaatcatttatttgaatagttgctatttactacaagctactcactgcatgtgattttaagtggatttatgagtgggttaccatctatacaacttaagggtcaattttcaacctaaacatatactactatataggaaatgccgttaactaacttcgtgcgggtgattttagtcacactagctctgttattatctctcatagacatgttattatccctaataaacaagttgaagactcatctacgtgtgttcaaatttagtcacaaagtatgaggctaaacattatttatacaatttggacgtcatgagtatagttatatattgacatatattaataaatggcactagtatttccaatgctttaattaatttgaaacaatgctcctaactagtttacataggttttatagtgaggaagcgtgttaaggacaattatttgacatctactttacagtataatatcaattttatttattagcacatttttaagttaactattatgcatcatcttgatattaattatttaatatttataaatatattttatcaaatagtgaattatataccattggaaagcttatgaatttagatgaatttaggttcaagtttcactcaaatccgagttaaaatgagagagttatgctagtttaaagattcaaatttgaataattgcaaaacagtactgttcctaactcatttatttttattccataatttacattgactgacctgtgggaccggcctgccatggacacaacatatataagtgaattttcatagattttaatcatagggaccccacatgtaagggacttaactaataaagaccaaggggaggattactatttactaatcacgtggggcccactctaacctctctcctccattctcttttctctctctcttctctgttttctctcttctctccctctctcacggccgggcggcgcggcgcggctaccagcgacgaagggaggagggagggcttaccggaccgacggcgacggcggcggagacacggcggcgaggtgcggcgcggcggcggcgaggcgccagggcacggcagcggcggcgcggcggcggaatgcggcgtcggtggaggggaagaaaagggaaaaaaaagaagaagaagaggggaaatggcgtggcgagggaagggaaagggaaggggtatttatagggcacgggggaggggcggccggctttaaacggcgacgggtcggcgcggcgtcgtggggctcagggcgatggcgacgcgcggcgacgggacggcgcggcgcggcgatgggacggcgggcacgacggcgacagtgcgcggcacgggcggggctcgaggcttgttggcgacggtggtgacgcgatggcgcggcagcagcacggggctcggcgcggcgcgggtaacagcaacggcgacatgagcggcgcggggctcggcgcggcgcagccgacggcgacggcaacatgagctgcgcggagataggcgacggcgacgggcgacagcgacgcgcgcggcgcggcaggggcgcggggcgcgaggcggggcgacggcgacagcacgcgctgagggaaggggcttgaggcgacgcgacgcgatgatggcgacggcgacgtggccggcgacgcgacggcgatgggacggcgcatggcagcacggggctcgggggcgcggcggcgatgggagctcggggctcaaggccggctagggcggcgcagcagtggggaggaagagggctaggatggctaggaattccatgaaacacctcatgtgcaatgaatagtgctatccctaattaaaccctattttagccagtcttctatactattttaatcctataaactctaattttacttagttaaatgttaactaaatttaggcactaaatcctcatgaaaatttatccaaaattattaccacccatatttatttatttatcacacaaacgagttctttttagattaatttagattattggccctaaagtgaacttatatatttttgaagactttggggtaatattgaaattaatataacgatgtgtccttattaatacaatggcatatttgtcgagtttctttgtatagcattatattttacacggatagttttaatctatttattctacaaatagcaaattgagactcggtacaatattaatctaattgtttaattaaacacccacgtggacctattttatgtataaagcttattttatttatatgaccattattttatatgagtgttttgatcaagtgttcaaatattaatgtatatatattcccatgaaatactcatttgtaaataggatcattatagtggtgatcgtcatttcatgtggatttataatacttcatgtgagattggatccaaatacattagatttaatcttactatcccattagttagttaaacctgacatcggcctatcaaaatggttcgaatatttaatatttgatttgtgatttataatagaaattaacatttgacttgtactttatttggcttgctttcttgtgcactaatatttgtagggttaaacgtaaataatatattctcgtaaattacatctattgattaaatgtagatcttttctttactttctttgtgattacttacggtttggcaagcaacagcaatcataacaaccagcatgatgcaaaagtttttaaaaagttcgaaattttagtgatttttattgtcgggaattttcaggatgttataaaacctatcctcatgtccctttacgcagtcttgataaggcctccgaggaacctaagggaacttcggctggggacgcctagtgctgataaggccttgtcggatcctatagagacgaaagaccatgtaagatctggtcgtgtaagagttctcgccgtgcgtattaactaggacgtgtaatcggaaatggactttccaacttcacggctgggggttaggatcagtgcttgttcgagtaaggcaggtcaaaggtcccagagccttatcttccgagaagaattctccgatgataaggctggggcctagggagagtgtataactcaagtgactgatcgaagtcgcgaagtgagaaaacactcgtacacactccatccggagtaagaaagcttagctagatagattccttctctattttcaagtatttcttacagtccacaaaaattcaaaatatattacactctaccctgagatatttatcacaagatacggagactaccaagaaggccaacgccagtccattgactgaaagactttctccgcaagcggcgccatcgacttcgccagctggtctatctctgcatcagttctccaagaacgtgcgaacccctcgtggaggaactcaaggcgcagctgtggatggtgatctcgtatacaggccagcacatgccctcctgcatatcggctcgaccgacgacactcctgcttcaagacctcgttgatacgcttgtcgataccttcaagctgggcgttggccccgttcagccacgagatgtaaccggccacagactcctcaggatcctcgcaaggtactcggagctccttgcaaactcccgccatggctgtgcagcaactccggaggtacgagttgaaccacacctcgcgacctcgaagtgcttccacggcccgatccctcttcacttctaacatagtcctctcgagttccgccacctcaaacttcgtcctccagtattggatgtgacgatctcggtcggcaagcgcactctcgaggtctgctcagcatggaaacgactaagtcaagctatcttcctctctcgagaacatggtgaactaagtcaatacatacggaagaacgaaggggatcgaaacaaaaagaaccaacctaaggaagtcgtcgccatgcccgtctccacgggcagatcctggtccacgccgtcctgcggcacatacagctcgagcgcgagtgccggagcgattacaggcaactcaggctgcccgcgctgctggacatcctcgacatcgacgtctctacaagcaatataaagtactcagaatcaagacgctaaagaaaactaaggcgataactgcacacacaaaggcagttggaaccaacaaaagttttactaagcgggattggttaaggggtacaggcaagttgcagtcctactctttaaaaagtgggagaacagactctcccagatcaccgacttcttccatcacgtccttacgcgcgtcgttagccgccccctgatccaagatcttctggagatcgagtttagggtgcaccaacctcacgcacgtgaggacgtggcacgccccgatgtggatcccgttggacgtctcctccccgatcctggccgcgtgcttggaggggatcgcctccatcgccatcaccagttccgcgagcgaagacgtcagcgagaactcgtcagggttcgccgggatggtggtcgtgacaccacactccttggctagctggtgtaggccggtgtagttgacccgcagcgaaccacagacctccgacaggttgttctcgagttccgacatgcggttctcgagcccctgccgttgccgctcgttgcaggccaccagctccctcattttctggaggtcctcgcgaacctccgccaggtcacgcgccagcttgtcggcgcgttcgttaaccgacgacgccgccgccgcccttgcctccgcgatctcgcgacttatgccacgagcgccggcctcgaggacgcgccccatctcgacttggagctcctcccaggtgaggacgtcagcaggcgggcctcgagcgggcataagatcgctggcagggccgctgggcgtcacctcacggctcatgggcacgaccacgacatctgtcgaggccactgcaggagatgcgctggaattccctccagacccatcttgcgccgccttcgcccgcgtcgccctacgaaagattgccatgttggtcatcataacaagctactagaatccgatcaagtcaatgaccttaaatttcgtccacttacttctcgccgagtgtcaccagcctctgccgtcgtggaggcgggggagacgcatccgaggcctaagtaaaccaaagaggcttaccgatggggtgggcgtcttccgacggttgccgagcacggaggaaaacttcctccctttcctcggaacttagccaccactggtcgtggtagcagcagcggcaatggccacgtcggaggcctcctgggcaacgccctctttcaacgaagccgccgcctggtggtccacgagcggcccattgacgtcagtcagagggagagcctgcacaacatgaagtcacgatgcgatctaaggggtaaaagataaagggtcatcgattacactcacgttgattgcggcttcgcgctcagccgcccctttctcgcaaagaggggtgggggtgttgctcgccgtcgtggggccactgaccatcacgtggccgacacggcgctccacggttgcgctgttcaaacctgtagatcgagaaccaaatttcgataagtcaggaggaatgcgcacgtaaggaaaggaacccagaatgcaagaaaaataccccgaggagaaacacgggtcgcgtcctccggcccagattagtcaaaggctggatgggctcgagcctggagcggctggatccgtctaccaatgaagtcggcagcgacttcatacccccgacaaccctcgtactcggaggtcatcgatgatatcgataaaagactgaagggatggggtcaaggcgggtttggcggtccaagacggaatcttgtctggttgctcctcaggaacaacaaagactggatccgaatcttctatctgaagatagaaccacctcgcccgccatttactacgagaagaggggcactggaaggggatgtatcgcgacttcaggccatcccgaagtcgaaaaccaacacacccggatacctttttaggttccatccaacgcaactcatagtaaaaacgaaagaggtcaagaaacagctctaccccaatgtaggcctcacagagatgggaaaaaatgctgaggaaggctatggagttggggttcagatggagtagagaaagaccgtagaagttcaagacgagaaggaaaaactcagaaggcggaggaagaaaaccacagagaatatagtcctcaaccgcaaccatgcggcccaggacggattcaggttaagtacctcctggttccctctccatggtcccgcgaccggggagagcgccctcctcctgcaacttcttcacggacgcactagtggaattggacttgtcgaggtccattgccgttggagatcgccggagaacaaaccgaggcaagcgagttagggtttgcgtggaagcggagaagacgaagagtatttggaggctagaaagttttcgcaacagccggactccaaaatggattcccaaaactcccttaaataggcgcactactgacggtgcgaattccaaggaaaggagatagatggccgccgaaaatttctgggtccgttgcgcgaggcggtttttggacttcaattttaattcactcataaccgttgaacttcgcatggtgttgtcgaccactccttgtctctacggttctcacaccgagatcaaccagtcgagaacgacaacaactccgacatcagaagtcgctatcggttacatgagttcatttaagcagaagtcgggggctactgtcagggttacggataaggtataccctctatccttggatgtacgctatacggcaatatggtatatttgcggtatacgaacgttctctgtatacgctaaggaaattcatcacggagtccacagatggaaagattcctacccggaaggactgggtcgttactgtatcgtgtagggtccgatgactccaagtcctacttggaaaccacctgacctgtggtataaaaaggaccccctgggaggacttaaggcatcgaatctcataaccaagacaaccaccacagcctacgaagtcgaagcctacaggagccaagccgccgggtgatctagtcgaaccaactcgactatgatctcgtcggtatcatcgagttctgtcattccctttgtaatttgtggtttccactatataatcacataccaactggattagggctattacctatcaagaggcctgaaccagtattatctttgtcttccgtttccttgatgttgtactacgtagatcctcgtaccagcataccccaataccctttatatccggtctacgggtactcacagtcgacagaggtagtatctactcgatcatagtgataaactaaatattttatttaaaaataaattttataaataacttataataagtggtctaatcaatatagtatgagatttctttaaaaaaaacatatttcttaaaacatggagcaattatccgtttttcacaatccgataaataagttgaaaacaacaggacaggagagttaacacagtaaaattttcatggttattaactttgtaactctgcgatgaacttggatgagatattgttagaaatatggtcataatttgatatattttaatctagaaattaagataataaacatgatatgtgcagcaggaattaatctagtaaaagtgctaaacattaacatgctaatgacttgaaaagtatcatctagaaacatgtttagcactatagttagaaatgtgacatacccaaagaacgctccggtaccgtataatgcattattggtgttgctgcttccgttgatattgatgttctcgccacgacgccacctccaggtgtgtcattgccaccacctctaggtgcgtcgtagccgccgcttccaggtgcgtcgttgccgccagtgcctccaccattttctcctcttgtagatacgccgatgtagtgaaagtagttgaagcggatgatgcagaggaagaaaacgacgacatgcagaaccaatgtagcagagtagtcgcattaggaagcgctccttaggatgtgtttggttcacggtcaaggttctatgggatatagcggtccatattttgttagatatggtgatccagttttttgtttggttgaacgaatatggtgatacagtcttttgtttggttgtagggatgaagatggatttggtgattcaatttttcgtttggttggagggagtaggatgaatttgtaggtgtggtcacctctcacttgagatggtgagtataacccccccccatcaaattaatacacaatacaaataataaaatttccaacaatttacactacaatctcgattataaatacacgtaaaaaaagaaaaaaaagaaaaacaaaaaaataaaaaaaggggaaaaaagcgtttggatctgggccgccgggggctcaccgccgccgccgcctcctcccgccggcggggacctcgcgcctcctcccccggccgctgccgccgcctcctcccgccgacggggacctcgcgcctcctctccccggccgccgtcgctgcctccttccgccaaccgccgcctcgcgcctcctccacctggccgccgcctctcgcctcctcctccgccgcctcctctcgccggctcgccgctgctccctcctcccgccggctcgccgcttctccctcctcccaccgatgcagcacgtcgtcgtcgtcgttgtcgtcgccgggcacgcatcggcatcgccgtcgccgccgcgctcgtcgcccacgccagcgctcgccgctgctccctcctcccggccgcagcacgtcgtcgtcgtcgtcgccgggcaccggccaactcgctccacgcggtgacgcgaccgctcgcccgactcgccggctcgcccgggcggccaaatccgggcaaatcggtcggatacatccatccggcatctgaggggaatattcccctccgggccgccctatcccactcccgcccaccaaccaaacacccacaaaaaatgggccgccatatcctatccacccaaaaccctccatccaaacacatccttaaatatttgatcgcctgcctatccgcgaaggtactcaagcgagcggaatggagtttcgtaggcatgctcgtcccaaacacttgtgcacgcacttgctcagaactggggaagcagagatgcaacgcaggaacagagaaagaaaatggcgataatgggagaaagcatagcaaatcgggacaacagtccttgtatatgtactaggcagttaataattaagcttgctgtacgttcaaaaaaacaaattctgctcgttcgaaaataataataattaagctttgtgggcttacaaggccatggcctagcgctccgcccgcccacaaaaaaatagaacagccccaaataacatctctcccgttctcttgttggtgtgatatagggagtaccacctttttcttggcaggtaaatttttgtccaaatttgattggacaattattcattgagttagattcggctttgtcatttgggcctaacaagattttctctttggaataagtctattttgcctcctcaactcatgctcctagttgaatcgtatccctcaaccgcaaaactaggtataacccatcccctaactcccaaaaccattgcaaattgactacccggacaattttagaggcggtttcgtttgacgtgacagttgactcactgagttattaagtgagaccgacttgtcagcggccttcacctcatcccatcttctctctcacctctctcccaccctctctctttcatatcttcctcttctctcaccttccatcaacacagaggcaggacgacaaacgacagcacacaagggaggagcttgtcagccggccggccggaccacgcgctggggaggagcaagtcgatcggacgtgcactagaaggagctcatccgttggctgtgtgtgaggaggagctcgtcagcatggtggcagccgacacccttgtcgatcttctgcgacgccccggctcgagcatgcttaggaggtgggagggcgccggggcattgtgcgagagaagggaggagggggtcgtggaggacgaggcgaaggtcgcgcaggcaaacccctctaggttgtcaaccggccgtgtgcaggggaggagttcgtcggccgtctacacgcggggaggagctcgttggcatggtggcgatcgatgaaattcgttgaatgggctgatcgcgcgacggaggcggatgggatataggaagggggcagggagctagaggaggctggctggggatggaggagagcagcgcatgggagcttggggtcctgcacccaactctcaagcaatgtggggctcccgtgatggagatggaggtgagcagcgcaggtggcgtcatcgagctcccaagtggtgcggccgtgggatgtcgacaacgcctccgtggtaaggtaccacatcgccagggacacccgcgtggaccatccaccgtgaccccttttctgtcgctacagtctttcccacgcgccgcccctcgtggggatcgaatttagctacgaaatgacgggttcactactaaaaaaacatttttccgtgtggaggatttgctcgtctacaccaaggagtctgggaaaatcaatatttttgtgtgcgggtagcccaaccacacgggaaaattatcttcccgcgcagtcggttcaatggactgcatgggataatcgattatcccgtgcggtcaaattataccgcccgcacgcaaacaaaaaaaataaaattaaaaaaaataaaaataccctaaccgtaaccctagaattgcctggtgccgctcccggccgccttcatcgcgccgctgccacgaccagcagccgccgcacccgaccgtcgtctgtgcccgagaccgccaacatcgcgccggccgcacggatccgggcgggggccagttgcagccgccgtccgcgctcgcgcccacgcccacgcccaccggccgccaccgccgctcgtagtcgccgtggttgcgccgccgccgctcccgatcgagcccgccactgccggccccgccgcgaccggccaccatcgctgctagctcccgcgggccgcctccactcctcatcgtgcgctcggtggggaggagaggggaggagaggagaggaaagggaaaagtaggagaggaaattggaaaagtaggtgtgtagagagagagagaggagtgagagtaattgagggatttaatataaggaaaaaggaagagagaagtttgaaaattttgaagtgagtaggagggaaaaggaggagaggtatgtttgcgtgcggttcacttaagaggcccgcacatgaaaatcgattttcgcgtgtagacccttaagatttttgcgtgcgggcctcttaatggtccgcacgcgaaaatgggacgccgatttttccatgcggacgcgaaaacggtccgtggttgctctcgcgtctccgggaagctctcgttgagtgtcgggaaaggagcaaggcggagacacatcttcaagctgtggaggcaattttgggagtagctcccaaccgccgctcccatgcgagcttgccgatgtcggccaccgcaccacccaacgacctcggtaaccggggcagaggccggctggagcggcgcaagggtcgcagacgcacgtcattggtctgacgtggatggagccggaatactgccacagtgacctccctgagctccagtgtccttcatccgacatttttttgctcgtcttgtcgccgggagggattgaaattagaggagaggaaaagaagagttgctaacagaaggagcctacaagctgactcggtcaacgtagtcaaagatgccacgtcggatgaaagtgcctcccaaatcgccaagggaggttattttccctggttttcaaagctgaaggaggtgttatacccgctctttcggtagaagggacgtgattcaaccatccaagggcaagggttgagggaggcaaaatagacttattccattatcttttgatcctggcgaaattggctcagtggaactaaattttcggattatattcagggatggaccaggtttcggcccattggaagccctattcctggagatattcacagatccacacatgcaaggctgttagtggagtcgtgaactggcctaacttctttttggtttggacaaagaagatttgattacacacgttcgtccctctccagaacttgttcactttgctaccatttttaaccttgtctttttttggtaaagttaccaaaaacgaggctacatttagtttgttgccaaattttagtaagtatatatgaaatcttgcaaaaattttgcaaccttgccaaaattttgacaaccttaccaaaatttagcaatatcaaaacttggtaaggttgaaaatggtagtaaagtgaacaagcccctagtttcctaatgtactaatagtatgtgtcaattttgaacgactataaaatattactactatactttatagccttaaacattttaccatttggttttactttcctttggaataaattactttgaagtgcggcgtgctcaaatgtacgtataagggaaaagtatcgattgacagttaggcatatttcatagtgaacaaatcagacaattaattatgtaaaagatttaagttccctgtgccaaatctgcctatctatttatctacctacctacatatactgtattgagtactttcgggaagctttcattttaattaaggaagatatggtgaatgattagataaatatataatatatcatgaccgcagattataattgtgaatttatgttatataaaacatttaaaatactgtttttactttatataaaatttattaaattcaaaattgggaaatggtaatatgaaattttacccatctttaactcaatttagtattttatttatccaattataatattagaaattaataattagaaagttgtaactgatatgtggatatattcttggtttaatttaaactgcaattataaaaaacaaccaaattgaattattatatcagctcgtgcaacgcatttccttgatggctaatttatttgaggtgcctttatttgattagtcattagtacgttgttgaaccttgaagaagagaaacaatagactgctttttcaacacattgtagcccaaataggttcttttttgaagatctgggtgaaacaacgacgcataatatatttagctacgatgaaaattagatgaactatataagaccaaaacataatgaatatattcagagatagataaaaatatttattcatttcattgaagataaaaagtctgagataataattaactaaaagtaagttctacagtagatgtgactactgcatacctctaattttatccatatcattcactaataaattaagaggcctatacaatatatcacctctaatgcataaataccaaatacctctaactaatactctcacatgcatactacttatagtttgtgtgcattttgctcttgcatgatgggtgtttcatcatctctcttcttacttctctcctttaattaccttatcacttgatgctatgtgacacttttatataatcaacagtataatagtacttgctctaaacaatttgcgcttgtggctccttaatgatcttttttctagtaatttgattgaggcatgcacccttgttttctgcatgtgagccacatagtcatgcaaaattctaaaatgattatatatttcttccgtttcaaactacttattattattttaagaaaatatatatgcttaactttggcaatcaaattttagaaatccatatagtctaataacatgtgaacatatacattgtgaaaatatttctcatgatgaatctaaatatctaaatcttatgatattaaattataaatttatagagaatgatgatcaaagttagaaaattaagtttgagtgtttaacttgggacaaaactgtagaaaagataggtggttgtgctgctatctccccgaacaagttaaacattaggatggaaaaagaaacaaaataaagagaagaatactctctggagtttgtgatttcaacaaaaaagctgaagcaaaattagcctgaaataattaatataacttcaatcgatcactgtggttattatacaacttaattggagatttacactaatgaactcgctatttcgtgatactatgctatatctatacatcgatcgagctagctaattaacggccggggcgccgggcatctcctagacagagtcaccattattagcattcatgaacctaatcaattaagtgatccaatcaagtgtgtatctaacaacaaaaatttcaacatctacatgcacaatgtgcatgcctcacctaaatacaccaattaagttaagaagcaaaacgagatctaataataatgacatcagagaggtgagactgattgatcagttatcacgtcgatcgtgagaagaaaaaatgccgtccatgatgctgctgctgccgctgccgccggagttgaacatgacgtcggcgaggtccgccaccgggtaatggtccgcgtccctagctgctgcaccgccgccgccggccgccgtggcgcccattgtcgtcacctgcggcgcggtggcggtagtgctagtgcttccctcgcctacggcgccggcgaggctggccggcgtcatcggccatccgatgccgaggtggatggacgtggacagcggcggctgcgcctgctggtgctggggcggctgctgatcggcggcgggcgccatgacgaagtcctggccgagcacggcggcggcggtcggagagtttgtcaccgaagtggcggcggcggcggggagtgtgagcagcggcgtggtggaggtgaggcaggtgtggttgccgcagtaggtgacctcgtaggtgaaggggtcgtcgtccagccgctgcaccttcttcttcgcctcgcacccgtagtagttcttgtgagtgcaccggtagtagctcctgtaattttcggatattgtcgtatattaattagtggaactatcttatatatatttatcgataaaatttaacagatataactgtaatacagtcgttaaatataaacataatacaatcataaatcataatgtaattacactaattatacatatataattaagtgtgtaatacaacttatacgtaatttaatttcaaaaattccgcggtaacaatcgttaattagttcaccacagtttcagattttgattaaagtatcttaatattcttaaaaatttatgccatgcattaattatccacgaaggtcttccatttaattattacaggaaaatgaacacataaatatacattggttgtatatatatttatccagaagcagtagactgtttagctaaaggtgatcgattgtacgtttccaggaaacaacgtcggaacttgtctattttattacctaaacttttcgtgacatttgaaaattaaccattagcgtaaagacttgaatgttttttcactggccaagactagaaattcttttttaccgtcaacgataaaaagatgtaacttttcaacattcgcctgcgtttagagtggtttctatgatgtttcactgacactgacacattgcaaagtgcattatgtttaaactagttttgaattgtagcaagactaaaggaaaagtagtgtgtttttttaaaaaaactcttggcccattaaacttgagaagtgacttaattaggatcatttggcaactcagtttttcaattatttcgaaacctagcctcggaaaaaaattgtttcaaaccatttaataattcgaccaaaagttgaaatcattctatagttattatttcaatatttcaaaattgaaaaaaaaagtcttcaggaattttcttgaataaaacgccaaactctccaaggcatgtaataatgattgattttccattgcatcgctcggtctcttcaatttctctctgtaagtaaacgtacagataaacatagcaatttcaagacaagtaaagtaaaccgaccaaataattttaaattttcaaatataagttcttctaggcaacttttgttgaactttaatattaattactcgacgacaagctagctaatctagcaactggtttcttgctcatcacaaattaatacacaagctaggttatctccacgaagatttttctatctccattaatcgtttcatttacaactgattatatgccataatacttttagtgataaaaaaataatccattgaaaaaactttatttatatgttcttagtgaattaaatcctatacttaaaagtaaactatgataaaaaaataaaatcaattctacaatttaacttttaaagtttaaaatttagctatacggctaataagctaaaagagtaaactatggagctatctatttttcctacaaaaaataacaatatagttaaccatatgcatatatatgttgcattcttggttcacttgaattggacccacaccatgctgaaagccaactaattcaaaaaaagaaagaaaactcacgtggaaaagaaagaaaactgatactaggttattctgcgcgcatgctcgatcttttcctagataccataagtgaatttgacattgcaattagcgatatattatatactagaaaaaaatacccgtgcatagcaacgggtgaaagctattttaatcttattattattgtacggtttacctatggtgaattgtgcgaattcgcttgtatattatttttataaaatcatgagctgtaaattggagtccgattgtcacaaattagtgtgcgagtttttttaaaagagatttcttatacgactccttctgtatttttaaaattgaacgaacttaaaaatcgacttaaacatagatttgtatttccaaaaacaaataaacttaaaaaaactgactcaaacaatatggatgacgtgcacatgtataatagtattgatatagatatagatatagatataaatgtgcacatgtatatatgttgctggactttcatacccccggtgctaattgagttagtatatacgtacacacttgcgtattagccatcgatcgggctacgtgtactgtactatagtatatgtttctttttcccaaaaacagaaagatatgaatatatgatgctttgtgtatgcaataatactactggtgtagtggaggaagcggaaaaaaaggtgaagaaaaatcgatatgaagatgcgaatgttagccaaccatacacactgccagacctaaatatgtccagccaaatcatatttaattaatcagctatagttttactttccaaaaaaaagctatagtagttttactcaacaaagcccccattacgatacacgttattaaaatacaatttgaaaatatcaaaacaaaataagtataagcaaaattaaagagttccaaaattaaattaaattaaacattagtaattctgtggtacctgggatatctggagccgaggatgtccttctggccgtacttgcgccacgtgtacccgtcatccggcggctgctccgtgttccccgtccgctgtgccgccaccatcaccgtcaccttctccccgctctccctcctgatacacatacatcatctagttaattatttactcgcttcgacctgataaaaactataatttaaaattagatttgatacaatctagtgtaatgaattttgatttttattgggatatatagagtgagtatctatgacgaaaattcactaatcaggttaatttaaccgatcgatcagcctattcagtaatcaactaattaacagctgatgcgccgcagagaacacagtacctcgtagagtactcgtagttgtgtgtaaaccctcgtgtaacttgtgtgcaaagcggaagcgccatgacttggcaagcaattcggactgcatatatgccgcttagccgtcgccatcaccgcgaacaagaaaatcaatactccctccatttcgaaatgtttgataccgttaactttttaacacatgtttgaccgttcgtcttgttcaaaaacttttgtgaaatatgtaatattatatgcctacataaaaatatatttaacaatgaatcaaatgataggaaaagaattaataattatttaaattttttaaataagacgaacggtaaaacatgtactaaaaagtcaacggcgtcaaacatttcgaaacggagggagtattaattacggggtattagtactagttaagctaaagtctatagttaattaatggcttggtgtactgcaggtaggagaggagagaaggagagatggatatatggctagtgcgacgaaaattcggtggcgtttctttctgacccagctgcgcgcgcgcgcgccatgcacggcgcgacgtggtaaaggtcaacgtgtctgaacagcttgaccgccaaaagacttcaccaactacagtagcgcaggcgcgccgcgcgggccatggccatggcgtgcttcgacctgatcgaatcgattaaccctagcgtacgccacgacgacgaccgggtgacgcacgcacgcaccaacggagagggaagagtgacgtagtgatgtacctcctcctgctgccggcgccgccctggcgcggctggaccggcgacggcggcgagcgcgacgacgacgacacccgcctcaccgggccacccgacgtgccggcgcccgcgccgccgtacgcgtcggacggcgcgcggaacgccgccgttgttgcgccgccgccgccgccgaggaacgggttggcggcggcggcggcttcgtccggcgccgtgccgccgagtacatgcggaggaggtcctctgctggcgatgctggtgatggaggtatccctcgccgccgaacgacgttgacgccgcgcccacgccgccgccgccgtggcgcgccccctgcagcacgcgcgccgcggcggcgtacgcgccggcaatggcgtggcagcgcgcggccaggtagtccgggtcgttctgggtcgccgcgagctccgacatcagctcgccggcgagccggaacccctcgctgatctgcgccagcacctcgtccatctcccaaccctctcggccgccgccgccgccgccgacaaccctgctccgatcacggcgatcgaaaccaccaccagcagcagcagcgagcaacaccgacaacggggtcacctggtgcggtgcaaagacgtgcatgaacaatggttgcaaggtgctcgacgacgatctcgtatttaatcttcttatgcccgaggttaataaggtagctagctaggttataagcaaattaaggttactatatgcatgtgtagagggtgaggcagtgtggtgtatataggaagcagccgggcacgtacatgcggtaagaaagggagaaactgaattagaacgggtcatgcatttggtcgttggggttttattgactaatttgctaactaaataataatcaattaaaaacgaagagagatacggtatatagttaattgaatatctttggtgtgcattttgcctctcttgcttggtgctgatcgagtcactttctgactactctttggttgggtcttggggaagaccatgaaagttgaaaagggcattcaacatggaaggatccaatcttaattctggccactggggtttgatcctccgttctttggccgaagactcggtgcagctttaattttccaccagaagagtctccggccaactctaattaaatgaaaatggtgacgtcacggtatgtgacacctcatcgcacaactgataggcacctgcttggagccacaaatgaattaactgaagctcggccagttaattttggggtaaatatactaagctggcaattgatcttaggcaacttatcacataattaacacatattatatatatatatatatatatatatatatatatatagtaaatttgtttggtactccatggtgcccgggcaccatgattgaaatttactatatacccaattcaaatgagtatgaaactttttcaaatatttaggtattaacgttaactactttactaactagttcaaagcaagtttgaactgaattcaaacttacttttgttagattttgattctaggtatatagcatccaaacatataattagttaggtatgtaataatggattgtgaaataaagttaaatttgagttgttttgttgctaggtataggtatgaaatgaatacttataagtaggtatatactcacaatttgaaaattttgaaacatttgggcgaatttgtgtatttcataccatggtgcccgggcaccatggtgccccatatgagtgtcctatatatatatatatatatatatatatatatatatatatatatatatatatatatatatatatatatatatatatataaaacatgttttttccgatactttggtacgtcatttgtgtgtgattcggtttctaagttcgtacgtttttagaaaaatatttccgtatttgagtcgatttttaagttcgttctcttttgaaaatatggaaggaatcgtataagaaatttcccacgtgctaacttaagacgatgagactcctaactgtagctcatgattttctaaatatatatatatatccaaactaaaccatataacaataataaatttaaaacaaccttcacccgttgcaacgtacggacattttctctagttattataaaaattgaagatgtttttgtcaaaattttggtacgtcatccgtgttggaatcggttttctaatatttatctttatctctaatctatctatatacctaataaaaataagcaagaattccgtgtatttgattttgtacgtcatctgtatgtgtccgaacccagcgaagttgggaagaatcatatgtaactttttctttagatatccatggatatattatttgcctgattccgagtccgtatgagaaagttatgcccattttaatgc

SEQ ID NO: 43794 - DNA, 1258 bp, Oryza sativa
cgtaagtgtgaaaaaatatcaaaaaaataaaataaaaaaattgcaactctatacagagaaacaagaatggaggcgagggatggagggaggtgccagccatgctggcgccctcctccctggggcggcgccagccatgctggcaccctcctcctgccacatcggttcgcgtatgccacggtggcaggaagacggcgccagccaccctagcgtcccaaaaaggaccatttctaggatatgtttttctaggggtctatttgcgaaataagtttttagaaaggaccaaaatgtgaaaaatccagggcaataagaccccatccaattcaaagctagatcttgccccgggagaggcgaggaggggaaaagggaacatttttagttcaatggctaagacgagaagaaaaaaataaaatagtattaaagaggtccacccaatctaaaactacactttatcatagacaagtttttagactaaaagtactcttgggatggagggagtaaaatattaagcatattattagttttaaatatactttatccattaatctatttctttcaattaatatcgtatgaaaatatttttaaatacatatctaatgataatacgtgcaagacatgaaacacacatttttttttacctcaattactagtcagaatttttaaacattaactttgcggagaactaattgaggtaaaaaaaattatcttctcctttggggaagaaaaacctcttcttggaactactatgtttagataaggggtaaaactttttaccgtgtcacattggatatacggacatacatatatatttgaagtattaaatatagtctaatgaccaaacaaaatacaaaatccgcttgtaaactacaaaacgaatttattaagcctgattaatccgtcattagcaaatgtttactgtagcatcacattgttaaatcatggagcaattaggtttaaaagattcgtctcgcaatttacacgtaatctgtgtaattagtttttatttttatctatatttaatatttcatacatgtgtccaaacattcgacgtgacatggtaaaaaaacttgactggggatctaaacagggctataatacatgtataattgtgtgtgtactccctccgtaacaaaatgaatctagaactggatgtgacgtattctagtacaacgattgtactaatacagacagatgtatgtccagattcgttataatataatgtgtcacattcatattaggttgtttttgatgagctacttgc

SEQ ID NO: 43795 - DNA, 20478 bp, Oryza sativa
  unsure (1)..(20478): unsure at all n locations
aaagtagcttccccgtaattttactgttccatggtttagggtttagggtttagggtttagttcagtaatacagtaatattacggggaagctnctttgtggccgcacagccacagtgtggccatgtggcatcatctactcatttcgcgtcagccaatatatgttaaattgtataattatatggtttgctctgtacgtcttgtttagtcagatagttctataatattttttcttcaactcagctgaaaaataaaatgctggtgtccattcaagaaagagaaaattaggaaacagtgtttatatgaaatgaattctaatccatcgggggaatgccatctcgtgttcattattcttctaaattcgatataaacagttgtaaaaatttcttaaaaaattaataatgtactagagtacaatgatatctattagtacaccaaaaatcgaatttaaattcgacctacacatcaagtaaaaacatccaaatttagatgtgaatagtgctactattcatctgaatttgtcttttatatctcttgacgtgtgagttaaatttggaactaagatttcatgtagttgtatatatatgttatatgagatttcatgaagttgtatatatatgttgtataagtgttgtcaatagtttttagattcataatagtttagatagtttatgagcaaacgagaggacatcctctcgaggatcaaaataatttcccagtgtttatatatgtacatacatatgctgaaacttaatcaggttgtagatatatgtgccatgtatgcagcatatgcgcatgtatgaagtagtaataattattaacagggatcttgacatgcatatggacttttggtgtttggcttgccggtcaacacacttcatatatatatatatatgctgtatataactttacgcgtatatccagtatgaactctacataacgtgaagagaactctatttgtatatatgcaaataatataattagttgtcgttttagttttaccattctaagccaaacattttcatctttaaccaatttctaaaaactcatggagtttaataacatgtgaattatatactaaaaaatatttctcatgataaatctaaaagtataaattttattaagctaactatataaatttctataaattaatagtgaaatatatagatgtttgactttggacaaaattataatgataaataatttaaaatggagaaagtaatattggtgtgccgaaaattaattctatgctaaaaaataatttgattatattcgtgcctgtgcctgccgtgaagcgagggccggcatgcatgtaaaatacacatgcaagacttgaaaaaaccgatcaaaggaagcatcatggttgccgctgcacgaattgaaggtccggtccggccacctatcgatctggtcctgcgcaacatgacaattaattaaattgaaccaaattttcctcctaaaagaaccttcttggccgatctcgtatggatatgatgcatagttgcatacacaccaaacagtttaattttgtggcatttcctcaatttgtttatcttcctgaataattgaaattagcgtgaaacaattaatacatactcctccacttagagtatagggatttttagagttggacacaggtattaagaaagtaggtagaattaaatgggagaagattgttgttaggtttagtcccacattggtaattgatgatggaatagcacgacttaaaagatgggggcagttctcacccatcatactagccttttgaattgtacaggcccaggacctaaagttggggctccggttagaccagtgatagagcagacccaatgtgacctgggtggcccacgattggtgggacggactgcatactaagtggttgagaagtggacgctcctagcgcgcgtatgccccagcaattatggccacgcgtcgtcttccctttttttttcacgtttttttttcattttctctcattttctgatttttttcccgccaattagcaagttttaaatcatgatttgaaagttttaaaatctcgggttgaaagttttcaaatcttaagctgaaagttttctaaattttcaaatctggacttaaaagttttcgaatctcgagttgaaagttttcgaatccgagttgaaagttttcaaatctgggtttaaagtttttaattttgagttgaaagttttcaaatttgggttgaaagttttcaaatctgagttcaaagttcttaaatctgggttaaaagttttaaatttgagttcaaagtttttcaaatttcagatgaaaagttgaaagttttcgaaatctcggggatcgtatttctacactcattgaagcgccgaatatagtcccgcaatgattcgcctaggttctgggttagagcatgtaggtcgtcctcgatcgcgtggcgcttgtaagtccctcggaagttagcaacgaattgctgccataaatcttcccacgaagagattgagtttgccgggagatggacgaaccatgaccgggcagagccttttagcgcagccggcaaataatttgccaagacgtttcgtctgcgccagtgacatagagaactgtggagtagacttgcagaaattcttctcggtctgtacttccatcatatctctcgatcgatccaggtcggaacttctcgggccaccgcatgttgcgaagtgcgggtgtgaatgccctgcgtccgttgcctgggacagggcgtggcccatgaccgcgatgccttcgtggaggtcgatccgaagaggacgatgaagacgaagaagagggatcgcttgggtcaggagcccgagttctcaaacgatgatcacgtccacgatctcgactcggatgaggagattgggagtttcgatctcgtcggtcgtcgttattcctttcttgtctccgaggactgttttccgatcccggtcgttgtcgtcgcgtcggtcgtcacgaggtcgacggtcgcgattcccgttggagatgttccttcggccatcgtcccgctctcgtcgaagctgggagcgaggacgatgctgtcggtgcggatcgccatcctcacgacgaggagaacgatgtcggcggcactcgttctcgttgcgttctctcctgttacgccgacgtccgtttagatgttcgcgaaggtcaccatcttcatggcgcggtggtgtagggtcacatcttggaggggagcggtcgccggtacgccttccgtcggggttttcatcctccgcatctccggtaggccgctctccgtctctgttcggctttgggccgcctgcggcttcagcaaacacggtgttgaggttggtcacggtctcccgtagtcgctctgtccatcggctggcatctgggtttgttaccggatcaaaagggcttttcctcaatatcgcgtctaggttctgcaactgatgagctggcgttctcacagcggcggacgtgctcgtctcagtgttgtcgaccacgtttacatctctaggcgactgcgaggaggactcgtagccttctaagaggtgtaacacggatggctcgtttgcgccgacaaatcccacaaaccgattcgggatcggagccgcatctggttccttggcaacacacggagtttgaactcgtggctgctggacgcgatgatgcgctggtttgagggtcctgaggaagattctgcagttggtgagatcatgcactctagatctgtgaatcaggcagtaggtggtactcgttggtgaagtgcgttgtatcccccgttcccaacaggtgtagagttcagcttgcacgtggagtatcaccgggcagtcctcgagagcatgcttggttgtcttatgtatgggacaccaagttctcggtttcagggtggttgtccttgtcggcttcgatttttcacacggagggtgaaactcagccgcttgagggttcgtcccaggtgttggggccgtcgatgttccgttctccatcggagtgggaggaattattgacggggcgccgtttctctcagtcgtagccgtacccttcttgttcccgatgacgatcgggccagtcgagattggtgtaacggtgtagagcggaaatagatccgacttgagtccacaccagcggtgtcaaggtagaaactccttgattggcgctgaggctgttgtcggggagtcttgaagtcatactagtggatccttgagcaccaagtccccctacctagcgcgccactgtcgaggagtactcgtggactggaaggatagggtattggggtacgttagaacagggatctacgtagtacgacatcaaaacagaaaaaagacaaggattatactggttcaggctccttatcaggtaatagccctagcccagtttatatgggattgatgatgatgagaatagattacaaagagagtaaccgaattggcgatgccgatgagaccgtagtcgaggaattcgacgagatctcccagcgagttggctccgtggactccggcttcgtaaactttggtgggtgtgttggcgatgagatgcgatgccctttgcctctccctaggggtcccttttatatcgtgggatacctttaccctcaagtaagacttggagatatgtaaaccgacacgatatcctagagattttaccctttccgagtaggacttctgcaattcctaaacttcgtggagatattttccataatttgaggcgaattcctaacgatgtatacggaaaccaaccatatacgtgaagttataccttatcggtgtattccataagtcgtaggatagagagtatgttttatccgtaaccctgacaaatatttatctaaacttgaatataaagcattactttcaatcctacttattttaaataatattatgtagtatcataaagatcgtagaatcggaatactatctaaaatttcgtaggatcgtgtgaaaatgaaaattaagatactacgtaggattgatatagttttggtttgataagatgatagtaccgtactactctgttccaaagaaagacaaactctggctaggaatttggacacgcatatattcaagttcgtagctaggattggacttttttttggatggagggggtatgatactaggatatggatcgggatactgataacctacttgtacctactctgtctgtgtaattagtttttttcccttttgttttaccatttttacgaatgtggctcctgagaagttttgtctttttctgattatcgggcgagcgagcttcgccactgccaagaatcaatctaaggcctctctcaaagaatggtaggatcgtccatgttttgacttaagaattatggactccatcgatttctgacaagttgaattcgtcctatatacgagagattagctttgttgacaaattctaattcactacagagattaagaactgaactcaactactgtccgtcgagcatagaagttttgtcttaaattgatagtttccttgaaagccatgttcatgcagggctgcatattggtgactcagtgagtcattgtcaaagaggtatatataggaccgaaagtattgctggttcacctgatctcacgctaattctcattccaatactacttttctcaatacctaaaagtataacaacagaacaagtcaccgataatagagaatcaaaatgtcttatatctaacgacggatcgggagtatttctcgttcgagtcaggcccgtttagttatcaaaaagtttttcccaaaaatatcacatcgaatctttggacacatacatggagcattaaatgtagactaaaagaaaaactaattgcacagttagggaggaaatcgtgagacgaatcttttgagcctaattagtctatgattagccataaatgctacagtaacccacatgtgctaatggtggattaattaggctcaaaagattcatctcgcggtttccagtcgagttataaaattagtttttttattcgtgtccaaaaacctcttctaacatctgttcaaacatccgatgtgacaacctaaatttttgtttcgtgaacaaggcgcttagtcgttctaaaggagagacaagtaagtgacatgacatttctgaccgtcgttttctgtggtttgattagttttttgcgtggagcaccgaggcaacatgccccttttggtgtataaaaatgatatatatcgcggtctctattttgtctcctaggcacgattgatatttgggcaaagctactgtgctccacctatagtccatctagaattaaagttggtttagcttcaataccttcactctttatttcctttcctcagtgaattctcgatctgaagtaaattaaatagagtatttccttggcaatgatatcctaacatttctagagaatgattaaacacacacatttgcatgaaaatccttttttcaaacggacccttttcataatgtttacacacacgcacgagcccacacacacactagcatattgatgtgcgttgcaacgggattttaattagttaaataaaattatcactaacttgttattattatctcttaattgatgtacatatttgttattaacatgtggaccttttaattccacactattcttttttttcctttttatagaaagtagagagttggtccgagtggttgatatgtgagtcccctagcctcacattttataggaagtatagatatatatatctcttttttaatagcacatgctctgcatatcatattttttcatggaaaattattttttacaaagattatggtaaatttgctgccatttataaggacaactatgctctttttctaaaaagttttggggcaattgcttatttgaccccgttttagattgtaactgccaatttaaccttactttttagagtttgcttatttgactctccttttcaaaaacgaagctcctctctgaccctatttcgtttaggtgagttcacggtgttaagttaggggtaaatagtctattttgcccttatatttgatcctattatatcttacttgtttgaccctattatgtcataccgtgtatatattcgaatactttaacatatttgtaataatttttgcataagtttcacaatgaagacaagtttgacagatttgtcataaatttgccaaatttgagcactttgcctatacactagtaagtggtaacaactactagtactatcaagtagtactggaacagtggagatcaggattacatgagtaaatcaatcagggatggcaacattcaggtttagtttgatcagatatcatgccaccatggtcagatgagatcagatgctgccggcggcgccgccgctgaggatgttgagcgcggcgacggcggccttctggaacctctcgcggtcgtcgtcgagcgccctgcccttgttggcgacgacctccttggcccgctcgatctccgcctcgatctcgccgccgcactggtcgatttcccccgtcatccgtgagtgaatcatctgctctccagcgtctaatttggaatcaagcaagataacgagttgcaataagctccactgcgcgcagccgcagtgggggatccgccgccaccgctcacttcctccgcgagccgccgccgctcccttcctccgcgagccgccgcgccgcctacgctcccttcacggccggtcgccggcacggatcccgccgccaccgctccttaccttcacggctgggcgccgacgcggatcccaccgccgccgccctctacctccacgagcgggtgccggcggggagtcagctttacgctgccaccgccccctcagcgccaccgacggacccgcagacgccgccaccgtttcgtcaaacgccgccgccgcaagcccgagcgcgccggtggggatcagcttcatgccgccgctgcacccggcgcacccgcagacgccgccgccgccgccgccgcaccgcccgacgccgtcgttgcaagaacgagagagacagagagttgttcgaatggatagggtttggatggatagggttgtgagggtactttgggaattaagaataataatcacatttcttttttaaaaaaatcaatccttaacggaggagtgaaaacaggtcaaacgggagcttcgtttctgaaaaagagggttataagcaaactctaaaaagtagggttaaattggtagttacggtccaaaacagggtcaaataaacaattgtcctaaaagttttaaacatgtactccctccatcccaaaatatatgggattttggattgatgcggcacatcctagtgctatgaatctaaatatagagtatatttaaatttgtaggactagaatgtgtctcatctatacaaaatctattatattttgggacggatagagtaaaatagtttgtatggaggtaactgtagtggcgcttcggatttgagagcggagaggatgtgaagagaggggatggagcaggggaaataagagtaatttatttgttctgctgacatgttgaccaacgtaatgatgctaaattgtttgatgaaatgaagagttgaaacgcaaatctgtgtcataagattgaatatcatatcactctatggagcggaagaaaagaagtaagagttgaaatacaagtcttctttttgttgttctttttgggccattcaaattaagccaatgtgtattgggaaggaagtgcctagagcacctccagtgaggggctaaaatcgatttcaatgaaaaaactgaaccatgcacactgtagtaagagcaagtttaatagtatagccaactaattaccagctccaaatcatttatagccaatttatacaatagttacctataaatatatactacattattaatatttggccccacatatcatatacacattgtgtcttagagtctgtaccgtagctggctcactactacaaaatcaatttttcatagcgtcaacctttctttttctctagcggccataagtgaaaaccaccagtgaaaattaaacaagggatgaggtgctaatgaccgccagcgaaaattgatcttagctagcggccggtttaagtgcacctcttgtaaaaatagaagtctttttgcaagcggacctctttagtgaccgccagcaaaaattgaattttcgctggcggttgctaatgagctccgacagcaaaacgtacatcgagagcacctctcgcaaaaagaaaacaatggcgttattaaaaaccccccacggccccaccgcccaccacccactgcatccctctcctccatctcctctcctcccctcgacccctccgatacccagtcgcctcccactcctctccggtgctaggagacggcggcgcggaggcgtgcgagcgatggcaaggcgctcggaagacggatccggcgacagggaggagcacgggcgaagctcgtggcggtcgaccgcaaggggagcagcgacaaagctcgtggtacggcggcaaggggagctacggcgacttgggccacgggcggcggatctggtggcccggaagtcgtgggcggtaggcgacggggaggggacggatccggcggtgggcggtgaaggagagggcggtcgcggtggaagaggtggatttggcagcggggagcggcgtggtgggcagagccgtggcagagaggggcacgtgcggtgaatgcgcggctgggaggggcgtgaccgatagatctacgaccaggaggagcacgagcggcgggcggcgaaggagaggggcagtcgcggcggctgccacgacgacgatggccgggccccaaaatttccagtggcttcctctaatcccctcccttctcccagatccaacgtgtggtggcggtactcggccggtctctcgacaacagcgatgacgatccaatccagttagtccgattagtctgaattgtgatgtggattgatccagttgaaaaccagtgaatggaaatttatggctgtataaattgtgatgcaaattgtgttgattttcggatttgttaactgtcatggatatgtggatttgtaaactgtggtggatttgttaactgtgatggatttgttaaatgtgatggatttaaattgtggatttgtgaatttatggttgacggaggcaggcggagcggcttcgctctgtcattttttttagcgttggtcaggattttcgctggcggacgatacaacagagccgccattgcaaattcattttttgctggcggctaccttacgaagaccgccagcaaaaatggatcgacgctggcggttggccaatgccagcgaaaatactatattatcactggcctttggtttatgagggtgctgttggccgcttgtaaaaacctattttggccgctaggaaaaataatttttgtagtagtagctacaaatctgtatccctttgctcatctctcttttctttcaactcctcaatatgtatttatagctggcttaggccatccctaacccagaaactatcaactagtttacatacttgccatgtcatatagacactatgtatagaaactatgtatataatggatggtgtcttcaaattaaattatcatccgatcacctctcttctctctccttctatccacatatcatcttgtttttattcttggttcttgtatagagatgattttcttgcatgagaaatggtttcttcatctttttacctatctcatcattaactctcttgccacatactctgtccgtgctcgtaaaggaagtcgttttggacagcgacacggtctccaaaacataactttgacttcttgttttcataaaaatatttattgaaaagtgatatatgtatacttttatgaaagtatttttcaagacaaatctattcatatattttttacatttttaaacccaacaacttgagagttattaatgatttatatttctaatgtttgacttaaacattgtcctaaacgacttactttgcgagtatggaggaagtagaatttttacttatgtgacaatgcatttaatgctatggaaactatgtcacatggagaattggggatagccttatagtatgctgttgtacgtacctgctctaacaacacaaacaaataaaaatatatttattgacttctgggtcaccagatagagggcgaggagagaagcgattgagatagttttttgagtaaattccctgtgtacccctgaaaactcactcaatccctttcatacccctaaaatttacccgatcccttctgtacccctgaaatttcaatttgatcccttccatgcccctaccgttacattttccatcattttactgttacgtttggttgcaaatgtctttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaattaaaatttttatttgaaattttaataggacaatggatttttttatcaggagcattcataaaaaaaaatgttgtgaacattggtatacctatctttatatgaatgctcctcatttttatgacctttttttaaaaaaataaatacgtatttttttaatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacggtcaactgacgggaggggtatgcaagggatcaaaatcaaattttgggggtatataaggaagtaagcaaaattcaggggtatagaagggattaggaaaaatttcaggggtatataagggattttctctagtttttttgatgggtctcacaaaatcgattctcacgctgtaataatcgaaccaaaattttattcggtttgtgtactgcactaaccgaaccaacactacggggcattttggattgataccaaaattgtatcttcctaatttttcctaataaatggtaaatgtgtttgtttggattgaggtcatccaattggcagtgcccatattttatttggccaaattttaaaagttttttcactacagtaccaaaatttaacttgatatcgatcccaatccaaatatgagttagataaatttaccttaccaaattattggtaatacaaagtttacctaaattttagaattaccaatgaattgatagggtagaaatccaaacatgtccaatatgtacccttagtagtagtttgacggacatgtcattctctcttctaaagcaataccaaggcttccatccgtcctaaaagaaaccaacctcatatgggatgtgacgcatcctattacgatgaatctatacacagatatgtcatatcatattttgtacgagattggtttattttggtgcaggaagtaatgctctaacacaaccatcgagggacgtacggataatattatccgtgtatgccttctggcctagtattgctgatcgaaactgaatagctgatggaaagggacagcatcttcagatagtgctttgcaattccggaaggaatcaaaagaagctgaagcggaagggatgagcctaaaatattccaaacacaagattactagatatagtagtattttttttccctatttgtcgtcgttgccgacatcaactacatgcattcaaaccctttgccaagccattgacctgacaatttagaacgcacgcatatagctagtagaaataattaatttacaggttagcatggatgggcaagtgagtaaaacagagcaggtcgttgcagtgcatggcgagtcctccattatagtattaaaaaaagactaagcaagaattaattaatctcattatcaattttcgacaagaaaattttcatgcggccggcgtctggagaaagagagatcgaggagacctcattgacagcgaaaggcatatattactacattaatatgcatgatatggatatggatggatggatgcttcgtggagagatcggtggagttgccggcaaacggggggcgtagatcgggcttgtctggcggccggacaaagctaattagagagaacccaaccaaaaaaccgagaccgaccgcttcaaagcagacgactttgcgaccccgtctgtgtggatggcttttgctcgctctcgctcactgtactcggtcagtttgggcgcgagtcaatggcaaactcgatcaccaccgccaccacgtcgtcctcgccgtacgtcgccctccaccacgcaccctcacccgatcacactgccgatcgatcgaacgtgcacagcgacatgtgctgttcgcttgtgcgcgcgcgcgcgcgttgcccgcatcggccggtgtgttctctgcgacagcggcgcgcgcgcggtgatcgatctgccggcgacttggaagaaatttatctgtacgtggacgtgacatgattgcgtcgatggcgccacacacagggaaacccgggtacacggcgcgtgggcgcgggcgtacgctgttcgtcgtcgtgtctgcacgaccaggtgtgagtgagtgagcgcgcgcgccgcgaatcgcgtgttggcaactactacgacgtacgtacgcgcgacattgatttctgccggacttttcaatggcatgttggcatgtagaagtagaacgtttctcgatcgatcatgggggctcactcgcggccggtagtccggtcctcgagtatggtggtattcagtagtgctgcgaatggccggccgggaactcatgggaaattagaggtccatacagggtacaggtggtggtggtctagttgactggtccttgtgtttttgcgtatatatctggacattaattcatcgcataatttcattcattcgtgtctacaattcgtaccttgccgcgcagggcgtgtacggagcacggtatagagctactagaaagaaagaatgggcaacagattttttgttttttctctacaacagaaaacgtataatttaacaaggaaatattgttgatttaagcacaaatattttaagagaattaaaatatttaagaattggtctaatttgaattaagttttattcgatgaaaacaatatataattggattggcacttaaaatttattttcctatgattattattttgtttctacaaacattgttgtatatgagaaattaatgttcaaattaatttagggggtgtttggttgtcagccacagtttatcatgtctaaggttaattaagttcacacgcacattttccacgctgctaaatagtgcattttttgcgaaagaaaatccatacaatagttgcttcggaaaatatactaatccattttccaaatatttttaagctagtactaaattaatcatacactaatgtgtcgttccgttttacgtgcacaggggattagttcccaaccaccttgttagaacgcatgctaaggttatacaagtttgataaacttggtagttatttggttgctaccatagattccattctaactaattgggtctcacgtattaatattaatgactcacaaaagtctaataagattttattaagtttgctaatatgtactaaagaattttatcacctcaatttagtagacagtatggtgaatttgctcacctcaatttagtatacaagtatggtaacttttatttgcaaataatgataaagtatagctagcgaccaaacaacctcttcccttattagagaccttatatttgaccatgcgtcataggacaaaggaagtagaaatggagaggggatatgtactgggccaaagttccaaaatcactcatgattactgagcagtttcattgtgcacatattggtttacaaaatagctttttatacacatacaaattataaaaccctaaaattgaccaaattagaaaaatcgtagatcatatctctccgtttgaaaataaggtatacttgtggtagcaaatgctctattaggatatcatttatgtgaaacaaaatcgtaagttgtaaataaactacatcctaatagagagtactatgctcctccgttctttcttataagacattttaactttttcatattaaaacatttttaaatgtgttcatctaactaattttattaaatctaaaattaaatatattttaatagtatctttatttcttttaggaaatattttgatagaagtttgactagaaaaatattcaaagtgtcttgtaatatgaaatggagatagcaattgttaaaatttatttatagaaacaggatacaccctttatattactccttccgtttcacaatgtaagtaattttagcattttccatattcatattaatgctaatgaatctatacatatatatatctatctagattcattaatatcaatatgaatgtgagaaatgctaaaatggtgaaacggaggaagtagtaatatataagacagtatcaaatcaaactatgatagatgagagtatccctccgaacaagtccgcgtggtctttgagccttttgtccattttctccctcccaccaccgggccatttctccccatccaggcccatcttctcttctctcctagtatcttcttttctttttggaaaaagttcacttaaggtccttcatctggtcgtcgagttttaaaatcatccttgaaccttcgaatacctcttgtaaattaaaccaggttacgttaggttccaagacaacattgctcactggtttagctgacgtggcgctaaaagcaaaaataaaaagttaaaattcacatggggcccgtatgtcagtgaagctttagccggttggcttcagcggacgaactcctgcacgcgcatcggcctggagcgccctgaggactgcggtcaccgtcgttcccaggccgctcgaccgccggcggcgatggtcgttgaggtgggcgaggaggcgggcaccgcagcggaatcgtttcgggagcagaaccgccagcggcgaacagttcgacgcctacttccccttcgccatccgcattcgccgcgccgacgccaccgatgccgacgcgacgacgccgacaccgtccccgccgcctgcatgcgtcgcccctacatcaagtgcaacagctgcgacgtgcgaccgcgccctcgacgactggctccgcgacgatttccccgaccgcctccgccaactctactactacaaggtgctcggcccctagcctttttttctcgccgctcctctacgtccaggtacacacctccatccatcaaccattcaaccatcacttcatcagttcgttcaacacatatgtttttgatgcgttaattaaacaactcaacaaaaataatccgcgtgtgaaaattgaaaattaaactgctgattagttgatagttgcagagtctattgggattcttggattgattgttcacaatttagtgcaaatctgagtagctagctatgcaagcttgtgtgatatgtcgcaggtgctctacgtcgcctgaagcggctcactctaccactctaccaggacgtggaccacgagctccccacaccactgcccggccaccaccgccgccgtccgccacatcaactacgacgggcactgccacccggtgcacgtcttgccgagcacgccgctgcaatagtgattcgcggagtcgctcgacagcgaggataaccgtaaggaggaggagacatgtgtcccattgcaatttttttatttttaacccaaccatcacaaacagggcggagccaccgcacggcttgcccgggcagccgttcgggctcgccggcaaatacaccattgaatttttaatgttttgaaaggattaaagttataaatattgtagcaaatactatacatatttaagtttgctcgggcttgaaaattttactagctccaccacttatcactaacatgttggtctcacgtgatttcctgattttaagtgccacgtcaacgctatataggcgtcacatcagccaaaaccactgtccaaccattttggaccttatttgcactagttttgtaagctgaggacatgtcatatcttgtattcaatttaagaatgaattttagactcggcaacaaattaaaagacctaaagtgaatttcatacgttggcaagtcaaggcctgaaccccgaagacataaaaggatggaggaaaaagtacacctaaggtccctcaacctgtcaccgagttacaaaatcgtcccccaaccgcataccgggcatccctcaactaataaaaccgttcacttgaggtccttcagtggttttgactccgattttgtctctgacgtggcggctgagtcagcatgggacccacgtgggccccacagccacatcagcctcctctctcttttccgctcttctctcccttcctcagctttctctctctccattctctacggtgatggcggctacgggcgacgcggcaaaggtgggggaaggaactgcgggcgggcggtgggggagggcggcgcgcgggcgggcggcggggggaggagcagtgcgcgggctcccccggtggtggcgggggaaggagctgcgggcggcgggggaggggtggtgcacggctggcagaggagcgcgcgggcagtggggggaggagttgtgggcgggcgacgagggagggtggctgtcacgcccagaaattcacgaaccagaatttctaagctgaatgtgcattaaacccctgtccaggaccagccagggtacacaaacgacaattgttgacatacagattcacgtcttacaaaaatataaaagattacaaacgcagcggaaaagataaaacgagctagccttggaagcttgacttcagcagcgggcaactccactccacaggcaaaccttgacggcagtgacgaaaccaacctctctgagacggctccaattgagaagaacttcaactctggtgtgggggaaaagagagcaagactgagtactacccactgtactcagcaagtcataccggaaaaggaggtacgatgcaggatataaccaatggaggctaggggttcttttgcataaaactagcatttaaaagcagtagttgaaagcagtaaaacagctgtagtaattaatcaatattaaccaatcactgtccaacgctacaccatgttgcaacaggcccaaccaaccacccgaactacaccagttcattaagctaaactaggggtgagactaatcacggtgaatttgattgatcgcccataaccgcgggcacggctattcgaatagttttagtctggccagaggtgtacaactgtacccacaagacacgattccacacatgtcaccatgccccaaagtatcaccatgatactgcaaagggggaaatcgtgacaagaccctccgcataaccctctcctaactatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacctcagatcaagcagttacccactcccgcttgtggtaagcatggtaagtatcccagggtttcccgtgaaccggtccttaactgccatgggtgcgactagcaaaaccatgcacccacagcccaccattcagtgtattttaattaactaacaccattgcggtgcaccaatccaaaactatgctcatagtcaaagtctatgtaataatgtgatccccatttgtatactagttgagctaagcatggctaagcatttcctaaaccaacatctaatcattttgatacccaagttatcaatggcataaggtaaacaataaatggctaagtaataggacccatcccacatgacattataaaagaatgcaacatttaatagaaatgcgggatatttgtaaattgggtacaatatgatcaattgtaatgcatgacttgccttgctctcgcactgatgagacctcagcaacgtctttgagaaaccgcggatcgacgaaacggccgaaatctacgcgacaaacaaagcacacaagcaaaacatgctataagactactgaaacaggaaacaaaacaatttttaatggattctttgcatttttatgaatttactgagacttgaatggacgtaaacggagctcggatgaattaactatgaattttagaagataaattgtgtttttactaataaagaaaaagtccttaatcaatttattgcacaataatacccagggctaacgtcagccaaggggggggggggcggcgccggcaagtgggccccacaggtcagcgactccaaaggggggaaggtggcgcctggcgggtgggccccaccaggcggtggctcaaaggggaggcgaggaaggcgccggtcgggctcggctcggcctcaaggccgaccgaccgaccaaggcgaggcggcggcgagtagggatggcaattgtgcctgtttgcccgtttacccgcgggtaaaaaccctattagggttgggtttgttctccattttatacccatgggtatcttattgggtcaaaagctatgcccgatgggtaaatgggcatgggtatgggtaatcactacccatgcccgctttgcccgtttacccgcgaaatctaacttacatgtaggctaggagcaaaatccactagaatacataagcccagttctttgttttcttcggtttcccttttatttcccttattatttctctcctcttactctatcgccgccagaggagagacacgacaccgaggtggagaatatttgatgttttaagttcgattcgaacttagtagcttgtagactttttgttccactgcttttgttgtggcgggtaaacgggcacgcccgcgggcataaggcgcccgcgggcaatgggcatgggcaaccatccttacccgtcatgtagtaatgggtatacccacgggcacaaataatctcacgggcatgggtatgggtaggcactacccgtgcccgtcgcgcccgattgccatccctagcagcgaggcacggccaccgacggcggtgaccggcggtgcgggaagcggcggcgacggccgaaaggcggcggcgcatggccggagcagcggcgtcgcgggaaggtgaggaaagaagggggagggaggactcaccggcgacacggcggccgaagcggaagacgaaggcggcgacgacgacccgacgagaggaagggcggacgagcggcggcgacacctagaggaggggaggagatgagttagggatggagaggacgaccgcgacgaccaaagtggccggccggagacggaggggaatggatagctcaccggctcgtgagggagatggggttccggtggggttccggcgacgcgaggcggtggccgagatggcccacacagcggcggagctagcggcggcggcggcttggcgcggcggcagccctagcggcgacggcacgcggccggagatgggcggcggcggcggagctcggcgagcgcggcgcgacggcggtagagggcgtgggagaggacggtgaatggggg

SEQ ID NO: 43796 - DNA, 14216 bp, Oryza sativa
gggtgttgggggatttcaaatcccccaccacttgcgggcgcgcgcgcgcgggagatgcgggggagagggcggcgacatgggcgcgaggtgcgggcgcggagtggaggcgcgacgtggagtggagaaggcggcggcgcgggcggttggagctctggctccaacgaccggaggtaggggacgactgacaggtgggccccacctgtcggcgcccgaaagagaaagggagggagggagggaggacttcggggaggggaagggaggagcgggccggcccaggaaggggcaccgagcgcggggagagagatgggccgacggcccatctagagaaaaaggaaggaaaagaaaagaaaaggaggaaaaggattttcctgggattaaatattacactttggtgatttttaattggttaaaattatttctaaggctctgaaaattccactaaaaatcccgttaatgtattgtgacatgtggaactcaagaaaaatcccacattgccaattccaattattaattgcctttattaattagggatttagctctaggttaattaagataattttttggacgatttatttaacaaaattttaaagcaaggaaaaaaaaggggaaaacttcagggcgtgacagtggcgcgtggggggcggggaggagcggtgtgcgggctctcccgccgcccacgaggagccgcgctgtcggcaactcccactctcagatccctctcgcgcgctctctctctctctcaccagggacgctattggcatcgcggtgacgcggtggcgccaggatcgagatcgggatcgacctccgcgctacggttggggggcaacctcctcttcacgctctttgtggcgggcgtcatcgccttcacactccttgctatggtccacaaccccgacgacccactactccaactcctccgatgtcgccggcgcggaggctaccaaggcggtcccgttcatcaagctcgacgacgtggcgaccaaggaggagtcagggtcagggccggcggtggtgtaggccatgaccattgacacagaggccagctcggacgtgggtgcagtggcggaggtggcagcggcggcgacagaggagaaccccatcatcgaggcggtctcctgcgacacggcggtgcctacttcgtcgcctgtctcctgattcctaaacacgacggccgtggcggcggtagtgtcgaggtcgacagccgcctactacatggtgttcagcgacgccgagctgataccgacggctgcgacgacggcggctgtgatgcagcaggcgccgctcctggatgacatcaagatgctgctcgacaactactagcctgcggcggcggtggcggtcactgagaacgggattaggctgctccctcgatgacgatgacgctctcggcctaacaccacacgctgagaaaagtgagagagagagagagatgaagggagagaagagaggaaaagagagaggaggctgatgtggctgtggggcccacatgagtcccacactgactcaaccgccatgtcagacaaaactagagtcaaaaccactgaaggacctgaagtgaacggttttgttagttgagggacgcccggtatctggttttgtagttaggggaacgattttgtaactcggcgacaagttgagggaccttcggtgtactttttccaacggatggaccctagaatggctccgaagtgaacgggtcaagcctagccaacataagtacataacaggccattcatgcttaggcgtatatgcggattcggcctgcatgcccaatattcttgggaaaaagtgcaccgaaggtcccttaacttatcagcgggattcaaaaacgtgctccgaccgcaaaaccagatatgtggggtccctcaactatacaaaaccggtcacccgagatccttcagcaattttgatcctggttttagtctacgtgacagctgagtcagcgtagaccccacgtgggccccacgtgtcagccaaccactctctctctcccctcctctcccatctctctctcacttatctcctctcgggcaagccggggcgggtggggaggagatcgctagggcggccggcgacgcggcagcggcaacacgaggcgacgcggccggcgacaaggcggcgggagccggggcggcgccgcatccacgaccgcctgcctctggtctcccgccgtccctcggaactccgacgtcggaaaattctaacgacgcccgctagctagtctgaccaccatgagcagactccctcgggattccacgaggttacgagcaaggacctgctcctcctcctcatcacggcgccagcaccgacggcgcgtgcatcacgctccagtacatctccaacatcatcatccacaacatccacatccatgattgtgtccccgccggcaacgcgaatgtgcacgccttgccgacgcactacgggtggtgcacccactccgacggcgacggcatctcgctctactcggcgcgcgacgtgtgggtggaccactgtgcgctgtcgcggtgcgccgacgggctcatcgacgccatcatggggtcgacggcgatcattgtgtcgaatagctacttctcgcaccacaacgaggtgatgttgttggggcacagcgacgagtacctgccagactcggcgatgcaggtgaccatcgcgttcaaccacttcgggatccagctcgtgcagcggatgccactgtttgccgatgtttgccatgttcttggcttgtttgccgatgtaggtaaataagtgacgccattgtttgccgtgttcttggcttgttttgctagtgagttgtgacagcagaagaggggaaaaaatgtttttttttgtgtgtgttggattggatttcgtctgtttgtttctcattttgtttcccgccgccgcgtcgctggccacgtcgcctcgtgctcccgctgccgccgcaccggccgcgtcgccttgtgctcccgccgcctcgcctcgtgctcccattgccgcggcgtcgctggctgcgtcgcctcgtgctcccgccgccgccggccgtccttgcgacctcctccccacccgccccggcttgctcgagaggagagaagtgagagagatgggagagaaaaggggagagagagtggttggctgacacgtggggcccacatgggtcccacgctgacttagctgtcacgtagaacaaaactgggatcaaaaccgccgaaggatctcggatgaccggttttgtataattaagggaccccatctatctggttttgcggttcgaggacgttttttatctcgctgataagttgagggacctttggtgcactttttccatcttcttctgtacggtagcggccggtcgaggaagagctgccgaacgagaaaggccagaacagcagaatccaaaccctcaagaaaagtgggcggcctgctggtttgcgggctaaacatctgtctctgtctgggataaaaaagtctatttataacccttacccatgggtcaaatttgattcgcactaactaccgtaaaaccaggtccagaacatctacaattttttaaaccaatgcaaatcagttcccttggggattttggactggtttcagctgacgtggcacatactaaccttgctgagttatcttcattagacatggcgcttatgtgtaattagccagtaaaaaatataattaaatatgtaatgagatgcacgtgtcagtgataactctatcataaaaaataaaaaaaactactggatccacctgccagccacatagaaaaaaaaataaaaaacctcaatctattatcttcctctcactctctctctattcccctcctccacacccagcacatccggtgatctgtgggacggcaacggaacagagaacgacgcattgagacggaagccactagtgattggcttgggcatcttctctcggtctcgtaccacgacaagtcgagaatactgcactaccttataccttgtttggttcacgggacgcattgagacggaagccactagcgattggcttgggcatcttctctcggtctcgttccacgacaagtcgagaatactgcactaccttataccttgtttggttcacggtactaatctatttagtccctctatactagtccttaagaattcaaataggggtaactaaaagggactaaaagtatatattgggactaaaatctatccattagtccctattagagaacttatagggaccaaagtggcagcctctctcttctcctcctcggtccacgtgcttctagtcccttttagtccttggattcaaacagtaggggactaaagtttttagtccggggactaaatgatccaaacagggcctgggttctatgggcttgtaagcttatttggctctttaccctatcaattcattagtagtgtcgaaatctaggtaaattttggcactatcaaaatattggtagggtaaatttatttagttaacatttggataaagctaaattcttatggtagatatgatcaaataggagaggggcactgtcaaatatttagtctcaatcaaaactagcacacatctgtacctaataaaaaatacgtaacgctttcggcgaaaattttcgtccgtcatccatcgcacatggaatcagcttcgttaatcaattttttttgggcagtaatcatattcgtttcctaatctaaaaagccaggcccaccatcaagctcaaatagaaactgtaagggcgcaaaatcaaggataaatctaatcataagtaaacaaataagaagataagagataagatttaaatgttaccgcgtgatcagtggtaacaaactaataattctatccggattgcccccgagctccagcagtgcaaataaaaaggtgaaaaggtgttgagaagaggtaaccaaccaaaagcaaaaccagacatcggcttcaatggcttcatctcagtcagagaattaattttcgtaattgaaaggtgattgtttattagatcttgtattagaactccaacattgtggtatcggagcttaaatttagcctacttccttattcacattatccctgtgattagaagccatcggtgccatcttggttcgacatgaacaattttgagtcaaataagtttattctaatctgtttaaattcttatctttactgcttagtgaagattagctattgttcatgttcaattaaagttaataagattgagttagggttcatgatgcactgctatgtttagacttattttaagtttaagttttatgtccaattaagcttcacttagcagtataattaagaaattaagggtagggaagaatgagataaatcggtttcaattttcccgaaatccccaaattgaaaagaacactaagcctcaaaatccgaatcaaatccaaatccaaatcaaattaagaaaattaagtccgagtttggattcttaccggatttggagccctaattctaccgggaaaccccaccgctatttgggtctcaccgggaagcgggaccgctgcccttcacctcctcgcggtcacgttggactccccgtgcgcgtgccatctaggtgttcctccactgtccctcactggggacatcaagcgttggcttagtgccgccttctggctccgtccccccccccccgggcgaccaagcccgagtgttctcggcgcccgtcgccacttgcacgcccgctttgtcagactgccgacgccatggcttggcttggcgccgacctcgggcgggcctcccagccggcgaagccagagccgcgtgcatgcttcaccacgacggaccgtcgtcaccaccatcgctgccgtccactccctcgtgtcgccggagattagatccgggagagtaagggagaaaggggattagggttagggtttttagacccctcccccttccggctggcgatttcatcggcgcgggaccaatctgagccatccatcagatcggacggctcagatcggcccaacgtcgagcctgcataagcgaattggtccacacgcgcttgcccgcgtcaaggtctcataagctcacccacatgcttgacgagccgtgcctcgcgccccacgggctggcatgccgtttgggccgacaccagcctctgggcaaaaaaattcatttttcatttattttcaccctaaaatcacttattgttttatttaataataaataattttagtcaccttgagtcatcatttcaagctataaaattgcagtaaattttatagacgtattttaatttatttctaactaaatataaccaacgggaagtttagttagaatatttaattattttttatcttctcagcctaatggagttatgatttaggaatatttttgcactttgattttgtttttcttttcttttttttcctaagtggaaccaacaagaaatttagaaaaaaaataaaattattatgttgtgatacttaaattttaattattagtatttatttattgttaatattaatatcattttcacccgttgcaacgcacgggcatattgctagtactatttattttgttaacaaattggtagggcatgtttttgttatcaaaccaaaatggctctatattgaacggagtcagcaggtagatagataggtttgtaggttgtaagatatatttctgaagatgaaagaaggaacagagctcgctgtgagcattaaagctaggagtgagatgtgctatttatctcagagataaacatacctcttgttttagatttattaagtgatgatttttttacctgtcgtaaacactaattaaaaattatttttactatctagcagtcatttaatatattggacgttggggaacctaagtacctaacccatctcgccacatgtccatatgattgtgcttaattttaatttgcaagctcaataatcagtataatatgctggttttgtaattgttgaaacttgctgaagcccacagactggatcagtataacgagctgactttcggcaggcatttgccagccgtgttgccctgtcgtacagctacccggccatatggctcaaatcaatttatcaatggccactacccactatcagtgttgatatattatggtatataccgcctcaacgcgctccatatgacctggtactcgaaacttaattaacatgcatgtcgtcgctctgcttaattaagataattaagttcaactacgaactcggcaattaaacaaagtaaataagctggagagactaattactggatatcgactgcacccacgcacgcacacatgcaggccaagtcaattaatggatccgtactccatctcactctcttgatcactaacggcgacatgttcaagtagatcatagtcgtcatggcctcatggctagaaggatcgcgggagaagtcttccatacatcttgctatgtacttcgtatatatactaatccatatagctagagagcttaacaaccagtcaacagtctgggggagatatatatatatacactacatctattaaagaaaatatacccctctctgtcctaaatatttgactctgttaactttttaaacatgtttgaccattcgtcttattaaaaacttttaagaatattattaaaaacttgaatagtagtagtatatttaacaataaattaaatgataggaaaaataataattatataaattttttaataagacgaatggttaaacatgtttaaaaaagttaatggagtcaaatatttttggacggatggactactggtgtgtcatttgatcgatcagtgataagtccattcaactcgacgccagtttcatctatcgcgcatatcgattatctcaaaatacatatatcacgcattgtttatgcatgctagaatatgtgcaggtcaggtcaacggtttgttgctgacagctcaaaggaagttaattagttgtagggattttcttttcagtctggtaataatatgtagtagcagaaggtatattttgcactcctcaactttcaccaaaacttaaataacaattttcaactttctagttaaagatccgtgcattgtaacaaatgttgtaagagataaaagcaaaaactgtaagtttcagctagttgattaaagcatatattaattgatagaatatgttcgaagactccaactgattttcacaaaataaagaggcaactgtctataaaaacagtgaaaacattctaatcaggctcttaaaaatgcatagtggagactgataatcataatatcatttaaggttagtactatcaacagtaaacctattataatacacggtagccaggatcctcgctcgggtagccaggggaactacccaggacggcagcggcggtgaccaccagatctgcgccggtcccgctggatatcgggggtggcagctggcagcagtaggggtgagctgcgctgggtggcggtgtgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatatcaatccttaaaataaatagaggacttatttacattaacttaggttgcagctcagacagcccgagaatacaaccgacgacacggacgaggcgaacaccaacaacaacaacagcagcggaaccaacggtctaacacccaacaccacaggcgacggctgggaaccaggacgaaaccctaatcttcacttcactttatcttctcttcagggcggaggaactatatatatatatttatatagagcaagggtgagtactttcgtactcagcaagtcacgggaacttaggtgtttaatgcaagcttggaagagagacaaggttgttttgcaaatcttttatttgaagacattttgaaatcactaagtgatttatttctttctaagtttgggccgaaaagagacttgcgtctcgattcgactttaagagatgtttttcaacagctcatttagtaatgtaccgacctctggggtcagatcattacttctcgactcccatagccattccacttgattaatcggctcccagagcctttttcattttctcggactcccagagtccagctgcccagcagcaaagcaatcctcttccactcgggaagcctagtctatgatgcccacagacatcccgaatcacacagattcgtttctgaccactcaggtcatccatctgccacaaaggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacctagggatacctcatgccacatagaaggatcaaatcctcacataaacataggccattttaggcgttcaccaatcaaactccaaccacctcgatcggtaattcagcaagcttctcgttcttgcattaccaggaacccggtttggctccaaccgaccccgccccggcgttcccaactattggcatgcgaggtttccctgaaccgactagctacttagccagggtgtcccattccaccttgtggttgcactttgattatgttcgatgagtttcccacaggaatcagtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaaccctcgacgaaaatccgataaccgcaactatacgcaaacaatcgaaaacctaaacaaaagaccaaaagaaagatcctatttagactaattagtagtgccattaaatagatctcaatttacggaattattggaagtggaacggagtcaatcggacgagcggttggggagatatggatttcctaagattatttggattttctgtctaaaggaaaaggatttatcaaatcccttggaaaagaaaaggaaggagggatgtcatttagacttactcgggcggcttaggctcggcccaaggggtcatgcgcagcgcggtcaggccattgggccggcgcgggcgcggggagagagaggccgacgcgggtggacgcggtccaccgcgcgggacccacatggcggtggttgggttcacggtggggagggcgcacgcgggggcgggcgctagggtttcgggtgcgcgcggttcgggcgcggcgcgccgggtggacggatggcggcaggcccacgtgcagccgcacggcttgccgtggaccgcgcgcacgggagggaagacggagggagggggcggctgactggcttggcccggtcaaggccgaggtggcgccgagatggcgcctacgtggcagccacgcgggccggcgggaggaggaagaaggggcggccgagatggacggcggacggcggccgagttcaccggagctcgtcgcgacgattcgagagagagggagtacacctgaacgatgggacggacgagagggagtgagccaccggatcggattcgccggagggaggccggcgacgacgaatcgcgacggcgcttgccggcggcggcaaaagagggaaacgacgacgacgcgatgagagctcgattcctagggacttgagcatctacgcgacctcctgagttcatttctagagtcggattgggtggagctacaccgaggaaggccagcgacgagcggctactaccgagtttgggcagcgacggtggcgagcctacgacgagcagcggcggcggtcggggcggcgccagcttgctactggaaggctactcgcactactgcccagagctaaggagaggagagggagcgaggagggagaacgggagatgcactaccgagccgagacggacgctgtgacgagcggccgacgacgcggaagcgagctctccggcctcgggccgggaaaggggaaggagacggcgcctggagtcccgcgtcagctcctcgcgcgcacgccggcttcaccagcacgcgcgatggaggagggaggcgaggacagcggtagcaaggcggcaagggcacggtggtggcgagggaatgaacgagagggagatggggcggcttggtttaatagatggcaatgtcggtttagggaggaagaactgacattggcggtcaaggagagcgagctggcggtcatcgacgcgtgcagccaaggcggcgacaggtgatgacgccggcggtgtcgggcaaaagtggaaaaggaggggaaaaaagtgagctcttctctttgccgagttggggagggagagggataggagcgggagctcggcctcacagttttggcaggacatgcgtggaacggctcgggcacgcgctgtagagctcgcggcaggcagcggggccgagcggcagcgtagcgcaggcgctgacggaggcggcgaccgggcggtcggtcacgagcgtgcgcgcgcgcgcgggaacgagcggcacagccgaaaatcgaatggcggcagcgggaaatcggcgatggcggcagcgctagcgtgggagagagagatcgaacgagagagagagagagacagcgagagagaggaagaggacgagagagcgagagaacgtccgagagagggaagggagagagagacagcgctctctctctctctcggtggtcacgtgcggcgcacgtggagatggagggagctgagaagagatgggccagcggcaggtttcggcccaaatcatcacgagggaggtaaaatagacttttaccggaaggtttgatttggagagaagtttgatgtggagattgaatttgaattcaatttgtatatttgtacacgagggttcaaggtggatccaagggaggggtcaaggaagggcttcaaaagcgggaattttggtatttttgggatggatttatatttggcggcacgaaggattatttcagaggatttcaaaaagggaagatcattattcaaaaatggaacaaggaagatagcggtagaatgccatggatagatagatagacagaaaggtaggttgataggtagagggacagatagacagatggatagataaacagatagataggtatagtagatagatagatggatcgatcgatagatagatagatcgagactcagggagagatgggatggaagagaaggaagaggtggaccggaaaaaggatgaaggtatccaacctatgagggaggttaaatagactttcacagagagatttaattgggaggttttagggttggagtctggattcgaatttcgaggttgatactcggtctcgggagaataggaaggagtcaaggaagggaacaatattcggagacgagtcaaaaggggatggataatttagagaaagagagtgtaacttgggagtttgtgtttgactactcaacgagatatgtggtaaggattttggagagaagtctgaatagaagggttcggacttcgagattatttcggaacggaaatcattttggggagaactcagggcgaaagggattgaatcttgggattttgagttcaagggtggaagtgatctcgatttgcatattcagacttggatcagaagttcgagaaagagaacaagggtagattgatgaaccaatacagggagaaagatagatgaatcaaaacctgagaggttgaattcgaatttgagaatcggtttgaaggaaccaaggagagagcttatgacgcgaaggtgaatccttggacggagttagggttcgggcattcgacaaagttcacggatggggttccaagaggggattccgaatataaggaatcgagcttcgggactatattgggatggaaattttgaggagacgatctttgataacagggtatcgagacaagggagggatttaaattgagatctttggcacaacttagactcaacactcaaagaacgaaattttcgcaattaggattttgccgaattagtttttaacgtctcacgaaaagcagagcgttacacggtgaccaacagcggtagggatggcgacggcggggcggatccgacatccccggaggcaatctggcccctcagcggccagatcgagtggggcgagctcgcggtgggagagcccgtcacggcagcgagcgggagcggagatcgcgacaacgcagggctcgcggtgatggcagtgacagcgggtggccggcaatgacagtggatggaggtgcggtcggcggtggcagcggctagaggtacggccggtggcgacagtgacgaccgacgaggtgcccacggcgcgaggaggcgccggaacggccactagcgatgtacgccggggaggctcgggtcggtggaggcagtggccggcgtagcgagaggcgacgaggcgcggtcggtggtggcatgtggaggctggccggcgggggcggcggtgcagtggtgctcacgcgccggcagaggtttagatggtggtggagcatcggtgtgtcaacggtggattggcaagcggtggatggcgggtgaaaacccaaggtaggcaacgatggcgctcgagtgtcactccccttcttgagggtgttgtcgtgccgtctcaccctttttagtggggctgccgggtgaaagcccagtcaatgttcttgagaccacgacggacggtgggtcggtggcggtggtgctttcgtcgcttctctctctctggagacaccctctagcagcaccattaccggaaccacccaaacatctgctgcaagctcgctctagagttacatcctcttatatcgacgcccagtttatacaagttagccacgtcggagggcctaggggggagtggttccattcttctttctcaccctctctccctaaatccctacagatgatgag

SEQ ID NO: 43797 - DNA, 5393 bp, Oryza sativa
tttgttggcctagcggcggccggtccggtgttacccttctcctggatttgtatttggcgctgtcggtgtgtgagtggtgctatacttttttccttttcctagttacggcctcataggattataatcttgtaatttttttctagtgtattaatatgtacttcgttcaaataagaaccttcaatatctcatcggctctccttcaacatcaaagaataaaaaaggggaagaaaacataggacaaatacttttttttgtctcatgtgtgtgcttgtcattaatatatccaagatttcgcgaaacgaccgttgataactcaaccctatttcttacttcaaaaaaatcttacgaatttcaaaaataaaaactctacagcagtacatacaactttttttgtccgcccctgaacagtgggaaacatatgctagtaggacaattaattacttgcacacacacgtacgatgcaccacggctcacacagccacaggcgcgcggttgttgcacccaacctgcaatgtgtgctggtgcaaagttgcgagattcaaagtttgacccagcgctaaaaagtggctggttcgcacgaactcatcgatcagcctaatattctataccggccacctgggcgccgtggtaggtggccacatgttacttgcgcaagtggtgcacggaacaaacaattttcgtcacaccttgtcataagctccttatttcgcaaataaaattgcatgcgtcggctaacactatgcgcgcacactccaaccactaccacttttgactgcggttgtggcatcgccaccaaccaatgatatggttaagctagtgctcgtaccttttttttttccatcacggttcacacacatgcatatatgcttattaactgtttcatattacatcatatccgtcctaaaatataacatttccagaattaaatatagttatacatacttattactatctacgtatcaaaaaataatatcgtataactttatatctgggcaagtgtatgtccagatatataaccaaaatctaccatatcgtgagacgaatgtagtaattaattgtttactattatatatgttttaaaatataaatatttttaaagttggataaggaaattaagaaataggtgacaatgattagttaaagtatgtgatttagttaaggaataaataaataaataataaacgaataataattaggattagttgagataagagataggtgaaaaaaatctttatttttttttaaaaaagttaagcgatagaaataactttattttagatagaggaactaccaatgaatcaagtgaatgatggagtcggtgaatttaggcttaaacgtggtacgtatgcatgctgtttggccacggctgctatggctcctggccttttggggtagcgccgtaccgtacctaccttcccaaccaactccaactttgttgagcttgaacacgacccgtgcgtggacagggtttacaaatgcgatctctgttgggagtatgacacccatccaatcaactaaaaccatgagatcgaaccggttgcttttgtcaacataatccattgaagttttgcaaaacgaaatatgagttccaaagctaaccagttgtttacgtgtaaatttgtaataattagttgtaactcgtttagcaaatgataaaatgttattctattattagaaaaggttacgagtgagccgacaacgaaaacaaactggtttacgcccaaaaccaacctttttttgtttttcgattgatttgacccaataccaatctattttgtggaaatgaaaagtttcaagtaacaaaaaatagaaatattgatggaaaagtgaggcaaaattttggcataacctttgctatagttatgatatttcagattttaaacaacactgacaatgcataatgtaacatataaacccaagtgaaaacatcataacaactgtaaaaaaaagttcatccatcaacagtacagcacataaaaatttagaggcacttttctgattagaggcgatttgtaatcgcctcttaagttataaattctacaggcgggaaacacttataaacaattttaagtgtactttttatacacttcctaatttgcattatatgtaaagccattgccttgagacatttttatatctctggaagggtaccttttagcaatttaatcctggtagcgatggagtaacacaaggcatatacaaccaaataatgagaggagtgagatgaggttgagatggttattatagagaagatggaagcagatagtgaagagtgaagagttgccgataggtgggtctactctcatgggctcacacgttagagagaaacgttcctacgatgtactccctctgtcccaaattttaggacaccatctttttaaggaaaatcaaactcgttaacttttaactaataattatactaaccatatatatgctaagtattatgcatgttatatcactttatttatattttaaagtactttcatgttatgctaatttcatatttgttaggaacataacatgtaataaattaatggttaaactatgtcattgaagacagtgtaaaaaaatatagtccttataatttaggatggagggagtactgtatgttagaggagccccagtcgagtgaagatagaaataggaattgtggttttttttcctttcttttcacaaatgcatctaaagaaatattacaagacatgaaggcttattataaaacgcctcatcatttttgaagacaattcatcacaagactacagtgatttattacaattttcactaccatgcctctacagactacagtgttataagtattgtagaaaaacagaatatgattacaaaaaatgattgtgatagagtacattaattcccagctggatacaattcacatcaaaattgcaaagtcaattctctgtctcgttgtatccgattctccatgcttcgatggggatggttcaaactcgagatatgaattcacgcaaaataaaggaaacatactggtattagaagtatatatataaatttacacggctacgaaatgcattttcccatatgatcaaatccggttttcgcaggcggctgggtgactcatgcctccccccccccggaccaccaccgcacctccctatcaccggatccgccaccgctgcgcctccccaccaccggatccgccactgccgtgaagggggagggtgaccgctgtcggatccacgcgggccgcaaacgccgccgccgttgcgcgcctcctctgctctccaccattgcctgagccctccaccaccgttggaaggaagaggagaggggagaagaagaggaagtcatggcacacctcctccgtcctcttgcactgcctgagcgctccactgccgttgggagggaggagaggggaggagaggaggaagctgtcgttgtcgcccttgcccatcgtcgccgccgccgccgccgttggcagagcccaccgcagggagggaggagggaggagaggggcagaggagtttgagaggagggggagagagagagagccgggagagaaaaggagagtgggtggttgactggttggagatagagagagatgagtggaaaataaaaagaagagtgggaatgggagggaggatttttgtatgcggatgaattaagagccccgaatacgaaaatacccttattttcgcgtgtgggtgttttaagtgatccgtttggaaaaattgattttttgcatacgggtctttaaggagccgtatgggaaaacggaggtcgagttttgcatacgtggacacttatggtccgtctgtaatttattggatgctcgttcagaaaaattattttttagtaatgttagttgctgagcaaatgacaattgtcaccgctccacctaactcaaaaagacacagggagcttttgattgaaatggtccaaaccgaagagctgaacatctggttggtaaatgtctcctctcagttcaacgaatatcgggcagataacagattctcgcatatataattgtctcgtaataaactgtgcaatgtcaacctcattttagtagcacatttgttttggatagtagcatggcctagctttgtccatctcttttcttcccttctccgtgccataccacacaacattttgatttgggacaaaaggttggtgaaatggacatattttcacatatatatatgctatatttttcttctcagtttaccgaaaagatgtacccttatatctcgtcatcgattttgggtcaggccagaaaaccattggtaacagaatatatgcatagttttctttatcaataaaattaatgttttatttaaaaatcgataaaggaactttttacaaaattaggctagaaatggtctgtctattatgacaaggtaaacttttgcgacattaatttggatggcaacttcaacaattcaaattgtcgttgtccacaaatctcttggttgtagaagacccacgcgtctgcaacatttttgcgccgaaaacttaatacataaacttgatttgttgggatacatggtgcagaagatacgatcattaataattcaaacagtgcatttcatggtccaactgactgccacgtcattgaacccgtaatcattcgctaagccaaatcaaattggcctcaaatgaattttcagcacgactttttacgccccaaaaacctagtactccctccagttggaaatgtaccctaccaagaaacttgtgtccgtcacgacgcctgtatcatcaatctagtcctcttttgtaacaaaataattttagaagatttcttttaatgccgtagaaattaaattaatcctaatgaaaatcatgtaaaactcacccgttataaaatgtcactaaccccctacacggttggtgtcctctttgtagccgaaatgcctcctctttggccactgcatctccacccatttttcaaacatctccaactaactttttgttccatttgcaaaaatgcaaaatgcgaaatgttaacttcacacacacccccctaccactacaaaactctcaccaaccccaatctagctatcagttcagaaagcaccttcccttctttccctattagagcaagtctaatagtacagctcactactagcttcaatttatctataaccaatctaatagtcaattcatacaatagttgcttattatactattaatatatggtctcacctgtcatacacacagtgtgtcttatagtccgtgctgcagctggctacatatctgtagcctgctagtcttctctctcatcgtttatctcattaaaatatgtttatagctggctaatagcttgctaatagcatgctattgtacctgctcttaccaccttctttcccttttggcaaatggcaatgagtgcaaaaatgcttggaaaaataacccccccc

SEQ ID NO: 43798 - DNA, 42067 bp, Oryza sativa
  unsure (1)..(42067): unsure at all n locations
ggccccgccggcgcgcccatcgtcggcaactggctccaggtcggcgacgacctcaaccaccgcaacctgatggcgctggcgcggcggttcggcgacatcctcctcctccgcatgggcgtccgcaacctggtggtggtgtccagcccggacctcgccaaggaggtgctccacacccagggcgtcgagttcggctcccgcacccgcaacgtggtgttcgacatcttcaccgggaaggggcaggacatggtgttcaccgtgtacggcgaccactggcgcaagatgcggcggatcatgacggtgcccttcttcaccaacaaggtggtggcccagaaccgcgcgggttgggaggaggaggcgaggctggtggtggaggacgtccgccgcgaccccgccgcggcgacctccggcgtggtgatccggcgaaggttgcagctgatgatgtacaacgacatgttccgcatcatgttcgaccgccgtttcgacagcgtggacgacccgctcttcaacaagctcaaggccttcaacgcggagcgcagccgcctctcgcagagcttcgagtacaactacggtgacttcatccccgtcctccgccccttcctccgccgctacctcgcacgctgccaccagctcaagtcccagcgcatgaagctcttcgaggaccacttcgtccaggaacgcaagtaagttactatctcaattaattaccttacctgcactgcatatccccaagaatccgcaagaacaaatcctacctaattagtcccagattattatactaccccatttgatctctccttcaattttttttaaaattttattcgtcatcttgcgtatccaaattgtgtgtggtggtaggtgaggtgaaggtgactagtttggttgcatcttgcatgcatgatgcatttgcatcggtgacatgaactggatgagcgaaaagtttggtagtaaaagcaatattctacgctagtagtagggatgtgcacatgccacgcgaggaaggggattaatttggcagcagcctcagatctgtttgggtaggaggaggaatcaaatcactttgctgttgctgcttgctgtgctgagcggtgacagcacgaggtggtagctgcgaggtcaaatttctggttgtgcaacggcttgactcgggctcgacctgtgccgcggagcccagctaccaccccgtgccaaagccaatgtccacgtcacggttgtttaaactctggagcctaattaaagcggttggtttttggcatgttgggatacatccaaccaaggttgagaattagcggttaaaattcctgtgtcacaaatcttatagattaggtaagcttcaaaacttttaaggcttagttcggcaccccaggttcccaatccaaacatccagtatgcaaaacggaacaatccattagcacgtgattaattaagtgttagctatttttttaaaaaaatggattaattttatttttttaagcaactttcgcatagaaactttttacaaaaaacacatcatttaacagtttgaaaagcgtgcgcgtggaaaacgagagaaagaggttaggaacatgggttgcccaacacaccctaagtattcatatctttccaatatttacatgggagcaatatgtatagatttatctcgaaacttaattactttcatagtattagtactaacaaaaatcattagtttaagtaacactagggtaccagtaccatgtcgatgtccaaaatgatttggtttagtagtgacaacaggagattaatctgtaagaactggacttgcctaatgttcaaagcttccttttcctaaacatgcaaataagtctgacgagtaggtgagccgcacatcatgggttgcttttcgtgccagccagctgaaagcttacgatttgggcaaagtcctgcctcatcacggaagcaccgacggcgacagaaactctctaccagtaacctaaccgatcggaaattcatttcgttctcagcgaattgagcagatctactagctcccccatgtgctcaatgactgaaaaggtcgcaagaacttcagacgcttcccctgttttcttctcgatcagtacactgcataactgagtaatataatcccgtttgattggatcgatcaatggtgccaaacaacaacatgcagctatccctttgattagaagatatacaatttgcagcttgcatttttttttcggtttctggatcgatttgcgactgagaaactgctggcctttttggtagtagctgtgttgggaagcttcggatgaactgttcgactgacaaatcggcatggacgtgtttgtgtcttttttgcaggagagtgatggaacagactggtgagatccggtgcgccatggaccacatcctcgaggccgagaggaagggcgagatcaaccacgacaacgtcctctacatcgtcgagaacatcaacgttgctggtacgtttttgtttattccgcgcaggatttgacttttagtttatcctcagcttaattttctttggatcaggcctaaagtatatatcgtagtacatcatacgtatccatgtcatagttttgacaaagctggagttttactagtacttgaaaggaactgagtttgtggagaatagaaggttcagaaccaggccaaattgcaatgctagcatttttctaccaacacatcacatcgttagtgtggctaaaaagaaccttaattaagtatgcatcatatataatattgtcatgataggctatggttaaagtatggcttcattaaatacgagcttttatatgatcaggttgccatgttcttggtcttgaggaccagttctttgggtaagaagtagtagccacgtcttaatcagagtaaccattacctaacatacaattgtattttttttattatccggcacatgcccaatgcacaaagtcgtgtgggtacatatggtaggcggctatctcataccttatgattcaaaccatatgaactaccgtagatacgaaacatttgagtcaaaaccagtagtaaaaaaaaaaaagggtgtagctatatttatggcgccatatttttcaccaaaaaatagtcggtatgtatttacattgtaactccttaaattacatatgtaattttaatgtatttataatgtaagtctcaaaattacatatgtaattcctaaaattacatatgtaaattcaaaaattacatactaactatatatgtaagtaggatgtaaatgtggtgtaagtgaggtgtaatttctgtgtaaatggcttaaaaaagtcgattatagcatgtgtcgacataattttagctaacccgatccggtgtcgtgcttgattcatatcatgtaattatcacggcacgaatctttgtggggatcgagtgatccagaaatcgactgtaacgaagcaaaaaatgtggcgacagtagtttagcaaaacccaaaaaaaacgccaattttagttggattattattttttagaaaagagtacaaaatgttaattaacaagaagcgtacttttttttgtgcgaaatgtgcagctatcgagacgacgctgtggtcgatcgaatggggaatcgcggagctggtgaaccacccgagcatccagtcgaaggtgcgggaggagatggcgtcggtgctgggcggcgcggcggtgacggagccggacctggagcggctgccgtacctgcaggcggtggtgaaggagacgctgcggttgcgcatggcgatcccgctgctggtgccgcacatgaacctcgccgacggcaagctcgccggctacgacatccccgccgagtccaagatcctggtgaacgcgtggttcctcgccaacgaccccaagcggtgggtgcgccccgacgagtttaggccggagaggttcctggaggaggagaaggccgtggaggcgcacggcaacgacttccgcttcgtgcccttcggcgtcggccgccgcagctgccccgggatcatcctcgcgctgcccatcatcgggatcacgctcggccgcctcgtccagagcttcgacctgctgccgccgcccgggatggacaaggtggacaccaccgagaagcccggccagttcagcaaccagatcctcaagcacgccaccgtcgtctgcaagcccatcgacgcctaggtcgatcgatcgacctactcaaatcaatcatgtgctgcgttatcctattgcactaaaaaaaggttgtatttttgtttggggggggggggggggggtagttatgtgtgtgttctgtgaggcaggcacctgttgttgtaggtttacttaacttttttttttcttatacttgttggttcaaacttaattattggtaatctatactgcccaaacattgcaaatatatcatttctggctatttacacttcatcaagacaaattccaatagccctattacagctcgtaaaacacgtaaccttgagaacatacagcttttgcctccacattggtatataggtgtcggtgtcgccataatttataggtaagtttgttaagaagattcctcatagtgaaaaaaaactgaaaatgaaaaaaacgcagcctacatagtactataggtattgaaaatataagcacatataggtttaatttattttataaataaatcacgacattgaacatatatactagtataaacacatcatacaatttacacatgtaaactagatagtagagcgtgaacatatcgaatgtacgaaacattatgaatgcgtaccggcaattttggtcgtttggctgcacagtaggaacaactcgccataacgggctttgacgttgatgtgcagcacccgagcaaagaggaagacgatccaccataacgggctttgacaatgacgtgcaacactcgagtaaagaggaagatacgagctgtggtggacgaacaactagtagtcgcacgaaacgcttttcaaattcatatgtataatctcatcatactacttccaaaaagcaagccctagtggaagaagagaaagtagccgcgaagcatcgacttggcagtccaattagcaaagaaaattaaaaagaactctttagacccacctgccatccctttccctcaaccaataatgccaccatatatataatctcataattctgattcaattactgtcataatgtatcatcaccaaatgcattatcccacaacactactcaaatatctactcatctacacatcgatttcaatggattttctaagttaccgtccacggctatgctaaagactgcagcaatgtacagtattgtcttggttaagtatcaacaccaccaccatgagggagagggatcgcaggtgggtccagagagttttttttttcctgattcaactgtcacggtggcgtcactaatgcaagcacaagtcaaaacaacccagaacagtgctaagggatgtatttgtccaatataaatagttgagggtgtaaaatatcctgtatttaagtttagggagggggtaattcagtcgactgcgatagtttaggagggaattagtactttttactagtgaaaacgaaccgattgaggactcctggaaagaagaatcaggctgtgtttagaactaaagtttggatccaaacttcagtccttttccatcacatcaacctgtcatacacacaacttttcagtcacatcatctccaatttcaaccaaaatccaaactttgcgctgaattaaacacagcctcagagtagctctatataggaacagcacacagtgttctcttttcttttgtgttaattggatcgtcttttgttgggcatcaaaatttctgggcatgggggttcttgttggatgggttggattggccatactgcatctacttgtaatattcatgttggtatatatatatgctaaatcagactagaagaggtaattaagtggaatactaaattccttccaaactaaaggtacggatctatcattgtagaatattgcatatatatgtagatcatgaacctagatactacctccgttttttaatagatgacgccgttgaccttttctcatatgtttgacctttcgtcttattcaaaaaatttacgtaattataatttattttattatgagttgttttatcattcatagtactttaagtgtgatttatatcttatacatttgcataaaaattttgaataagacgaatagtcaaacatgtaagaaaaagtcgtcatctattaaaaaacggagggagtagaaaagaaggttatatatgatggaataaggattgcagttaacctcaccaaataaaggggtagatcagaatttttaacatttcacattgctcttgctgacttgctgttactctttacatcattacatctcgaaattgaacttgccaccaggcacagaacaacagaacaaagcaaacagaccgaaaggagcgaaaccaacatattagagcaaaataactttagattaccataaaaaatccaacatattatggaattggataatcaattattcattttgccaatatacaattctagccaacttgcggcaccttgctgatcccttcgccaccggttggaagggctccaatcaccagcacgacgcgattacaacagaattcatcattttcctctcgcccaatactattcgaaatcaagtacacaatatttgtcacctgcggattctcacgctttatggtgtcgtaggccgtgtcctggtcctttccgaggagctctggccatgtctgctctgcacatcgaccacaaatgatgaccaagaaatccatgtattataaattgttgttctccttcatctcaaacaaaaagtcaagtagaatgctggtgattggagcaggttgaaagaaggaagaagatgataagagggatgatgggtgtgttactcacttccttgacaaggcggtgccgtacatggctcatctgcagctagtatacatgtggttgaaattagaactagtagaataggcagcaggaggagggttgaatataatgggggttttggcattgtagatgcagtatacatgttcttgttcactcgatcttgttgcaggttggatttggggatagaagcatatatataggtcaaaagcagcatgcatttgatgggtttatctggcgtgagctggcaattgaagatttcaatcatttgtattcatagattttattgcatagattaatacatggattttattgaagatttcaatcttttgcattaatggcttgagctggccagtattaaatttgtggacactacagattttattgcatatgctctagatttatttcatttagagtgaaactagcaaagtccctgtacttcgtagagggatttacaagagaattttattggatgtttatgtagaaaattactccctccattccaaaatataaagcataaccatcattaacccaaagaccaagaaataattattatcatctcatagtttggattaccctaataaatagaatacatgcacccaataaaattaaagattttgatggtggaagatttaaataataatattgtagtggaaaagaaatgctaattaatgacatgcatgcatgcacaccttatattataaaacaacttttaaaatagttatgccttattacgaaatggagggagtgcgttgttttgctagttcatttaccgtgtgaatgtacatatcttacggaattaagcgacagaatcgcatggcattgtaaaggaaaattaacctttgagatcgagattgtcgttttctttttaaaaaataaatcatttgtggatactacagattttattgcatatatgctctagatttatttcatttatagtgaaactagcaaagtcctatacttcgtaacgggaattacaagagaattttactgcatgtttctgtagaaaaaaaatattttgttttgctagttcatttaccatgtgaatgtcaaattcttatggatttaagcgacagaatcgcattgcgttgtaaaggaaaatctaccctatgagagactatcgttttctttttaaaaaaaaatcaaaattagaaaatactagtcgccaatggctattattgttttattataaatattatgattttaggaataaggtaaacatgctgattatttttcaaattatatctacttagcctaataaaagaatagtccacattaattacaccttaagaattattaatttaaaatttttaattaaattaataaatactgttttgatagttcatgatatttcgagctgctactttgtattcagactgatatatatcaatatatgttctctgttcgtaaataaagattaaatagctcagttttaaaatgcgtttttgtcagttgattggactataattacctgaccactcattgataaaacagttcattcaatagacaagaagcaacagaattcattattttaatcaaaacaataacttcacgaatgtgttcattaggtcaaatataaaaatgtaaattttagatgcaatgcgttcgaatgctgctggttacttgttagaatctaaggccctgtttggtacagctccaactccaccttcctagtttattttgttagagcgctccacccagctcagctcctattttaggtggagctgaaactatttggttgggctccagctctaggagaggtggagctagagctggacctgtgccaaacagaccctaatcctagaggcaaagccaccacagatcttaaaaaccgattgtagggatgtaaatcagacatatgattggaccacgtggctcctgagaatttagagttaggtcctctgaaaattagccacgtgtcccccatctttatcttctcaagcccgccgttcggctggaatatgattggtccacgtggcacgttaaatttgcgagtaatttgggagtgcgtttctctttcgtgcgcctaggtgccaggcccgtctccctaggaaagtctagatcaatctagctggttacccaaacaattaaaagccgcactgggcttcacgacccagtaaggacgtcttatgccactcagactctcacaagtcataatcataggctcacagtctcccgccctcacgtagtcacttgtttggatttgtggtgccactgtgtgttgctcctcgagctggagtaatcataaatagaggaaaataaaaaacgaagaaaaaataagaaagaagtaaggaaagtgtgtttttaaatagatgacgttattttttatctaatgttttataattcgtcttataaaaaatataagtaatgattaaaatgtctttaatgataataaatgatactcacatgattttataaataaaacaaatgttcaaatgctatatttaaaagtcaacaatgtcatatatttaaacaaatgttgaagtattttaaatccttgtaggacatactgtaggttaagtcgaaagataaatacgaaataggagagaagtacatgacaacattaatatcctatattttcagaagaaacagtaaataggaaaataaatgaaaaccatttaaaaggttagatccaattttgtgttttgagaaaccatttttgaaaaatatttgttatatactacctcttccatcctaaaatataagaatttctaacaattataaaaccaattaagcttgaagacaaaactagctcgtagactcccaaaataactactaactcatataaatacatgggaaataaattaaagagcgccaactggcatgtttattttctagtttaatttcgagttccagacttgaagtcgcatgagtttcttcaccacttgattggttgggccaagaagttggtcagttgggctgaaagggatgggatatggcccgacaaaaaggaaaataaagacgggctaaaacctaccataggagatggtccacaggacatatgggtcccactaagtctaagccctttcggctgacttaccacaggaggtggtccataaaacacatggatgcgataaaattggttatctttgtgaatggaaaacaaaaatcagaatggactttcagttacgaatagtagtatcaaattttgcagaccactttgctcttgcccaatcaaaattagcgaaactatacaaacagaaatctcaaacaaggcatttgatttcattcacgggccatctgcaaaaggagttgacagtgctggaaggaacacaaatcaagagctagtttcagtcgttgctccctccgattcccgatcacagcaactctccctaacatcatccagcaatgacgatgcagtatcctgcaacaacagcgtgtgcacctaattagaatgcagagcacttgattcactcgaaaaggcatcgaatcctgtcatcctgagttgttctcaaaataactttgtaccaataacagaaaaaaaaatgaaaggctgtgtctcagtgaatctaatgggaatggaagcatttaccagcgaaccagagtgcgcaatcccttcctttctcttcctctcttccttcgatctcagtgattccactggagtgtaaacctgtcaaatgaaattgagaactagccatcagcatccaacagtagcacagaaaacaagcttaaatcgagctaaatcgaatccgcgggcggcacgcggacgaacgagagtacgagactgacctccggcatgccgatcagccgcatgagctccgcgacgaggcgccgctgctcgtcggcccgccgctcccactccctcgcctcccgccgcagcgccgcggcgcgctcctccagggccctccccgtcacctccctcgccgcgcgcatccggccccgccgctcccgcgccttctccagctcctccgccagcgacacctccctcaaccccaccctgcatcccccggccttcgcgtacgacctcaccgacggcggagacgacgccgccctcgccgtccccttccccttccccttccccttcgccgccttcccggcgagcgccgcggctggggaggccaccacgttggtgtcccgcggctgcagcggccgccgcacggcgacgacggcgaggcccccgcatcgcgcctccatcgcgagctgaggatgcaggagaggcgagaagagagaaaaggcggcgattgattaggaggagtttttcaagggggggatttggtgggatgggtgattcgaatttgaacccgggatggaagggaggtaaagtaacggctagtaaaacaggttgccctacgaatggacggttctgcccctggggaacgtgggggtatcaggaagatgttgaggggtagttacggtatgttggagggggtatgaatatgatgctgttttgcatgggttctaggggaggcttttgacgatctggctttgtgctgggtgtcatctagcgggttcggtggcttttggggccattggaggtttaaaatcgagggcccaaagcatgaaagtgatgcttctgatctgagccaatatcaatacatgtaacacaccacaaacacagatgtttatatacacgtgcgcacatacaatatagctatgacagtattttagagactaaatcagcatatcttaatattgataaaatcatcacaatataataattcaatcttggagatacgctaaaccgcacccagtgtgcgttttaactaaaacgctcccctcacatagcccccccaaccttccaccccctccccccacccccatatccatccgcacaatctttcccacatccctccttctctaaaaaattctttcgttaaataatcagttactatcagctgttttagttcaataagtaaccaagttactatcaagtaaaccattttttaatgtactcccgcacttctttcatgattggccccattagtaacaagattgctcaccttttttatctactcccgcacttctttcatgatttgcccattagtaagaagattactaagtcgatcagctatgagtaaataagttactaacactcccgcactcccaaatcgattccatctctcagtaaatggattactcctagagtcctaggttgttttcaacctttctcaatttggttcctcctctcagtaaatgaattactctcacgacgttctcatctcttctcttaataagttagggtgtgttcgcatgtgctagttccgatccagggctgttgggaaccttgaccgtgtgggtcccacgcatccacgtgttgtggcgctacagttgttcggaagcaaatggctcgaacggagttacggtgccgtcacggcttccttgcctatccctcgatcccctttcttccgtcatccactcctctcgctcgatcccctttcctccacactcctctcgctcgatcccctttcgtccacagcgccacgacgaaattgccgtagggaagcagaggaatcccccctgccacccgcgaatcgattcttccacctacaaaatcgcaccgccctcaccaatcccccctggaatctctgctccaacgagtggtcgctgtcaggtaaagctgccggcagcacgacccagctccatcgattcaagcgagcagtatcgccgcaggctaggagcatcggtgcaggaggcagtgctgtggctctgggtcggatagtgctgagcatcgtcctggagggtggcaaaagcgggcaggcgtgctccctgtgcgcgtcggcatcggcgctcgtccggccgagtcatcttgtccatgcctggcagcgcccgtgctcgtcttggagcgagaacagttcgcacggaattgaagcgcggaggcagcaaagctggcggcctcaacaggaagccagctctatttgaggaggcggttgtggatgcggcaatggaggctaaggggaagaagcggaagagagaggttgaggtctcacaccccgcattggagagggcggtagttcctacgaactccgctctaccaatccaccgatccgctctggagtccggcgaggactcctccgagtccgtcacgtcggacgcgggcaccgccaagcctccagccaaggacgtcgtgcatgtcgccaatgcactgtgtacggtgtgcaccaagtcccccaaagccgtcatcgagttcgtgcgccgagtgagcccttccaccgtcagccgttcaattgactgggacctcgtcaacgaggacaaatcatcgaaggtatggctggctggtgtagtttgtttatgtcattcattttgtttgttgactagcatttcagtagatgtccgaatcgcgtggtcgctggaccgatttcgagctgcatgtgtttcttgagagttgcttggaggagatggcggcattcaacataacatcgaactcccccaaacccaaggcatgggagaacttggtgaagaaaatgaagaacaagtgcaagaagaagatgacgaaggcgcaattggagtatatctgggggcagtgcaagaagcagtaccagctgtgggtgtggcttgaatcgtaggcgaccggacttggccgggacccccttactgcagccattgtcgtcgacgaaagctggtgggaatgccaaaatggggtatgctacttgtacacaaattcattttgcaatccgattatcttgctaccattgtgttaccatcatgtctaatatgaacataggcagtatgtagtaaacgttttgggctttggggaatctgattggtgccgctagtataacctgatcagaaagcaaatgatctagattgttttcagcgtataatgaggaatcaaacagattctagaataatttcagtagaataaatgcattctcaaatttcggttggataatgtgcttctgaggaattggataatgtgatgctgctgccctttgttctctagtgctatatggtactataaattggctagtccttagaagtgacttttgaagaacttaaatggagctgcaagtacccttctttactcctaggggtattagtttgtcctatcagttaatacaccagttaaccatttacgcatagaaataatgaatggtagaatgaccaaaaaatgtattgatctatgtttcatgtgtcataactcattcctttgcaaacacttatcaggaggtaccataacccagtaatattattcttacatgtaccataactcattccatgcagcgtagtcacagaagtgtgaaaataatttgaacactacatcttttgctgaaaattgtttcttattttttagttcctaaattcttaacaacattctttgcatcaaagtccgctatatctgctcatatatgtgtcctattggttatgatatgttttactcatttcgctaattacattactacatgccatgctgcctacactttacatgtcatcttgtctgtactgtgccttgtcaaatatttcctctataacaagttccatgtgtacaattgtgacaggtgaagaagggtgtgatcgccttcagaaacgatcccctgaagcacattgatcttcatcacgcggtctttagcacgcgcaccgttgtcggcaaccactccgccgtcgctggggctgaccaaggcccaccgcaacaacccgttgaatggcagcccattgacatcgacgagctgacagcagcgtacactcctccaccgcccgcgccgtcgacatatggtcagagcaatggtagtaagggcaaaaggaaggcatccggtgagacctctggaagttctaacaagcggacacgcagtagcgattggggcgatgcgcttgacaggctcagtgtgctgtgcatggcgtccatggagagccacgcaaagcaaatggatgcttggaaggctagcagccctgacggttgcatggagttggaggaaaaagatggcctccggccaggtagtgaggtctggtttatggccgcgcgcttgctacgtgatgcaagcaatggccactgctttatgttcgcgcgcctcaccgacccagatgatcgcctgcgatatattttaacaagtggcaacgggtttagtggtgcatctggtggttcgaactagtatcagctactctactcctgtttgtttcatgtgttgtgtgttttatttccaactaatcctgttgtaatgtgaaataacttgttcgtggtaacatttggtgttctgtgttgagtgtaagcatctctttcgacatgaacattaatttggtttaatacatgtgttatgcttcattgtctgatttcatataagttggtgctttcaaataaattgttgcattacattccctcatgatcacacaaattgttgttttaaaacgaatgtgtgctttcaaataaatgggttctttctaataaattgctgctttctgataaattgttactctcaaataaatcggttgatagatttgttacaggaacgcggagatgagtagcaatgtcggtccctacggctgggctgatggccataccagcagcgaggaggaagatgccatcatcgacttgctggccaatgagatcaggagaaatgaaagagcacctaaccgaattccagttcagaccggtatcagtaggatgatggacacgttggcgaatagaaggcaatgtcgggccatgttccgcctgaccgctgaagagattcacagtttgcacagccttctagtaacttcttatcagcttgtcgatactggggggatttcttcgctagaaaaattggggattttcttgttcatgatggctggcggccgttcgacaagagacgctaacaatcgttaggtccggtcgaactcaaccgtctctatttccttcaatgaagtattggattgtctcgacaagttggctaggaaaattttgagaccaaaagataccaacttcaggacatctcacataatgtttcaaacggaggaatggtacaaaccattttaccaatccgtgggtgctgtcgacgatacccatatatgtgttgtgacttctgcatgcacgacgatgcaacacataaacagacaccatgtcacgacgaaaaatgttctcgtcatatgtgatcatgatggcagaattattttctgtgattcaggatggccaggatcagttcatgatcaaaggattctgaacgaggatgtgcagtactatcccaatgattttccgcagattccgcgaggttagtgaacttcacttgttcactttacaaactttggtttccacactccaatcaatttatattcattgcggtgcgatttaattaattatccataatatgttctacaggaaggtatctacttgtggactcaggttttcctagtaggatgggatttcttgcaccgtacccacatgtacagtaccatagggatcgattgggacgaagacaagcggcggcacccgaaggccgagaagagcacttcaaccattgccactcctctttgcgaggtattgtggagagaactttcgggatcgtcaaaaagcagtggaaaatactcaaggtgataccgtttaacccagatgatacagttggaccacggatcatacatgctgcttttgctcttcataactttaagaagaattataatgatgatgtgaactacgtttaaacaaatcctctgtacagcagacatcccattccgacgcaaccgggaactttcaatgcgatgtactatgcaacaaacaacgaggaagcgatgagatgagcagatggcgcgacctcattgcgaatgatgttttcagtcgctctcaaagatgagcagcggcataatgtgctttctggtggggttgagatgaatgttcgtaacaactacataaggattgatcaaatacaatatgagctgcctttaattatcactttttgatgcatgtcttaatttcgcaataaatttcattcagtcgctgtcgaccattcctcacatcttatctgcgtaatcctaatgcccgaaacttcttttttagttctttgctaatcacgtggtcttctgaatttacagcggccaactatgcgttctgaatatagattttttcaaaaaaattccctccatgcaatacaaccatctattaacttattaaagaaatcacatgtgtgtgcatatcaaatatttctttcacaattggtgccgcgtagcaaatacctctttcacccgtgtgttgcaaaaaccacccattttcgcatgctacagtacctccactgccagcccctgcccggcatcacacggcacggcaacggaaagtgtcggccatagacggcgtccaggctgccgctttccctccgtccctgacgccctgacgctgctacagtggtctacagtactacatgttcccaacccaaacgtaaagctccgatccggcacttgcgaacgaacccttacttccgtttttttgacaaattgacccttttggaaaacttatttcgaaactaacccctgccaaaaacttcaaccaaaaataggccgtcgcctcagcgccaaacacattggcgctgacgttggccgtgtcagcgccaacgggactggcgctgacattgtgccaccgtggcggccggggccgatccccagctgacgtggcagctacctcagcgccaaccggactggcgctgaggtgggacttggccgcaaccccaaggcccagaccagcaagccttctggatggcttgcgggctgggacctcagcgccagccataatggcgctgactgtgggaaactcagcgccagccaatctggcgctgaggtgggacttggccgtttcggccgtggcccagcccagcaagacttctggatggcttgcgggctaggacctcagcgccatccataatggcgctgaccgtgggacactcagcgccagcccacctggcgctgaggtgggacttggccgtttcggccgtggccctgcccagcaagccttctggatggcttgcgggctgggacctcagcgccagccaaaatggcgctgacattgggaaactcagcgccagccaacctggcgctgaggtgggacttggccgtttcggccgtggcccagcccagcaagccttctggatggctgggctgggacctcagcgccaggtgcactggcgctgagtttgtacatgtcagcgccatttagcatggcgctgacgtcccagccctgctaaactttagcaaaactttgcacacaacacaggcaaacatcaaatgacagaaatttacaggcagtaatatatccagagaaccatacaaaacatacatccatccatcaatcccaacatcattccatacatccatagaatccatcaatacatccatatatgaagtccatacatataagaaataaaaacatcccatcgatcctcgtctatacatccagtcgagtccatacatccagtccatacatccagtcgagtccatccatctatccatccatccattgaaccatgcactcacctcctcctacctctagtgcgaggacgaggcacgtcgggggtgtacctccagtcctgcgaaggagcccgccggcttcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacagttagtactatatagtaagaaaccatcttcatgtgtcatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatatctccaccagagtcagggaacagaatactgccgaagatgtacagcacgtacgccctgcagtatcgctgtactgtagcctcgtctgcctcagcgggacactgaccaaagttggctcgcaaccaactcaaaggaacccctgatgtctttgtctgcctctgaccatcaggtgccactggaggctccagaccaaggtactcctcgaccctctccctccagttccccgacgctgtgtcacctgtaaccggataggaagtggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttagcccgccgtaggtacgggacgtaccggtcgtcgaacagtatgtgcgccgtgtgacctctgactcgaagggtcttcaagcgctgcatcaaaaataaaaatgcgattgcttgattctttttctcttctgcgtaatcaagaataatataaaatcataaagattgaaaacaatccttggagcaatggtcagaatattaacaaaatgcgattgcttgattctttttctcttctgaatcattgcctgattgactgtatggtataaagtcccttagttattcgtatatatgtgtgccattgtgtttatttcagcttcctatactttaggaagcttctaaaagtgcctttgctactaccggagctttcactttggattttataacaatttcctgcacaactaccatgtagtgtgggactaaaaaatatttgtttggattcagtatgatggatcccaatcccaaatcagacaacccttctgagaccattttttcttactcagtgttgcatcctgttttgtccttagaagtgattggtaggaattgatatattgctaaatgatgatacattgctaaatgatgatacattactcagcatttgttttgatttgagggaaatttgcgacgccaagattttgcaattataactctgcatcaagcccataattcagattcttcattttacttctcttttgtaaaattggcattcagtaactcaatttacaattattcattgtggaactgtgcatattattcaagttctaattgtttatttgatatattgactttcccttcgaaatggatttgtctagaatgcataaattggtgtttgaatccagattatcattctttcttttttagtatatggagcacacatgcaatatatcctgtagtcctgtggctaatcttcagaatcttctttgtgtgttcataagatagatagcaaagatctccaggtgcaagtggtagctatctaactacttatgttgacatttatctaactacattatacttttgacatgatggatgatctatctgtacaaactaaaatcaaagaagaaaaaataaattcgatcataaaaaaaatggaatattgttgatgctaacctctccgctggcaatctgtggggcccggtgcttctcctcgtagaaatcctccaaccccggaaagtgctccatcctgcaaatgaaaatggaatcaatagtaattgaaaaaatattaaatggaaaaatcacaatgagaacggaaaggaggacaacagaaagtaaacattgaagcaacaatatgaacttaggaaatgaatgtcatccaatcccacctgtgtgctaccctcaccacctccccccgtcctacggcgctttttcggtcgatccttagacttgtctcgcttcgggcacctagttttcttatggcctagttcgtggcatagcgagcatctattttgcatgaccggctctgaatttgtattgttcggcttttgtgaccgtcggttggctgagcttttgtatgctttgtccatatcgttcttgaaccttcttgtccttcttcttcctccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacatcagctaggggatcggcccggccgccacggtggcacaatgtcagcgccagtcccattggcgctgacacggccaacctcagcgccaatgcgcttggcgctgagccgacggcctagttttggttgaagtttttggcaggggttagtttcgaaataagtttttgaaaagggtcaatttgtcaaaaaaacggcccttacttaggatagtactcccaattgattggtataccttctcttagtaaataaattatagtataccttctcttagtaaataaattacttagaattaacattgctattgccacaagatttcttagtaaataaattactatggtaccgatgattctcaacataacttattgatcttgccacaaaattttttgtagtaaccaagttactattaaactaatggttcttaacattttctcttagtaactaaattacaccaatgattctcaacataacatattggtcttgtcacagagtttctcgtagtaaccaagttagtattacaccgatggttgtcggaggcgatggcggcgtggtggataggtatggagtgaaagagggcaacgggtcggccatggagggctggccggtggtcctcttgtatctggccatccgcggccagccgccgggagcacgcgcgccttgtgctgacccggcgtgcttgaggggatgcgggtgcgaacgacctcctcgctatcggtggtgtcccaccttagccgaatcatctctccagggcttgacttagtccctgcaaccgaacatttcgcaattcagtgaattgaaaaggccaataacaaatacataaaggaactcttttggtcaaaacgctcaccaatatgagtgaacaaatggaaattcagatgggaacagatttctgagaatacaacacacaaatttgcaaatgacatatttctaattgacatttagagcatcatatgtgtatgagccccataattttcataacatttcagagcttttgacccaactgtgagtatctaattgtccagccgaccaaactaaaaaattatgaaaagggctgcacttgcaaaccgagagaacatgacactcagagctctgaatataatttctctgaacgaaaattctcagtccatctttcattcagcaataaccgttacaaatcaacatgagagttgagagcagccactagacagattgaaaaattgtcacttctgcgcatgtctgtgtgaaccaaaaacattcatagaactattagccaatcaagatatcaactagaaaatctaagaaactacaagcacatcaaaaagaatatttaagaaactgttggcttatcaattaaatgttgtccaaagactgatgaaccgatagcccaaaagccaagcactagtgatataaatcgacatttgttacatcattaagatgagcagaggtgtgcatatcagctaacaagcctgcccagaacacacatgagaaatttgtagagttgtgatcgatgtgcttccaataacacaaaacgaaataggcagccagatctcacctgtgcacagatggaaataatcaccgctgaggacgcagaaatcaagtggatgagtacctctcgtcaagtgcatcaagctgtacaatctgccatgctttcccttgatgaggaatacaatcaatcagcttcaatgtcgctggccacaagtaaaattaagaatattaggcctgaaaaagtatgttctgtcaaaacattccgataaaccgtagcatgttgaatgggaccatatgtagtccggtagttcagaaatacaatccaatccatctgcattgttgaaccacaaaatttcagagattgtccatccgattaagctccttgcaaatcataaaatgtatgtgcattgcaaaagactaaagacagtgaacaaaattgttcagttatacttgtttctaatagttgaacatgaataaaaactataataggcagctaagtaataccttggttatcaaatctattatgtgctcaatatgctttgttaaccgtggctcgtgagtagggggaggcactgaagatcagacatatcaagaatggctgatggccggccagttcctctacgggaagaggagggcagcaactgctcgccatacatcccaccaggagccattgttagctcgctgtgtggcagcggtggtggcagcacaggaggcggcgccataactggcacatgaacctcctcctccagctgctgccgcttcggcggtggtttacggtccttcaaccgccggtggcagaaccacatctgcagctgcttgtctgtgagccctaacttcacagacagcaacagagaccaaaccaagtcaaaacagaaatcccacggccgtttcgatcgaaaaatcgacaaaacaaacacgaaatagccctaaaatttccagaatccccaattccccgtaggccatcgacgaacctgtgtaagtcctcttgagaacctccaactgatagggcgtcttcatgatgcgcttcaccttcccgctggatccagaggcgctacaccaccaacagcggcggcgggagtgggagagggagcagaagcctgagccgacgccggggcagggctctcctcctccatcctagcgtcgcccgttcttgtccgctcgcctctgcccggctccgatctccggcgactgcagcggcgacccacgagcgctacctctccagccgattccacctgtcgctggccgatttcgcccgtcgcccgccgcccgccgctggaggacaccgccaccgccgacgccgctcccagatcctaaaaatacggggtataaccgtacaaagcaggtgtcaagaaaatggcttataaaatggtgggggtgggcccacttaaagtaacaacgttactatgagtacaaggtaaatacatactcacgtaggaataattttactatcggtactacacgagcgggaggggggtgttccaggggtggggtgtgggggtggggttgtgttttaacccatgtgtagtatagtatatctattcaatcttcattgaatataggagcattataggacactggataaacgatcattttaccgtctggggcccttgtttgattgggtgcacggtccatggtagatgttcaccgcagtggcgtagccaggttttcaagatatggtggtacaactcagcaaatctacaataggattatacaggattgcaaggtttaatttcaatttaccattccaattccaatcgatcggatatcctaaaattgaaatgagattgaacatttgaacctaaagaaaaaaaccctactgttagggaggagaaagagagaagcagatgagaagttgagaacctgctaacgtgctgtttgctgtgctttggtgttgcgtgcctcctgatgaatggagtgctgctgattgctttctccctgctggttgctgctggcctgtggcactgcgcgctggtgcggtcgctgcccgcggtggcgcagtcgccggccgccaacgtggcgacatcacaactcactcgttagtgccttagggcattagcactgcgtcacgtttttctgaggagcctaaacagccacgtacgaagaaacagcgtgaagctcctctctccacaatgcggcgtgggcgcgtgtctttaggtggacctcaccaaactgtttctcatgcgggccccaccacaaaaatttacttttttggtcagcttctcccccttctctctgtgtcctgctttctcatgtgcaaatgcgattaaaaaagctgtttttctgacgaggctctcggagccaaacgaggacgcgcggagctggtgaatacatgggccccatcttcttttcttctccacgtatacaatctgcttagctggacagttgaggccaaataccatgtagatgcattgtgaatggccttagtgcctcagtggacagtggtcgtcgtgactcgtcgacttgcgcgctcgaaaattggaaacgacaattacgatggaaacgaagcgacgcgccgacgcccgacgcggtgcttgaattggcaaaaaaaacaaagcgtcaaagtgccatctatatttttctggaagtagcgtatagggctaatgggccttaggccaaaattctatgatggtccatgaaccacacggaccacattatagctccgcccctggttcaccggttgatatcccaaacctactggatggcacgcattttgtgcagctatattttctttaaagtatttttaagtatcgcaggacatccaacatgcataaatttgaaaatcaatatgatagctctgtttttttaacatatgatatagttgacttttcagttcttttgattattcttctctataaatatttatccaagtttgagaaaataatatttttgtcaaagtttaagaataaaataattacgtcatatctactagagtacttaaaagcagaatcatccaccgtttcgttcgcatagcatatcacacgaagcacaaccaccacctctaaaataaatgaataaataaccgcatcctatcccaaccaaatccttccccttccttgatcagtctgtcatttgagaagagtagcagtagagttctgatgttgagctgtatgtgcctccgagcgaggaagtatcaggtgctacagaacagttccgtgctcccgtactaccaagctttaaaaatgcacccaaaaagtcaaaaaaaatgtaaaaaaaatagagatctgcagcactatgacagcatcacagaaaaaaatcagcttaaaatatgatgtacacagggagaaaaaaaacaacaaatctgtgctccaacagtgttcaaacatgtcgctttactattcatattttgatttgattttatgtgatgttacatgtcatagtgctacagatctctgatttttttcacatttttttgtgactttttaggtgcatttttgaaacatggtagtacatgagcacgaaacatttccgtatagcatccgatacttcctccgagtttttctttgccaagtttcgttatgtttttctactgtttgcaaaacgctgttcaaccttgataatctattattattattattattattattattattattattattattattattattattattattattataacattggacggagatatcacgttcgttgtagagactaaaagttatcatattaattaaagaaaaagaaaaatgtttacactgttagattgtgatgggtgtagattataacaatgtagattgatcatgtatccataaaggaaaataatagacaaaatccatttgggattttcataaaaatatatactccattcatttcatattataagtcatttgaccttttttcttagtcaaaatcctttagattttaccaagtttactaaaaaacttagcgacatttacaataccaatttagttttattaaatttaattttagatatattttgttaatatgtttattttgtattgaaaatgttagtatatttttctacaagtttaatcaaacttacagaagtttgacgttacataagtatgagtaaaagaagatcaaattacagaagtttgacttacataagtatgagtaaaagaagatcaaatgacctataatatgaaagagggagtaatagaaaaggacacatacgatactacaggaactctttttggagtccgactcacatgtcccaagcatgcaaatcctaacatgttttttatatatagaactaaaattaatataaaaataagattaattaaaattcaaaataaaaataaatagactccaaaaatagtatttcaatactaaccccaaataaattaatatttcaaaaaattataacaataatacatctatactcctaaaaaaattagtagtggtggtggtgagcaatgaatctgccaccacccctaccactaagtccatgcctttttagattgcagaaaaaaagtgaggctagaggttccacatatcaacctctacaaaatctctattttttattagaaggaaataaaacagtgtgggacaagaggacccacatgttaataataaatatatgtataaattaagatagggtgtatatctttacctattataaaagttcaaggtgtttttgccagaattttggtacgtcatccgtgtttgaaacagttttagttttatgttttgattttaatctatacctctactaaaaaaattcccatcttatatacgtaaaaaaaaagaaagaaaagtccgaatcaaaaaaggtaaataaagaaagaaaagaaagtccgacttaacgagctattaaaaaaaagaaaagcttccgtcgtagttagtaaaaaaaaacatctcttgtccgactctatagaaaaaggaaaaaaatctcccagtaaaaaacaaaaaatctgtttgattttgttggcaccggtattattttttccttttttctttgcacgcagagttttttttccttttttctttgcacgtagaagagttttttatgcggctaaagcttttggtttttttttatctttttttaatccgatctattcaccgtgcatctcttgggtgcttatagttttttcgtcaatattttttgtcaccggttttttctcccgtgtactttttgtttgtctcatccggttttataatcccatctgttcgtcgcacgcctcccgaggtgaaccctagcaccacgccgctgccatatcgatagtgtgttttttcctccaatttaattgtaaaaatcgattccctactcctctctcaccattttctcaatgatttccccttcgatttagctttaattgttggatttaatctctgttctaaagttgccgattttgacggcgatcttccccggtcatttttatcccgaattttacgctctgattttggagaaaacggaaagagtagattgagtggatcaaaaacctcgaacaattttggttacccaagaaagattcggctggatttgatggggagatttgctttggcaaacgtgcgggcacgagattatcttcgggcacgggattatcttcgggagtcttcgggaggttgaagatggtagtcatattcggaaagttgaagatggtagggtcgaagagaagcagaccaaatggagggaggtagcgggctagcctagggctgaaaaggaaggaaggctttcggctaaaaacctaggaaatattttcattaacttttttttaattataatatatagctatcccaatgttaagatttttattaacttttttaattatagtgtatagtgatcccaatatttcaatttattacttagctcttgatatatcactgcaaaaagtctttacccgttgcaacgcacgggcatcttttctagtataaataatggaataaaggttaataataagttaagatagggtatgatggtggtggttgatggaacatctatatctatacttctatactaataatataaaaaggaggaattgtccccctccaatcctacaggccaaatcatctggttaaatcccaaccgtctatccatagatcaggtaatccgtaccgtcgactgatctccaccgcacggtttcatcctctccacgcacaaagaccgcgcgaagcctcaccctcttcaggcgtgactagctcgctcctcctcgcttgtactgctgtcgccgcctcactccaccgctgcccacgccgaagctgacgtcgtccccagccgccgccgccgcagccgaagtccaccgctaccctcgctggatccggcttcttctccagtcaccaccggcgccgtggtgttttccgacagctaggtccttcccagcctccaccacactacaccgcagcctcccctcgccgacgccatggtggttcccgacggtgaagtccttacccttttgccgcgccactccactgcccccgctggcaccgtggtggttcctgatggcaaggtccttccccgccggcgccgcactccaccagttgggttgattaccgatactatcttgcttctggctgcctcaaatcgtgagaaagcagggaaccgatagagggattactccagcgccaacgtcgatagaccgcttgcctcacttgcgccgtgtcaatcccttctccgatcccctccgtccccatcgtctcttgccgctcacctccttctactctgccacacaacctggtgatctctctattgtcacatgttcccctctccctttggttaacgctgaggagtattaactaattttgttttgcatgttatatattttataccagaagtccagaacaacgtccatcggcatgaagatgagttgtttcaggttgttgaattgcttgccaatcccctttcgattttccgtacgaaatatactcagatcttacatccattccctcatgttggttcctctgtgattttctgttgcagagcatagcttcatcaagccaaatttaatgttttctaatttctcctgtttgttcttacgtgatattacttgtagcagctaaaatcaagatgatctggcttgggtaggtttttaggttgtgtttgtatgcaactaaaagttgccaggctacgctactaggtatgctgtcatgatttatatatttttttttgcagtgtcatcattttgtatgaatcatatcttcatttggtaccattaaaattctttctgagttatctcttaatttcttaccattagaaacaatgactctcaatgttttcaaggatcaagttcactgccatgatacactgaatatagccatgtgagggagctcttgccatcaaaaatatgcattggacgtgcatgattactagtagaagcaaaactaggagtagcagatagcaaaactaggagtagcagatgcatctaccaaaggaaacccgaaacaagccttcccaagcaaggaaacccaagacctgacgaaaacaaactcgggctcagaccctgacggtctgaccggccacatacctgctgttggtatttcttaacgacgttactagaaatataattcccagcaatggcacagaaatactcctggtatattatggttacagagttcatccgcaagcgcacggatataccattgtagtatttcacccgagagtattccaagagtattgtatttatttaatcatgggaagatcatggtagattgaacttgactaataatttatatattacttgtaataatcatagtctaggcaggggttaagataatccaagagtagagtgacacacaagcagtaagctactcattctcatactaaattatctaagctaagtggaaagaaaagagaaagataatgtactcctatacttctagtatacatagtatactacattctagtcatctgatatactagctaataccctctatccgatgcccacctggtacttcgagaagccacccctgactgccgagttccttacgacagcccgtcataaccatacaaccggggctaaatacagaggagtatcctctccaggaaattaacttagtactatatacacgcgcggaggaatacccgtactgagctgtcactatcagcggcccacatctcatccgcagcatataaccccaaataatgatatcccgtaagctagacactacgtctaaactaccagatactactctaatatcatcgtcatggcatagagcaattgcatacgcaaatattatacccgcactaaaacatctcctagatgagctagtagtatattcaatataacatgaacataatgtaaagttggcaatcatatactcggaaagtatttcaattccataaatgtataaagaagagtattctaaataaagtacaaagcttacaaaagagaagagaagagctactagagccataaccgaactcttctgaaggcttccggactccgatttctactctattcctattccactagcttaagaacactaaactaaacttgagagaatatgcttgaggtgtgtggaggaagtgaggaggtgaagcccttttatagctgaactatgacggttacgacggttggaatggtcggaattaccctccaaccgtcataggggcttcatctcagccgtccagccaaaacctggatccaacggtggccaggtgggttcggccgaaccaggggccggcccatccagcccacaatttggctggtggcctcctctactgctcctctccgcagacttgtgaattttggcccaattcgtcgtgttaattttgagttcttggcccattcatgaataagtttgattctcgacatcgtccgattgatttatcgtctgaattgatgtcgattctactccactttatggttattctctgcaaaaagttagtgaaccaaatactagtggaatattattattctaacatataaatgcattgcaagcataactagttcccttctattttggtagtactgatggtcgaaactgatcgctaacgatcgtcaacacctgcggtcagtccggagttcaggctgtggtcaaaccacccacatacctgcggtctgaccggtcctgtgaaggaaacccaacactttccaaactttggcaattttcacctatttcatccataggtgccaaatttgggtgtaaacaccgacatcttcgaccctcctctagatctcccttggaaagaatgttgacatctctagcactcctctaggactcctaggagaaaactccgaccattgggcaactccttcaagagcttcctctcactattttactatattataactctactatagagcagcctaaacatgaaagtgagttgtactccactttgctgtgtgttgagagtgaagcaagctcctccttttctatagtagttcggtaagcttgggtgcatgaaaaaagagggagtaggagatgagaaaccagacttccgaacacgatgggagagaaaaaattaggatggagatgaagatataggaaaaaatgagtaaattgcacacacggtgcattaacttggcagatgagtgcaatttagtgcaagaacttgagaaatgagtgttttagtgcaacaacttggtaggtaggtgcaatttagtagtataaaatttttataagtgatcatataaatgcaacaacttgcaagataggtatgattttgatacaataacctaagaagatatgcgacaatttaattatttggagcatttttttatatagattcaattttaagtacttattttgacaatatactagcgtgtatttgtataagaatatttatatttttatcctaataactgatagctgaaagtcaattaaactggatatagaaattattatatttcggttgatatttgagaaggtgaagaaaacaaaaaaattcttaaaaggtaattggatgtaaattgtatgtgcagtataattcttaaagattaaattcaatattataaggtaatgtccgtaggattactatgtaatggcatattgatatcgtgaaaaaaattcacttagcatatgcttagccaagttgatgtaccaaaatactaataaattattaagttcttataccagaacgctttcacttgttaagttgttgtacttggacatttaattctcaagttcttacactatatcgtatccacctgccaggttgttgtaccataggtgcaatttacttgaaaaaattgagctgggtgaaaaaaatacatgcgggtctcctaactctttttacatgtgagcatcttaaggatgtgggaactttcccaacttaattatctctggttcggtatgcgtgtttttccaaaccgttaaatgatatgtttttttacaaaaagtttatataaaaaggttgctttaaaaatcaattaatctatttttcaagtttttatctaatactacctccattccaaaatatagcaacatttgttctgaacggacaaatttatagctaaaaatacttatattttgaaacggagaaagtatttaattaatcatgtattaatttgccacttccttttacttggtaagtggagaagttccaaacctcatctaacacggccttaaaaaactgtttttactccacatgaaaaaatatattttttatattttttgaactatgtagatttttaaatttaaaactagatacttccaaaacttattttcagaatctgctagttcatccggcgtggtaaaataatactgaacaccacacacaaccagcgtgatagttttgtcctgtcacgtggcgtgaccaaataacgctaccaccacaccaatgagatcagcgtgatcaaataacattgcacgttagccagactgatatgatagtattattttaccaagctagtccggctagcgtgctaaaaattaagatcttgaaaattagttttgagagggtttattttaaaattagaaataaaaaattcaaaaaataaaaatattcctgaaaaataaggtcgtccgcaaaaatcgtttttgattggccgaggagaaggcgaaacagactgccactgtgccacaccatccaccgttcgccggcgccggcgccggccgccgccagccccggcccaccagctcttccccaccaccgcaccgccgcccccaagccaaaccccaacgctgcgtgcgagatgaaccgcctccgccgtcgccgcggcacctcagtggcgccgccggtgaccctgccggacgacgacgacctcctctcggagatcctcctccgcctcccgccgcgtccctcctcgctcccccgcgcctccctcgtctgcaagcgctggcgccgcctcgtcaccgaccccgccttccaccgccgcttccgcgcccgccaccggaatccacccctcatcggcgtcttcgaggactacctcggataccccttcttccggtccgttctggatccgccggatctcatcccacgggagcgcttcaggttgcggctcgccgaggacgagggcggccagtggcgcttctacggctgccgccatggccgcgtcctcctcttcaaccgggccaagaatgagatccttgtgtgggtccccgacaccggcgaccaccgccgggtggccgttccgccggagattgacggcaaggagaagatcatttggaatggggcagtgctgtctgctgccaatgccgacgacgggttcagctcttgccccttcaaggtggtgttggtaggcgtcgccggcaacaacacacagatgttcgcctgcgtttactgctcggagtccggcaaatggagtgatctcatctcagtagctgctcccttcttggtgtttttctttcgtgatcctggcatacttgttggccatgccctgtattggatggcttctggtgatcatgggagtaccattcttcagtttgatttggatgatcaaacccccgccgtgattgagtggccctccgattccgatccaaattgctacactcagacctggctgacagaaggtgattgtcttcgcgtcgccactttctctcgcggaagccttcaaatgtgggagaggaaagtctgttctgaaggtgttgccaagtgggtgctgcagaagacgtatgagctgaagaatgttcttaacccggagattaggttgaatgtagagtatgtaacaaagctggggtatgctcaggatataaaggtgatgtttgtatgggctgctcacagtgtcttcatgctccaacttgattcgttgcaggccaagaaagtttgggaaagttgtgtcatcgccccaattcatccctacgcaagtacttatgttgcaggtacttatgttttcagcatttaactgcataacagattaataggtgtagttgtataaacacgaaataaaaagcacagaatctagatttgaatcatctggcgtctcaaataagtaatttgctcgctcatttcagaaggtaacactgttttttttttcattcaatacctgtttgagcgagatgacattttagaagccttgcggtccaccttgttttgaattttgaacattgcaagatgtagaagtatttagatttgtcatggaaaataattgcatggtattttgtttttatttactcgaaaaattaatgttcagtcttgtcaaaagagggtaaaaagtcagaagcatcaccagtaagaaattaatttgcacctgcatagaaatgtattaatttgcaccaggaagaaatatatatacatatattttttgtattatcttttttctaggataacattctgcttgtcaacgaagttctaattttttttttactagattatgttagcttgaggatgcattactctagtccatttatatacacacggtcagtgcagcagaataattttagttaacttgtgcacccatagttataaggtttattaacataaattttcgaggaatatttgcttccctttagaattttattcagtttacatttgtgatatctccagtacgtgtgtttttttaatgtgtggagtctactattttgggttagggtgtgtttgcaagaggaagttcccaacactcccatctcgttttccgtgcgcacgcttttcaaactgctaaacggtgcgttttttgcaaaaaatttctatacaaaagttctttacaaaaatcatattgatccatttttttaaaaaaatagctaatacttaactaatcacgcgctaatggaccgctccgttttccgtacatgggagatgggttcccaacacccacctccaaacacagccggctttgcatggtgatttgtgattaaagaagtatctgtctgattatgattttgtcagatgaccaccgtatttctaaaataaaatagataactaactacagtaaagaattccttgatagatgcttggagctctagttcaagatgaaattaactagatccctcacttgcattctgaatgttcatagtttttctatttcttagtactaaatttttcaatggcaggaattatggtttaagaaaaactggtaaggtttgttttagtgccatgctaagataaatgatatttgttgaccaaaagaggtttcacttatgagatattgagatacacattagaaagagttgagtgtacaatcacaaacggtagtaatcatacatggctggtgtacttatgcctctccgacaacttttaatttgaacatagtaattattgattggttcttaaatttctgaaagaatacgtatgaactagaaacaggtgtttctactttctacctgctatgtgtggttgtgcccctcatctgccaaaatgaagcagtgaagtagtaatcctttagttgctagatagatgtagccaaagttcgagaatagttccaacaattcaattgttcctctatcgttgttcactgtttcttctttttgtttttgcctggtaataatactgacattattcaactttggaaatttgatgtgcggttcacaatgctgaaaatagtagttgcagtttgcattgcaccaaaaaaaaaaagtgatataactttgtgactgtaaataccagaatgactgatggaattgttctcctgcaggtatctagactttgactcttattggtaaggcgcagagatggattgctggtgcatgatcttccattttgtatgtggtggtggtggctgtgtggcctatgaagatatgtgccaatggcccaatgtagaaactggaagctgaccctctatttatttagtccacttgtcaattgtgaagttgactcgtaggaattatgtactcaaggtttcctggtataagacataacgactgatgccctgacttgctttctactaaagtgaactgaacattaggctaagcattaccaggccatgcacaatatttttcatttcagtagcattttatgtgttcagaattggcaccaacaaaattatggtttgatttgctatgcccacagcataactataattcatttatttactaatctaggtgcaatcatttatttttataactagcaaccgtctatctgaaatactacagtattatatactaaaattatgaatctttgatactccttcctccgtttcacaatataagtcattctagcatttcccacattcatattgatgttaatgaatctagacatatatatatctatctagatttattaacattaatgtgaatgtggaaaatgctaaaatgacttgcattgtgaaacagaggaagtacattggatcgaaaaaactaccttagcattatgacagataaagtggatcatatcattaacactacattactcagtaagcctcttgatttgcaacccttatattgaaatatgccgggtgctaaggttcaaccaggaccatagttttaatgcttagcattgcaacagcatcggacatataaaagttttacccaaaaatcagatttttcttttgtttttgctaataattggtacgaataagcataaggataagcaaaacgatttggctgttaaaatcccaatgacaatgaagagtagagggggcagcaagcggctcataaatgagtaggtgattgtgtttgatgggacttctaaaagcgataaaatcataacctagtgagacaataaaaactaaaaattagaaggtaaattggtggcagaggtgtaagatcaggtggcagctggggtgaattttatagactaaagccatgtgataataaggttcgatttattaatatttagataattttatatagatgctagccgtgtaatgcatggaccatcctactattttcgctacctgaaatggggaaagcttcgccctctctttctagaaaaaagattaactatttagtgccttaatttactaactcaattgattttgtatttcttaatttttcactgaacatgaacacacaccaatcgtaaagatatgtggccgccgttgcccgcgttgcgacctgagaatcgatcgaggcgagctgcatatcgatcacttagctagaacattcgttcggaattcggaaacgaaaacgacatcgacatccatttcatgatgatacacatatatgtgcgtacacactatacagtatacgcaacatgtattgcatggatttatatataatattgtagctttcagccgttgttcatgccttgaagccatgtattgcaaacgttgtacgcctgcgcgcgagtgcggcggctgcaagttgccgaattgggcacgccgcgccgtcatccttcgcggacaagcccagcagtggctacctacatgtttttatgtttttttgataatggaatgaaacatcccggcctttactcatgagagctacagccaattattataagaagtagcacactaaaaggcgcagtccaaaattaaacaagcacaccaaccaaaaataaaagaaatcctaacataacaaggaaaacattatttcagtctattggtgaatctccatccatggttggtaaaaagttacataaccgttgactcaaggttacgacatgcaacagacaggaattctctatcttcctcacacttttgcagttgggcccacagtcgaagccaatatgttgccctgaaaattacctgcatataggaaatagatggtgatttgtcaaaaaccctatcatttctacacaaccacagagcccaatataaagccgaggcaccaacaactatcagtttactcttttccttgtccacaccctgaagccaaccgttaaacatatgagatatacttctagggaggtataaaccaaaagagaattgcaccgctctccaaataaactttgcataatgacaatccataaacaaatgttgaatagactcatttttcatacaaaaacaacatcgtaaacacccattccaatttagtcttgctaaattatccttggttaacacgacacccttaagtaagtaccatatgaagatcttaatcttaagcgggatcttaagcttccaaataaacttatttctgtcaatgcaaccattattaattaaagctaagtacattgatctaacagagaactggccattctgatgataattccatctaaaacaatcagaagaatcatccaactggatgtgagcaatagaagcacataaatcataccaaagagttaggttctgtccaactaaagctctcctaaaagaaacatttagcggaaccgaggccataacactggcaatagtagcactcttccttctgacaatagcatataaataaggatacttatctctgaaggccatgttttctacccatttatcctcccaaaatcttatatgttgaccatcattcacaatccaagagcccatacttaaaaatgtgttttttattttcatgagccctgaccaaaaatgagaatcaccttgtttcctatccacttgggttatagacttattatgaagatactttctcttcaataaatcttgccacacaccattctcattaattaacttatataaccacttacttaacaggcatatattttgaatctctaaattatgaacacccaaaccaccctgatctttgggttgacaaattatatctcatctagttaatctgtatttctttttatgatcatccccttgccagaagaaacgagatctataataatcaatcttttgaagaacccctttcggaatctcaaagaaagatatcatgaacatagctaaactagaaaggacggaattaatcaaaaccaatctatctccaacagacatatgttttcctttccaactactaagttttctctctattctttgttcaataaccttccaatcattattacttagcttcctgaaatgcattggaatacccagatatttaacagggaaagacccaagcttacaaccaaagatactcgaatattgatcatagcaatctttcgcatgaccaaaacaaaataactcacttttgtggaaattaattttcaggccagataatttttcaaacacagataaaatcaatttcaagttctttgcttatcgtaagtcatgctccaaaaaaatgatagtatcgtttgcatattgcaaaatggacaaaccatcatccacaagatgaggaattaccccattaagcgaaccattatctttagcccttttgattaacaaagctaacatatcagctactatattaaaaagaattggagataacggatccccttgtctaaggcctttatgagtttggaaattatctccatttaaccttatcataggctttctcaaaatcaatctttcgaattacatcactattatttttacgatgcaattcatgtaaagtctcatgcaatataaccacaccctccatgatatttctcccaggaataaaagcagtttgagtaggactaatgactttctgggcgacactcattactctatttgtggcaactttggtaaaaatcttgaaactaacattaagtaagcatataggcctatattgttgaattttcatggcctctacacacttaggtaaaagaatgatagtaccaaagttaagcgagaatagaggcaaagatccattgtgaaactctttaaacaggtcaagtaagtcattctttatgacattccaaaaaacttgataaaattcagcaggaaaaccatcaggacccgacgctttattatgttccatctgaaaaatagccttcttaatttccttttcagtgaaatcctgagttaaagcctcattctccaaaagagagatctgaggaatatcagcaactctactctcatcaaattgaagtaaagaatcatcaggaggcccaaaaagacccttataataagtggtaatatgcgattttaaatttgcatcaccatctatcaaatggtcactatcctgtaattgaaaaattctagttttcctatgttttccattcgcaactaaatgaaaatactttgtattagaatcaccctctaaaatatcctttgatttagccctctgataccatttgatctcctcctctcttagaatagaggataatctattcctacaaaaccatctaatatccaattcttccggactcaaaagggaattttctgcctttttatctagcaaatccaacttatctaaaatttttttcttttcttttttatataaaccactactatgttttgaccagcccctaagatgctgtcgtaaccgtcgaatttttgcctgccatctctccatagcagtattgccttcgtcaacactagaccaaatttccttcaccatctcaacaaaaccatcccgtaaaagccaaccaagttcaaacttaaaactatgttgagcattactcagagatgaagaatttgtattcaacggtaaaggggtatgatcagagatatccctattaagagccaccacagaagataaaggaaatttctgttcccactctgtagacattaaaaccctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgagctacttgc

SEQ ID NO: 43799 - DNA, 4648 bp, Oryza sativa
tgtcttagggcagcgtgatttatattccttgcccacccttagggtgatctattctttgtagatgtttttttaattcaaatgtttgaattaatggggtattatgtattatttttattggtattgttggtttcatctctttgccgcaatttctttgcccttgtaagacagcaccggtttacgttgatacaagactgaatgctagctataggaagagcattggcagatggcgaagaaattgttgtttccgaagaatcgggcttgagcttgtttacggacctcttatatgtcgttcatgcacgtactgcaacttcgcgctccttcatatactctgtttgcgtttcagcttcaggttacttttctgccatcatatgttggattgatcgggcctgctcactttgatgccattttcaaccataccatcttttggcaaagttgcccaaaaaaaataactacgtttagtttgttgccaaatttgctaaatacataataaattctgccaaaattttggtaatattgacatcttgtcaaaagtttattttggctacaatctgaacaggcccatcatatctatccacaaagtgaatccacacctccttaactgtcctgaggaataaatctatttagtgaataggataggtatactaagcaaacacgagcgcaaaatggaaataagtaattcatttttaaaaatatcattgaaaaagtagtttaaaaaatcatataaattaattttaaaattttataactaacacttaattaataatacgctaataagtcatctcgttttacgatgggagataagttcccaagttttcagactctttgcaaccaatcactacactggccaaggtcacctgtgacggtcccaaaccctcacctttaacggctttgagcatggtcagtgatcagtggtcactggtgagtccagtcacctttgacggatggccgaccatcacaagtgacacccacctctgacggacaagttactagaagaccatcagaggtgttggtctccgctagcctagggccagttaggactctcacaagtgactcatctctgacggccctttaaataaaggccgtcagaggtgatggtctccgtatatagaagttgccacaggtgatttacctgtgacgggcccgaaagtaaaggcccgtcataggtcacctctaacgtgcctttatttgttctatattaatatagaacaaaatattgccaaactgctatgctcgtgataatgtgcaccaaaataaagatgataaatctgcttaattacatgactaagagcaagtacaatagcggactataagccaactataaacacatatgaggagatgaaagaagagaaatgtgagcagtgggctacacatttgtaacagatcagctgtagcacggactttacgtaatatgtatacgtatgacaagtgagacaagatattaatagtgtagtatatatatttataggtaactattgtataaattagctattaaattgactatatatgatttggagctactacctagttggctatactaactctaacagcagcaccggcctaggatcgccggattatcaacagtaacaaccttttttacgtaaaataacagaattattacagaactacaaaaataattagaaattttgggtcagcaggtgagtcatagtagtttttactaatactatcgggatttcaaatattttagcacactactaaaaaccaatttttatactgtcaaaactcattttccatgggattgggctacccgtctgtccaaaagtgtgctaaaattgctatttttccatatgggtatttatgtcgtccgcacacaaaataaaatttgtgaaaacaaaataaaattccaaaaacccatgcaccgccgttcgtcgttgccgccaccgtcgatgtcgccaaagcccggtagtagctcctcatcatcatcgccacagtctgttgctgcgcgcaaggggagctggatccaccgccgccgcgctccccaccgctggatccgccgccgtcgctttccccgtcgttggatccgccgccgccgtgcctccccatcaccgaatctgttgctgctgcacctcccccaccgccgcacctctcgactgccactcttgctcccgtatcaccgtcgttccccatcatgagaatgagatataaaaattttgaagatgctaagaaagacaaacaaaaggaagatcagacttgtaggcgagtctttaatagccgcattttcacaggtctcttatgcaaccgcataagaaaacatattttttcatgtggctcttgaactgctataaaaataattttacaggcggagtagttatgacccacctatatagtggcagtctgatagcaaaatcagatttaggccttgtttagttggggaaaatttttgggtttggttgtcacatcggatatacggacacatattttaagtattaaacgtagtctaataacaaattatagattccgcaatgaaactgcgagacacatttattaagcctaattaatccgtcattagcaaatgtttactatatcaccacattgtcaaatcatggcacaattagatttaaaagatttgtctcgcaatttatacgcaatctgtctaattgattttttttctatatttaatactctatacatatatccaaatattcaatatggcaacttgaaaagttatgtttcgggaactaaacagggcctaccatgtcgagattggtaaaatcaaacttcggcatcgttgtgttaattaagaaaggacaaaagtttcagatacgattttgctatatattcgtcgacaaattttctcccaaaaatttaacagatgtaattatagtataatcgtagtgtaattacactgtaacttgcatgtaattacactgtaactatagtgtaacttgtatataactttcaaaaatctctctgtaatatgttatttcggtaaaatagaggttgtgggaacaaattcttacacatgtgtgtgctgtgattttttttctccctcaccaaaacaaatcttgtaatagatttaacgattcaaaattacgtgaaacttttatacaagttacactgtagttacatgcaagttacagtgtaattacactataattgtattataattatatctgtcaaatttttagaacaaaatttgtcgccaaatgtataagtggtccctttgggatacaatgattagagcttgcaggtacttgagctctctggggagtagcttggcctacttcatccagaaatcgatccattgtggaggccgatgttatctgggcccatatgactgcggacacgtgcgagccacagcgttgtatgattggcctgacggaaagaacggcatgtacagtaaagtcgtagccaaatggcgaatctttctacagttatggcacaacatttagcagaggattaggcacgtgaagctatatgtttttttttttcgaaagcggaagaacaggattacattgtacccaaatcctcttctcttgcttgtcacacaaaaaaggttaagacccccagctcataatcaagaaccacattactacgtactaatcgtgttgttacttgctagcatgtctgcagcttaaagctgagacgacacatcaacaaggaatttacaaactaatctagccaggctaattaggagtatctttgcaagttccaaattaagatccgcgctgccgctaattatttctgtacacacgcgtggaatccatcttctttcgatcgttttacccggcccgtgtccatccatgattcttcggtgatcaaaagctcaaacccataatgtcgtccagatcgaagacaacctcgtcgttcttgaagaactccatgccggcgacggcgtcgtagctccagtgcagggaggacgtgacatcgccctggtccggcccgaagggacccgcgactccgccgccgccgccgccgccgcgcgccgcggagctgccgggcgtgaggctgctcagcacctcctcctggtcggacgagccgacgccgccctccaccttgagcggctgcagcagcgggcccggcgcggtgaccgtggtgatcgtgctggtcgtcggcgccgcggcagcgtctactggcgccgccggcgcggcgacgaagctgatgaggcgggaccccgcttggaggccgccgcagccgtcgtcgttgtcgccggcggcgacctggtggatgacgtgcgccgcgatgatgggggcggtggccgggtcccggcaggtgtgctcgccgatgtaggtgaccctgtagctcgccgggtcgtcgtcgcagcgctgcacctgccgctgcgccgtgcacagctggtcgtacttgtgcgtgcaccggaagtaggccctgtacacgtagcataccccaaacaactcctcgtcagcgcgcaacgcatccaactgtacagtctcgaacacattgttttttgtcgggacaagtctactcactttgggtgcttggagttttggatctccttctgcccgtacttgcgccatgcctggccgtcgtcgaggttcttgacgaccaccgaattcccggacgattgctgcgtcctgcaatacgtacacacaaatcttagtacattaaggtatcgttcgtttaggggtgatagggaaggtatcgttcgtttaggggtgataggggagattgg

SEQ ID NO: 43800 - DNA, 3305 bp, Oryza sativa
aggagaaggaaatagagaagattgggaatatacgcaaaacgaggtgaaccattagcgcatgattttatgattttgaaacttcaaaaatggattaatatgattttttaaagcaactttcctatagaaaatttatacgaaaaacgcaccgtatagtagtttgaaaagcgtgcgcgcggaaaacgagggacaatcccccctatcttccctgaaagaacgcagctaattacacacagatgatgctatgctttgtgatgagctatgctctggccttcgttctcacctcctgcggcagttggccttccggtcggcggcgggggctttcctcttcccgccggcgctggccccgcccccgcaggtgacctcgctctgcacctccgacccttctcctccggcggcggagaccgccgccttgtcgagcgcccgcatcgcccgggagaaggtgtggagaatctggtcgacgaagcggccggcctccggcgagtcgcggaggagcccctgcagctgcgccgccagctccttccccttctccatgtcctccatcacctgcgcgtacgccggcgccggcgccggcgacatcgatgacgtcatcctcaatccaagcaagcaagcgcacacccagtgactgacactacactgccgctgccgcgcactctcgcactctctcttcctcgcagctcagctggtgatggagctcaaagcagcaggaggcttggggtggaggcaggtcggtatttatggctactctgctcacctggagcggattgatccgtctccatttctgtagccgaaggagatgatgcgtaggcgcggtctaccgtcgatgacgcgtaccgtgtcaatgccaggtgggaccgtgcggctacgcccagtgagcggctcacgaggggtttccatggactggggcgctcgctgcgtgggcgatgggaaaaagggacgcggctcggcaccacgcgagaaccatagacccggttcaccgaattgtggcggcccacgcggtgactcgcggtgaacggcgcagttgaacctcatgaaccgagcgtacccaatcccccatgccggtgtgaatgcacgaggtgagtgggccagcggggggggggggggggcgggggcttcacacccggcccacgccacagtggacgtagcccaccgcggaaaccacgggagagatcacacggacatgtgggccagtcctggagggggtggcccggcgctcagtggaccgcggtacgaggaattcgggggagttttggtggtgggggccacgagagattattttaaaaaaataaaaaaacttgagttgcaagttccttcgttgggtgggcatgtgggagtacgggcaaggggggaagcatcgccgaaggagaggggggacgaggggacgacaaccggatgacgtcacgggggcgacgtcagcgaggtgatcgatgccgggttggggggcaaatgaggatgaggaggtggtggtgtggtggtgtgcgtccgcgtcatttgtggaaatttttatgcagccggatgggttggacggcggagggaggggagggaatcgtttgatcggattccctggtggaacgtgcgtgtgtgacaaccaacagttgagaaatcattggagtagaaaactggtactataaaatttaaacttcggaatcagatggcctttgcctccttgatgtcctcctaagggcttttacagtgggcagagatgtaagttcagccttaacaaagccgggtcggacattccatgccatgtctgctgttcttgttgtccccatgaagatcgtggagccaagttaaaccacaagttctttgtcaaattttaaaggactggcccacgctcgtgccctgtgccgctagagaagggagagggagaagaactcgtcggccatgggagggtgaccaggcgccgtgcttgtggagctcttgggttgtgccggcgacggcgatagctacggacaaagaggggcgcgagcttgacggggtggcggtgtccactacccatccgccgcaacagctcggcggcggccgccttgagccctcggcctatctatagctcgtggtcaccgtcttgtggatctagttgtcactgttgagtggtgaagaagaggaggggagagggatgctggtgggaaggggaggtggtgtacggggagcttgctttcggttaaattgtcctgctagattatattatctaaggcatctaccatcctgaaaaatgtataattgcttgattatttagactgcattgtttctcttcatactttgagatgtatcatccctagttgtgcttagaaccatgcaaactagcctgcaattaggcataataaggatagtatcgaggtttgagctgatcttacataatatgcatgtttcgttcttgtttcatgtatattcgccacttatatagacatatcattttatataagcatatgaagctttagtcagtatcggcaagatttgtacaccttcatgcttgatttctgttttatatgtttatatggatcaatctgtttatataagtttttactagagtgtttatataagtttgtactagagtattagctagtacgttatctttcttgctctaaatactgtcacatcggctactttcataatattgtcttaaatcaatatgttaaactccatagatagtattacagccgattgggcatgtttagggtttattattctttgatatatccagtccatagctgatttggtctaactccatcggccgagaccatcaacgatgcactatcggcctatcggccgatcggctatcggtcgactgatatgcttttattctttcttgctgattgcaggattaaatcagctagcacgcccttgacacactcgacactagctttggacctgcactagagttaagcatatctcccaggccgtcgtgttttcacaccaacaagtagcccagtcgtcgttgtcgcggtagccatcatcgtcgtcatggcagccgccgctggatccacctccttcaccaccgtggaggaccgcccgagcaccgctcgctgctggatctgccccaaccctctcaccaccttcgctgccctccccgctagccttccccgtcgtcgcggcagcagatccagccaccccgtcgtcgcggcggcggatccagccaccccgtcgtcgtggctgttgatatttcttaactttacagataaaatccgcaagcgcacggaaaataccgatgtagcacttcacccgggagtattcttaggtatcgattttccacaggaaacgtgtgtgttaactccagatcaggttcatccaaggacacgaacctaaggata

SEQ ID NO: 43801 - DNA, 6538 bp, Oryza sativa
  unsure (1)..(6538): unsure at all n locations
gctcttagagtagaattgtttactgaagaagcatactggtactttttcaaggtgtgcacagtcggaagcatggatgaacaggagcacccaaagctggcatcaatagccatggatatggccagggagttggatgggtgtttcatgggtgcaagcatctacagtgtacttctgaaagcaaatttcaacgctcggttttggaacatggctctggcaagcatcaaagaattcaagcaaacgaacctcctagtatacggcgcatatattgacaatccttggcagacgtctgaaccgacatatgttaggacggtaaacagaatttcctctgaataccttgtgattcttgacgactatcagacatgtcccatccaaatcacaaaccctgctcagagtgaagctgaagttcctgaggtgaatattcaagattttctctttgcgagtgttatacctcaaggaaaattcaaggttcttgcatggacatctcaccttccacctcactacaactacatgctcagctgtgaggtacagaggaaatatcgtatggtcgccaaaaagaagagatcgcaggaactttgcacctgacagtttgattgttttctgaagctttgtaactgaccatgtcagaacctgctgtataatgcaattatctgaagatgtcatctaaaactgagtttgtgaaatattttcacctactataatagccactaagatatatgtttctgttaaacttttgtgcttgggagatgttctagttgtttctttcttcttttttggctgtgtgcattttatgcagaggccgggggtgactcggtttgattgtatcatcttgatgtaattaactgagtctaaataaagtttccattatctaaaaaaactatatgagcgagggcgtagtccaagctcctatgtaagattactatttgtaagaggttgtcaaactcaattcatcagcatctattaattttgtactgtttgaagtttgaagatttcaacatgctgagaattgatagctactgattgatcctataggacgcggcctgaatgaacagttatacactagaagttatgtattttccataaaattgatttgatggttgtttggatgatttgacttgacatattgaattcaagcttgaaatttgaattcaaaaagtttctaggaatgcaagggagtttgtatgttggatgaatttaaataaattttgaggagaacataaaacaagatgaaattttagggagatatcaatgaatatttgaattcaaatttataatttgatgtccacacagtgttaagaataaggagttatttggattagtatatgtcctatttcagtgaatggggatattttaattaattttgtaatggttttacaagggagatgtaaattccaaaattcgagttctgagatttttgttaagatagaatgttttggatcaaaattttgggtttactaggaatgatttaattgatatcttgccactaattcgttgatacacacaaagaatcaaagttttaaaattatgctttttaattaaaataacttttagctgctaaacaaaagtcagggtgttacaatctctaacctttctaaggtgttctctctttttttcaggaatacgctaggagcatatctttgtattaagaggaataaaagctatttacaaatcaaacataaattttgaaggggacgggataccggagcggaacaaaggacttaaactacaatctcacaaccaattaagatgacctagggactcataaaaatagagaccaagtgccggtactaccacctttgctaggcgccataactccgcctccgcagccattgttttcactacttccacccatggccactgttggaggttgaagacctagttgtttctctccttccagatcatccaagctactagtgccacaatggtatcaaatccctgatgacgatctttcgcgacttttttcctgctaaggcaaagccactaatggaaggaggcctcatgcaaggggaggcaatctggctgattaatcaccctgagaacccaccgccagagctagcgggattatgggcaatcaaccaagatatgatctatactctgttcatgttgattgcaaagaacacagtggacagggtgggggagccccggccccgatggcgaagacgatcagtagcctagcatctattcgctgcgaccaaaccagaggaagtagcgacagcggggaggggccagtggcttccagattgtaaggtgttctcgctcgtgatcgaggtacttaattgtaaagaatctatagcacaaaaaaggaatttcagaaaagttgttagctggtcagctgccattccggttgcgaaagattgttggtcatcgttgagctagttgaggatgttgatgacgacaaatggagaaggatgtactcttcttcacgaagttgcatttcagctggaagcaaaatcataatcacaagcccatcagacaagatcgcaaagcttggaacaaactcgatctcttcatgtgaagtttctgtcacgagaggcttattggtacttcttcaaggtgcttgcattcggaacctcaaatcctgaagattaccctgagttaacatatgtatcaataccatgccaacgtgccatgtaggcatcacgtacaataaaaccgtcactgaaatcgtctaggaaggaaaaacgagccaattttaaatgttaaagagaggttatatacctagttttgtagttgagagagatgagaataagactcatcacgtcctccgcgacaagcccgtgccgtccgatgccccccgactcggcttttctttttctcccctcaaatcttaatgaaattcggtcaccggtctttggctgacccggcaaaaaaaaaaaaaaagagagagataataagactcggcccatcgatgagggatgagcaatggactttctcataggaaaaggaccacgcgcaaactccgttcggaccagcccatctaccagcgggccctccttcccacttcgccggcgttggcgagctgctcgtcggcgggcggcggacggcggcggcgctccggtggtgggcgccctagtaggctagtgctctgcctccaactcccctgatttggcagcgattgatgccgtccgccatgaagccgagctcggccggcggtggcaagtggccgcaatagccctggctggatctggagacgtcggcaacaatggcggcgccggacggcgatgccactcctccgtcctgctcgtctaattggcgatccaaaggttacttaattttcaaggatttatagcatattctgaatattttatttttcccatagcagtcaactattgatctccaaaaggaatttcagaattgcggctaccataatcgttgaagaaatgtagctaaaaaaaaaaaagctctctacctttttcagtcaaaaaaaaaatgtagctaatcagctgattaaggatgagacagcaaccgcagttcgaaaaactattggtcaagccaacaaaacaaaaatgtattttgtatttgggcataacagttgtgctactactactagacaacattatctgatgatcctggcttggaataggatgggaaattttcaacagttgggaaaattggttggtaccaatggttttaagaagaagcatcaatatattcgttcctattacgtcaaaacaatgaaggaatatgactgcttctggcaatactcaaatgcagaccaataggcatcactactgctatctttgccagctgtgctatcagcagtttccatttttatcagttttaacatgctggctttcataataaaatggtttaaacatgtattttcctcatgtttgtcaggtcattttgtctagtatgcagactgttcaactaaaaatacacgtgcttgtgaaacttgaccagagatctatggtgctgaactaaacttgtagaatttcctttgctgctgtcgtcgtctcagctatgtggtcaatcttcgacggttatattaatccaaaccgcagggaaaaatacaaacttgaattcaaacagtttacattcaaaagcatatctaggttcagacacattaaaaggtatacggtatatctatgttctgaaatgcatctctctttatggagacgtggagctactcgagtttgacgctgccttaatctctattcctattacagattttcagactacaaagtttctctcaggtcccagatcttgttgatccgttgagtaatccacaaagttagagactacacagtttcacatggagatatttctgtctgccattctgggtgatcttgccagtagatccatatcattcctgatcaacaagtgctcgaaaccgacagtgctaaccgtggaggagaaactgcaacggctgctgctccaggcatgtttcatcgtggaggagtcagatgaacggctcatcataaaccaagccatgctgcagcaactgaacatactaaggaaggagatgtacagaggttattataccctcgacagcttcagatgccatggtcatcaagaatataatcccaaagatcttgaggtgagtagctcttttgcaccatcgatgttcaatcctgccaagcgtgtccggttctgcagggtcactggccagagtgtacaagagcatctgctgcaacaagtttttggcagacttgaagtcaccattgaagatatgagtgaatttgttatgttcctgaatagttatccacgcttttgccgtcagccatatagcatgcacttgcttttagacgagtgcttgttcagtcgccaaatggagatggagcacatcatgaacttcctgctgaaagaggataccaccggtactgaaaatccaggtgtcctgccgatcataggtccaggaaaagttgggaagagcaccctgattgaacatgcctgtgacgacgaaagggtgcgtaaccacttctctcaaattgtgcttttcaatgacgacgatcttgaagatgcaaacatattgactcttagagattctggtgtaatcaagcatcaaaaccatgccactggtggaaaaaggatactaatcattattgaactaaccagagatatcaatgagggtgcatggagaagattgtactcagcttcaaaaagtcatgttgcaagtggtagcaaaattatagtcgcaagccgatctgaaaagattgcaagctttggaaccacacaagctcttagagtaaaattctttactcaagaagcttactggtactttttcaaggttcgcacatttgggagcataaacgcagtggagcacccaaagctggcaccacaacaatnaatatgccaagggaattgaatggttgccttcatgggtgcaagcatctacagtgaacttctaaaagcaaatatcactttcagttttggaggagggctctggccataatcagagaattcaagaagctcaatctcttactctacggtgcatatttttttgatgatccttggcaggcagttgaaccatcatatattaggaccgtaaacaaaattaactcggaatatcttcttgttcttgacgactatcaaatatgttctgctccgaacatgattcattgtcacaaaaactctgctcacagtgaagatgaagttcccatggtgaatgtgaaagattttctatttggaaatgttaaacctcaggaaaattcaaggttctcgcctggagatctcaccttccacctcactacagttacgtgttcaactgtgaggtaaagaggttacatcatatggtcaccagaaagaagagatctcagaagctctgtacctgaccatctcattgttctctgaaactgatgcataatgtaattatcttaaattttaatataaatctgagcatttgtgaaatagtttgacctactgtctgagcaaatgcgtagtccaaactcgtatgtaaaatgtgctatttgtaagagattgtcaaactgaagtctatcagcatctactaacattctatatttgaaatctgaacatgtcaacattcgtgagatgaaaatacattcattgcttctggcatgaactaactgctcctatcttaataaaagatacacaaagtatcaagtgctgctgttgacttctgaccttttttttttttttttgaaaccgaagactgcatttgctggtgttatattaagtaggatataaattaattgcttgttgacttctgaccattcagtgcttgttgtaatttgcaagatacacaaagtatcctaatccttaatagaagacaatgcaaacactttgtagcagtatcagaagctataccagctatggataacacgttggtggcaacgtcagctagggttcttccaacaatgttggcaccggatggcgatgcctccttgctgtctgtgtctgctcttgatccaggtacttatttttcaaggatatgtagcataacatgaactttttattgtcccagataagtgtattgatcaacgaattgaatttcagaaaagttggcttccgctcaaatggttagccataaatctattgttgaagaaatgtagtacctagtaaactgtttaaggagataacaacc

SEQ ID NO: 43802 - DNA, 6947 bp, Oryza sativa
  unsure (1)..(6947): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagctttcgcctccactgagaagaacctcttttgtcctgcccactgcatacgctcagttcctttgcagatgaaagggggatgttgcagaccctgcacaaagaactacagtcaatcagtggcaaaagaaacaactatacaaaatatgttgattatggtaaaaaaatatttagtgaatatttagacagatagaagagttagagctggggtataaatatcatttcccaccaatcccaaacctgttatccaaacatgcgttagattattagattttaaagtttaaactaggaatcagacaaggtgaacattggtctgtaccaagttcggagaagttaacatgttctaaaagttagtagctgatgctggacatgtcaccctgcctagaagtaattatgtggcctcacaggtagaggcatatgtgctttgtataaggatgcgaatgctacgtacctagcaggtctgttcctagaatgcatgactttgtattggaacttaacagaaagcgtggatggggcagatatgattatatatcacttggcctacaatttcagtggcagataacagaaagctgatgtggactaatctcatgggaaaaaaagtattaagccatgcaatgggtgtcagtataatcagactccaacgtaaagaactcacaaacacataaacataagattacaaataactccaacggttccatgacaagaagaaaatcgagaaaaacaatggtctttatacaatagtcaaataatcagatggcaaacataaaaatagacaaaaacaagaaagagcaaacgaccattcattggaatctgcagaacaatggatcaatgttctatatagcgttgatctgactcaaaattgaaatgacaactttacaaactggttatagcaaatcccccaaatcatgatagacccaaaagttccaagttcgtaaactagatctagatgtgtccaacttattcaaaaaagagcaagacaattataaccacctataagtgaaacccatgtctattcagtactaccacattgccagaaatcatatactagcatacaaggcccaagaacgtagcattgttggcccaaaattttgggctgaggggtgtcatgtcactgatcaccagattacaaattggacaactgaagctaggcctcttcagaaattggaacatatttaaacccacacaccacaatccataagacatgctgagcttctagcatatgaacaaagactgtctgaagcctaaagcaacgtgtctgcagatataccatacttgggaggttgttcgtcaatgactagtagtactacacaacaaattcgtaaacccctcttctgaaatttcacgaacattcgcacgaaaacaagtcactgactagattcaaggagtctctttttttttcaagctggaaaccttatttgaaggagccagctagcgtacgaaattaacaagattggaatcgcggatcaaggcgtgctttttatatatatatggactcacctgcaggttagggatacggcggacacgcgcagcggcggcggcggccggagacgagaaggccgtcgtcatcagctgggcggcagggtggagggagggcagcggcggggcttggcagatcaccgccgaggatcccgagaggcggcgggagatcttccccaacgccgaccgcaccatcgccatcctctctcctcctcctcctcctctctctcctctctctctctctcttcgtgtggataccagggtttgcagagggttgaagctaaattgatgaaaagaattcaggagacagagatgatgagaattaaagctcccctaaaacttacaaggctctgtttagaactttttttctcttccaactttcaactttttcgttacacatggaacttttttagggtttacacacacaaacttccaacttttatgtcatatcgtttcaatttctttaaactttcaattttagcgtggaactaaacacaacctaatagtttttcttttcggattagagtctagaaaataaattaaaaacttgttttttttagcttggtataactctgagtagctcccccataatttaacaacctcattgtttggcatatatgaggaaaaagagaaacgacatatttagaaatgaaaattagtttgtgaattgaacttttatatatgtgtcctttacgatctaaaaacaaaggctgaaaaataaactacgatgaaagatcctcaaagattaaaaattcaaattttagctgataagtataagaataagaaaaatatgaggctgtaaagctccccaataaggtttccctttttttattaagacaaattttatctcggtttttgttatcatgcttatcaaattgttaaatggtgtatttcataaaaaaataattccatatacaaacaccttaaaaatatcaaataaaattcaattttcaattttaaaacaattaaaactaaattaattatatgccaatgactttattgttttatgtgcctacacttaatctcgtcttgagctaaatcgaacgcagcccaagtccaaatttattcattttgtcaaatctttctaaaaattgaacgcaacccaagtccaaatttattcattttgtgaaatcactctaaaaatcgaacgcagcccaagtccaaatttattcatttgtaaaatctttctaaaactcggacacaacccaagtccaaatttattcattttgcaatttctaaaagtagttgtagctgctagaagtatcctaaataggagaaaacccactatgactcggagaagaataataacactgaacctgaattaattattaataaactaatagtgccaatttttgagagcatgagattttagaagacctgaaaaggctgggtttttatcggctgacattagttcagtgacgcgaggtaaacaaagtcacaatgacatcataagtttaattgcttcagagcaataatataatcagcttgaaactgacaggatacgagatgcaatcaacatgacatcatcaggacgtaattagaaaacactggatagacatggtcacaaggacagtagtaccattaggatcatgtctaatttggttatttaaagacgtaagacaagggtcctgcttaaaaacaacatgaccttagacttttggtattcagtagaaaaacagatttgacaattgacatgcactcgttgaattcaactccaccaacataaaattcaaccaattcagtctttggtcccacatgactatacattgacttgcaacaaaagcaaaaataacagcactagactgttggtagtagtacatttgtagagaccacatcggcaataaattatgcatttggaattaattagtaggtatcttcattcaccgctcatcgtttgtcctataacttataaaccattactaaaatataaattttaatttctttttttgaaaatttaaattttaaaatttaattataaagttggttttaacttttttttaacattggtttttaatcaccaagcatacaaatataaaaaatttacccacaaattattctttaatttgctttcaccttttttttttctgatggtctgacccatatggttggacttcttcagtattgacattgccgcgttatttctcaacgtaatgaaacgaaagtaaaagggacctaacggaatggatgttattttcaaccatactattttttttataaagttttttaaaaaatatctacgtttaatttgttgccaaatttagtatatacattagaaatcctgctaaaatttttacatattacaatcttgctaaaattttggtaagagtacaatctaaacatgcccttaaaagaaattaatctccattaaaaatgcaaaaataaaaaagagaaatgccacgtcagcaggaaaccgcgaagctagccacctctcctttctccccctctaaacaaacgcccagaaattgattgaattttttttttaaaaaaaagagaggccgccccaaatggaggaggtcgccgtcgtcgccgtctccgtcgccgcccaccaactccgccgccctcctcctctccgcctccgatgccattaaccctacgcgcacgggcctcctggtcgccgcaggcctccgtgatgccgacgtggtggaagcgctccaagtcggcgttccagcgctcctccgccgtctcctccgccccggcctcgccggcgagggcctccacctcgtcgtgcgcggcgcccggccgccgcagcgccgccggcaggtgcgccgatgacgccgggggcctcctcctcgcgcggcgcaggcagctcacgcggcagcggaagctgcgccacgtcgacgacatcggcgtcgggctcgagagcctcggcctcgtcgtcgcgaactcctcgcctccccccagaggccgcgcctccacgtccgcggccgtcggccaccccgtctcgatcccgatcgcgaggtccgcgagctccgccgagttcagagccgtgcaccagccgccgccgagggccgccacggcggcgtcgcccgtgctgctcccgctgccgctgccgtctcccaagccggtggaatcggacacgtcggagccggatgttggtggcgagagggcgacgaggtaatgtgattatattttataattcttttcccctctgaattattggatcatgtcgaatcctgcgattgaatgaattattatgtatgtgatgatgatcaagagatttttttttgtatttaattgatgcgatgcaaggtaaaatgtgattgttttcctcaaaataaattaagtttttgttatgctgcgaagagattaagacgcataggaaggtgcaaattttgtgattgattaggcatttggatgttgggcatagcaatgttaacctgaaactgcaaatctatgttgtttcctgatgctcacttgtcttgtggttgcagggtgacaagccagattgttcaaaattttcctgataataataataatcttcctgacaatagttcaaagcgtactaccacctctagtcaccacaggaaggtgttccgagagaagttccaagataagagttcaactgaaactgccaactttcggttgaacattcctgctaaaagtgctccaagcagtgggttttcaagccccgtgtgcagccctcgaagattcagcaatgccgaatatacgacaccaactgctcaaggtccccaagcgtggtccgctccatctgtccgctcggtagattctatggcaacttcatctccgcggatttcacctgaaatatatacaggggttacagagcaatcaactttttctaactcattgagaagtcctattctaatgtcgaagaattccagtgcccctccatcacctctgcacccaaaattattcccagaaaataatatgtcacgtattgaaggcaatgggaatgtcagtttccacccattaccacgccctcctggagctataaactcaatgcagacaagcattgttaaccagtctgctccaaaagttgaaatgccctcagtggctggtcagtggcaaaagggaagactcctcggtagcggcacatttggctgtgtatatgaagctaccaatcggtatgtgagtgtttttctttttttggtgttatcaaatttacggatgctacttcatgttgagctttgaatgcaatttactgacattaacatgcaggcaaactggagctctttgtgcaatgaaagaagtcaacataattcctgatgatgcgaaatctgccgagtctttgaagcagttagagcaggttaattgactgtgtcctaaataagattacatgatgtccatttggggcaacataaaaatcttccatttatcactgccattagtttatctaaatgtattgttatattagtgttcctgtttactttttttatgctgagaaataagcttctatgcccaatctaaatacaatcaatcttcctttgaataaaaaaactaaactctaatgccctccattttgtactccatttcttagttcccactgcaagttgaaaaatgcagtattttcccctccaatgacttgacattttggcaatttcctttgttcactgagtttcctatgtttcaggaaataaagttcctaagccaattcaagcacgaaaacatagtgcagtattatggaagtgacactgtaagtccctgtggaaatctgatcaagtatgtccattgtcatgatttattctgaagttgtttttggatcgtgcagtttgaagatcgcttctacatttacctggaatatgttcacccaggttcaattaataagtatgtcaaacaacattatggagcaatgacggaatcagttgtccgcaacttcacccgccatattcttaggggtttagcgtttttgcatggccaaaagattatgcataggtgtgtgcaaatctctatccttgtttactatttttttgttgctacatcatctattagtttgactccaactgctgtgtgtgtgcagtactttacatatccttcttttggtttaaatattcatttcaacatggacaaactgtcttttctcagtttattttggcatgttctgtctaactgtgtcttgctcacctcacaggcctcatcttcactttcacctatcttgctattacttcagaaaatcattatctttatgcaaatcatttatccttttaattgctattttgctgcatgtaaaagttggagaacatcaaactaattttagtttgagtaaagtgtacgggcggtccttaaacttgtaggggtgtgtcatctaggtccctaaactctcaaaatgcatatccaagtcccagaacttgtcatagtgtgtcatctaggtcccaaatcaccacaatccctttacgatcctacgtggcgttgatgtggca

SEQ ID NO: 43803 - DNA, 10601 bp, Oryza sativa
  unsure (1)..(10601): unsure at all n locations
aatttaaggaccgccaatgtactttactcttttagttttttgtgaagatactagtactttctgcacttccagaattttgtttatgttggtctccgcttcaatttatgttaccttatgtcatgtatgtgaaagtaaacatgtcgactcttacagggatatcaaaggagcaaacctgctagttgatgttagtggtgtagtcaaattagctgactttggaatggccaagcatgtgagtatatcctcaaacagagtacagtagcatttgtacatatggtactttattgtgtatatccattttaaacagcatttgcatgtcattttagaatgactgagcaacagcttaagctatcatctaatatttttccaaatctaactagcatcactaaacaagggagttgttggatgcatttgatatgtgcatataacttttatctgctgtatgttgttgagctcttgaatcccattgagtttatgttcattgtcagcactatttgacatataattgtattttgtggtactattagctcagtcatatgcacggaaccgtttgataacatgctctgctttgggtaatttttaaaataaatgtattcccttattacatatattctgtttaatgtactgcttatgttaatctctttcttttagttaagtactgcagcccccaatctttcactgaagggaacaccatactggatggccccagaggtaggcatacacgtttcttaataagttaaaacatcttctatcaaggttcaaagaaaaacaaacatcgagctgtataagcggtagctccatatgatgcagtgtttttctttgaccttatactgttttatccatactaaagataggagctcgctttgtttagcttctcctggatttggttcctgaattgtagggttgcagtatttaaatggatacagaaaaataaaaatactttgtccgacacatgtgcccagcacatgggcttgtacagctccaacccaaactcagtttatgtaacagataatgcaaatgttttttaaagttgataggtttggttttgtcttgtttgctttaattcaattgaaattacattctttaattcagttggtctcagatgattaggctacccaatggtttagtacgacagatgtctgacctgaaacaacctcactaacattgctttttctaatttacagctgtgttggaagttctactttcaatgcaaataaatttagctgtaacattcttcggaaaggagctacggaaattctgttacactcttgtacctttatgcctattgaaatctagattgtttcttctcctgcagatggttcaggctacacttaataaagatgtgggttatgatcttgctgttgatatctggagtcttggttgtaccattatcgagatgtttaatggaaaacctccctggagtgatcttgaaggggtaagaacttggagtgttcatctttacatgaagcttagtaacatgcatgtcatgactgtagtctgcctattgtaatccctaaatatgaaccacttcacccaaccaacatttcttggtatcaattattgtgtttcaatgcaagtgtcacgcacacataaccattgtaatacctatgtaacatgttaatgtgataggtgtagccactgaatggcttggtagtttgggtatgaacaactatacataaaaaagtattattctgaaacactagtcataataaatcatttttgttctacagcctgctgcaatgtttagagttttgcataaagacccaccaattcctgacaatttatctcatgagggcaaagattttctgcaattctgtttcaagaggaatccagcagagagaccaactgcaagtgagctgttggagcatccatttatccggaattcaagtcattacaacaaacatggttccatacattcatttgcggggattaaatccaatgtaagtctatgtctcccagataagctctttgccacccacatgagtatgtgatgtcactttatatgacaggataataataatggaaatggttcaagagacaaagcagcctcgaagagtgattcctgcgtgaaaggaaaaattactgtagggtgagtagtttccttttatttagtgctgtcttaccttaaaatgttattttatttgatttttcatcttcttagatcataacatagctgacatgttttatttgccagtgagccaaccaatgctaggccttccgaatcgtcagcttttcgattgactccactatcaatccaggaagttgcacctaacttctcctctagacccttaggtctaacctccaatcctagtccatcagccaatttagtgaacactgtatattttccgattgcaaactctcagcgtagtcctttgccaagacctaatgaaaaggaggctctgttctaaagatatcaagcatgccatggggagtgtgatttccatctcggatcatgttcatgtgcacaactttgaatgcgaactcggtcctaactgtatttatagaattaaagcagagaaagaataggaagatataagaaggaagataaatcttgtgaatcttggatgttgcgctgttatatcagctacacagcaataagataaatggtggaagacatcccagaagagacataccttgcactaacaatcatgtgatggaagacataaaagttttgcagcagccatctttaactaagttaaccatttttgtgcaatagttgcactatatgaatttgtacagcttacatgttcttgtaaaatagtgattgcctatttggacatgcgactaaatgttgctgaatgtgacggatccatgaaagcatgggatcttcattgttttgggatattctgatggcattttttttttgtaacatacaatcaggaataactgtagataagttgaaagtcccttattctaatctcatctaacaggttccactgctgtgtaatcatatttttgttgtatttttgtacaaaatggtgtgattataaatactagtatttacccaacatgtttcatttgatttattggcggtaaaaagctttagtacagtacttactttgtatgtgcatactgtatgataaattacaaatcggtaaatccattatgaacactagatgaccaatggctcaagtcaaactacctacatacgcgattgagaatgtgctagtttgtaaactagttgtacaatttcttcacaaaattaatcgctataaacagtcgcttaaacagttgtacagtttttccacaaaattaatcgctataaacagtcactttagacataactcgtcaccgctcttcaacttccaaattcaagcttctgaaaatagtatttaaacccacatgaaaaaaaacatataaaaagaaaagacattaaccaataaaaagtctttatcatgggtaatagaatttgtgacactaaccttgtacaggattctgttaccattttgatgtttacatgcaatacagttcataccaaagtatacaacactggaaagcaaaatgagtacaatcaagcaacaagtttagtgcggtgcatttgtcctctggaacatacaaaacctgatgtcgtttgttggtaaatgtaaaaattcatgagtatttctggcctagagaaacttagtaacatctggcacaccttccttgccatgctctcagtgattgaatgacagaaatttattgtcatgtctttcagcattgctgcccaaccgaatagctgcttcacaagagcaatttgatgttcggttcccctgaagttattgatttctacctcatgaaggaatgccaactttagttcctcagttttccaatttggtggaagatcacaagtgcaacttgatgaacatgcagctcgtgcctggaacgaatggcatattagtgtagtaacatcaacttgcctaaagttgccgggctgcctaaacaccctcaggatgcatcactgaacagagattgcataagaatgacaactgcaaactagtttgaagccaacctttcgcagaaattgtagttatgtgctatgataaagttgtgcgaaaaacgtaagtataaaattacctagatcctcaggtatcgcaaaattaataacaaattgccaatcagtatcatccctaaatcctaattgtgtttccaagagcgtgtgatagccatgtgacaactcaaactcagccaaccccatctagagctacgtccaagtattaaaaaaaagggcagtatgacacttgctgagaaaaatgttgtcaagacatgcataagccataatgccatatatttacaacatatatcagtaattcaatatcaattcaaatcacaacctagggtagggaatctagccaaataaaatagcaaatcaagcctaggtgtgacaaagcatgaaaatgcagactgtagtccacaatttccttagtaactctgtattatataagcaaattaaggatagtttttagcttttacctgcggattactagaataaatatctgttgccagctccaaccttcttatactagtgctcattctcagaacatggaatacgctgggaccaatggcatgtccacttgccaatacagtaaggcccaggaacataatgtcagggagcattgtcatttcttccatcaagtattcattttcaaggtcatttagttcctgttgtagaaagtaaaacatataaggacagaaagatctcacttgaaaaaagttattagcacaaaccaatcagttgccatacgttaacactttaattttcattttcttgtatacaatctggagattctgaatctagaaaagaggggatcatatataacagttggagtagagaaacatatcctttggggaagtgattaggggtcattacaagctaacaatttcatttggatttgtaaaaaaaaaaaggtctggacactgtaagttataagtctggccaagtcagaaaagtgcattggttattcccatgagcatactgcatatctcaattttagaatggcaatgataatatatagtgcacaagtacaaatattgtctgtactcggttcacattcccttgattattgaggtatcatgttcccttcaataaataataaactagtactgtattgcatagtgctagcatatgctagttctcatggtaaagtggaaaatgtagcaccatcaattaacagtaagatctagtgggaaagaataaaattttagtgtgatcaaacatgatgtatgggcttgactcttgagcaatgcaaaacatacatgttagtacctcaacagcatttactaaatttcatatgtcttgaccaaatattaagatattatgcaaatgagtatggtgagataatcatctatgaaccaccttgatttgttcgctgcagtgaatacacggtaatgcacagtgctctcatctatgatgctagtagaggaattgaactcaccgacatataggcaagcgtgagggaaagacggtcgagggcatcaaactgaaagcgctgcaacagccttaaacaatcgccattgtggccgaagtcctcttgtccaaatgcaagataaaagtgagttcccagacacttgacatttgccatgttgccaaaccggacggagcttggatcgaaagcatcctcccagtggagagtctccagctgaggggctgagatgtcggccaccggttgactcatagccagaggatcggagaagcaggagatcacatatagcgcgccgagtgccggcgcaacgacattgagctgcttcaatcctttcagtccccccaaacgaatctgcaggagagactccgagtggatgctgagattgctcaacccatgggcattctggatggtgagtctcttcaggaatggggaccgcggtgaggagacggcgtcgccgaggtcgcacgggcggtggaaccggacgttgtcgagtgagaggagggtgagccgggagaacacgccggagcgcggcatggcgacggcaatgaaccctaggtccagcgcgaggttggcggcgctggcgaagcagggcagctcaagaacttctccagcggcggcgccctccccctcgtctctcttcgtcttcggcaccacgttgagaagccctagatagccggagaggcggcgcgcggcgagggggagccattccgcgacggatccagcggtggcgcccacggcggagacgaggaggaggcggaggggaggcgctccatggtaggcgagggcggcgcggatggcgcgggcgtcggctgtggagacgaaatcgagctccgggaggaggtaccagagggagcgccagcgccgggagaggacgctggtccgcgcggcggcgctcgtccctacccggagaaggatttggacgagcaggtcgtcgggaagcgcgctgaggcggtcctcgccgccgccgccgccgccgtcgccggcggagagcttggcgcgcttggcggtgccttcctccccatcgccgtcctccatcgacttgggtgggtttcgtgttcgggggcccaaaatccggaatactggaggagttctagggtttcgatttgatatggtatgaattcaaatctcctcttcgttttgaatttaaatttaaaccttgcgatgaacaaatttggattaggctcctcatttcaccacaaattacaaatcccatatagtactccctccgtcccataatataagggattttgatttttcgcttgtaacgtttgaccactcgtcttattcaatttttttttgcaaatataaaaaccgaaaatttgtgcttaaagtactgtagataataaagtatgtcacaaataaaataaataatagtttcaaaaaaatttgaataagacgagtggtaaaatgttgcaagtaaaaactcaaaatccattatattatggtacggagggagtaattcattgtaacaaaacatggctccatacggaactggagatgcggttggttagtgatggaggcatgtcacgagggtcttcgaccaaacctaccgaaaccaccaactcatgaaatgtcggttgaacccaaggggtgcgtctaagggcctgtttagttcacgaaagaaaatttttgagtgtcacatcggatgtttgaccggatgtcggaaggggtttttggacacgaatgaaaaaaaacatgatttcataactcgcctgaaaaccgcgagacgaatcttttgatcctaattaatctatcattagcacatgtaggttactgtagcacttatggctaatcatagactaattaggcttaaaagattcgtctcacgattttcccctctaactgtgcaattaatttttttaatttatatttaatgctctatgcatgtgttcaaagattcgatgtgatgtttttgggaaaaaaatttgagaaactaaaccaggcctaaggcgannnnnnnnnnnnnnnnnnnnnnnnnnnnnntaatgacgaagaccaaagggttcgctatcaagctcaccatccgcctgaatcatcactaagggcaaaggccataagacgaagcaaagaggccatcgcccgaagtagaagatgccttcggctaagggcttaggaggctctgtggcccatggaggcctttcgccactaatgggctggcccaagaaaatcgccgtagggcccatgaatacaaaagacattgtatacccacactaatgtctctatcataagggtaactatgtaaatttcccttattaactaaaccctaaagggtatgaacctgtactttgtagggtctattcgttttgaaagaattttgtaatacatagaaataggacaaatagaggaataagaatagtaatttttcaagaggtttgattggacggagaatttcttatatttttctccctacaactagtaggagagaaaaatttcctttggtattttatatctatattcttctgaatcgaatgacatttataggaattaatctttagaaatccatgtcctttggaattcctccaaaacaaataagccttattcatttttactactgatttagctggtgagaattctgataatttaaaaatttggaagtagccgcatatgccagaagctctccatgtgccctttgccaccattattaatctaggatgttactcctaacatttcccttagatccttatgtatgtctagcctcccattgttcatcaaccaatttagtgaacacattaatctttcaaaaacaaactctcaggtctcagcctagtccacattgccaaggcccactggagaagaggttctgttctaaagatttacagcatatgccaaggaagcgtgacttccatctctgttaacttgtaccttacacaattgaaacatacaaagataacgagataaatcctgcacatcctccatgttctaactttctatcagctgctcaaaattaaatgatggaatgaaacattactgcatcacatatgagccctgcctgctctaacactcatgtgatggaagatatgccaaagttttgcagccattaactttaagttctaaccaattttgtgcagcagttacactacatgaatttgcacggctcacatgttcttgtaagatagatggctgacctgcattttgtctaatatctgagagcattttgatgtttacatgcaacgcagttcaaaccaagtacaaaactagaaagcaaaatgagtctaatagtcaagcgtcaagtctggtgcggcgcattagtcctctggaacatacaaaaccttacgccatctgtggtaaaaataaattttcatgcatatttcaggcctagagaaattaagtaacatctggcacacctctttcgccgtgctctcagggactgaatgatagaaatttatcgtcatgtctttcaacactactgcccaactgaatagccacttcacaagggcaatttcatgtccagttcccctcaaattattgatttctacttcatgaaggaatttcaacaaaagttcctcagttttccagtttggtggaagatcacaaacgcaatctgatgaacaaacagcttgtgcctaaaacaagcagcattctattagtgtagttacattaactttgcctgaaaaacacctcgggatgcatcactgaacaaagattgcaaaagcatgacaaatggaaactagtttgaagacattgtagttgttatgtgctatgataaagttgtgcgaaaaaacgtgagtatgaaattatcaaggtcctcagaaattacaatatcagtaacaaattgtcaatcagcatcatctcctaaatcttaattgtgtcaccgagagtgatagccatgtaaactcagactcagaaaactttcaatctggagcaaaatgcttccaagcattcaaaaaggaaagagcagtatggcactttgtcaaacttgcagagcaaagtttttccaataggacatacataagccacatgtttactacatatatcattatcaattcaaatcactacctagcgtaaggaaactagccaaataaaatggtgaatcgagcttaggtgtgacagaaaatgaaaatgcaaattgcattctggacttcctcggtaagcctgtagtagataaacaaactaacaatagtttcagcttttacctcgaggtcaagagaaatatgtgttactagcttcaaccttcttacacttgtgcacatcctgagaacatggaataagctggggccaatggcatgtccatttgccaatacgttgaggttaagggacacaatgtcagggagcattgtcatattttccattaagtattcaaagtcacagaggtccttctgtaggaagtaaaacatggcgattatatatagcaattggaaaggaaggatagaaagatctcatttaaagaaagttattagcatagacaaatggttgttgtaagctaacaatttacttatgattttcttgtaaaaaatctggagattctaaatctagaaaacagggaatcaaaaagagcagttggagaggtacagaaacatatcctttagactatgtgattagcgaacaggacatggtcagtagaagctaaatttcttattaaaaaaactatggccattgcatgtctagctaagatataggaaactgcattgctcattctccttaagcacacatggtatctcaatttaaatttggcaatgataatatacagggcatcattacttggtttaaattctctccactattgagggatcatatttcctttcagtaaatattaaactaatgcagtaccgcataatcattgcacataattctcatggcaaggtggaaaacataacacatcaattaagaggataaaaagacataatgggaaagagtgagattttggtgggctgaaatgtggcgcaggggcttgagcaatttaagacatacccgaaatacttcaccgacattaactaagtttcatctgtcctatcaaatatcaggagattatgcatatatgtatggtgataatctaagaacctccttgatttgtttgctacattgaaaacatgagtaaacagtgctctcttctgtgatgctagtagtatgatactatgatgtactcaacataggataggaattgaactcaccggcagaaaggcaagcgtgagggtaagtctggagatggcatcacgccgaaagcgcttcaagagcctcaagcaatcgcggttgttcttaaagtcttct

SEQ ID NO: 43804 - DNA, 4158 bp, Oryza sativa
ggatgggaaccgccgcgacgaggcggcgtcaccgaactcgcacgggccgtggaaccggacgctgtccagtgagaggtcggtgagccgggcgaacacgccggagaccggcacggcgaggggaaggaaccctaggtcgagagagagcttggtggcgctgccgaagcaggggagctcaagaaatggggagccatccttcccctcctcgtcgtcgtcgtccttggcatctctcttcggcgccatgttgaacagcaacagatccccggcgaggcggcgcgccgcgacggggagccattccgccatgccgtgaggggcggcgtcctgggcggcgacgaggaggtggcgtagggaaggcggttcatgggcagcgagggcggcgcggatgctgccgccgtcggcttcggggacgaaatcgagctccgggaggaggcaccagagggagcgccagcggcgggagaggacgctggtcctcgccgcggcggtggttcctcctatccggagaaggacttggacgagcaggtcgtcgggaagtgcgctgaggcggtcctcgccggcggcggcggcggcggcggcggcggagagcttggtacgcttggcggcgccttcgtccccatcgccgtcctccatcgagttgggtgggtttcgtgggcctggaactcaaacgtgttggcccagcccaagtgccttacataactgaagcagcagaggaagtagaataggaccctgtttagatgggactagaaattttaagtctctatcatatcgaatgtttgaacactaattataaatattaaacgtagactattaataaaacccatctataatcttgaaataattcgcgagacaaatctattaagcctaattaatccatgattagcctatgtgatgctacagtaaacattctctaattatggattaattagacttaaaaaatttgtctcgtaaattagcttttatttatgtaattagttttgtaagtagtttatatttaatactctaaattagtgtctaaataaagagactaaagttaaggtccctcatccaaacaccagaaaagacgaggaaataaatcctgcgcatccttgatgatgtaatcctctaccagtctacagatgctcactacgatggagtataattgtgtaaggaagcattgttgcatcactcaatgtaagttccactccctctgtatcattatattataagtaatcaaatattttatagaaaaaattagcaacatctaaaatatcaaattagtttcattaaatttaacattggattttgataatatgtttgttttgtattgaaaatactactatatttttttctataaatctagttatatttaaaaaacgacttataatataaaactaaacgtagggagtaactttttttttacagcagtttgtaatatataaattgatacagcttccttagagagcatggaaactagccaaatctatatccagtaaactagcatactaagtctaaagctcaacacgtaaccataccacgtcatcactcactagcaataattatatatttaacttcatgcaagcatacaacatcatctacagtttatttaattatacaaatcaacatgcaagcatatctaatcatcacccctcacatcatttacataatattttaacaaatctatctatcatttttataatatttaacatatacttattaacacgtttcacatcatttgtttgtttcatggtaagtactgataaacacagatcactagtacagatccttccatttgtgacggcccataacaagactggaatttgcgggccgtcacaaggaagtaatctcaatcgggccaaaatttcgcccgattgagatatggtcgcacagccatggtatatcggcataaaactaaaacccgtcacggatgacacttatctgtgatgggctatagttgaggcccgattgagatgagggttccatatctcaatcgggccctaaaagaagcccgtcacagatgagggtcatctgtgatgggctccaactagaggcccgattgagataagtttattgcccgtcacagatgacactcttttttgattggccttttattaaggcccgatagagattacttgtatgcccatcacggttgattgttttagggccgttacagatatttgttgcacagtataaatactccccaccacctagtgtaactgtatcccacagttcactattttggtgggaggctgtagggggcgaatttttgtcctttttccaaggaaaacagaaattaaattcccaaaagtaatcaaaatggatcaatcaagtgagtaatataaatcattaattgagcaatttcatcacgtcttacttttgcaatactgatcttataatatgtgcctctaatttgttttttttagcaattgatcgaagttggatgtatgccaaaaatttgaaacgtcattctacagagtaccgaaagggcataataaaatttatgaacgccgcggaggaggatcggataaaaagaaacagtgattacatgtgttgtccatgtgcagattgcaagaacgagaatatgtttgatagcggaaaggacgtacacggtcatctgatacaacgaggattcatggagggctatacatgttgggtgaagcatggagagcaagaatcaggaagtggagcagcagcagacagaagtggtgcgcataattaggaagatgaaaatgagcatgaaatgtttataccttctccattgggcggtgaaatggttgatgtggatcacgatctgctgcaagacatgttacgtgacgttgaggacccagcccagaatgagagagatggaatgaaattcagcaggttggtaagtgattccgagacgcctttgtacgctggatgcaaagcaaaacacactaagttgtcagttaccttggacctaatgaagctgaaggcaagtagtggatggacagacaagagtttcacaaatcttttaggaattttgaaggctatgcttcctgttgagaacacattgcccgagacgacatacgaagcaaagcaggttctgtgtccactggggttagaggtccgtagaattcacgcttatcccaatgactgcatattgtaccacaagcaatatgcggacttggatgcttgtcctgtctgcaaggcttctcgatacaagcgaaagaaaagtgctgacgaaggaaataagtcaaagaggggtggtccggcaaaggttgtgtggtatctacctatcattgatcgtttcaagagaatctttgccaacccgaacgaagcgaagttagtacgttggcacgccacggaaagaaggaatgatagtatgcttagacacccagcggattcgattgaatggaggaatatagatcgaaaacacaaagactttgctgccgaccctagaaacatgaggatatgtctttgtacggatggcatgaatcctttcggtgacatgagtagtactcacagcacttggccagttcttattgcgaactataacctcctgccatggttatgctttaagtgaaaatatattatgttgtgcttgttaatccaaggtccaaggcaacccggcaatgatatcgatgtattcctggagcctgttatcgacgatctggagattctttggaaagaaggtgtggaaacttgggatgcatatggtcaggagaacttcaagctaagagttctattgttttgcaccattaatgactaccctgcactcggtaatctttccggacaaactataaaaggaaagaaggcaaggaacatacatgaagccggtggctgaagaaatcacgaaagatggtatacatgggtcaccggaggtggctcccgctacgtcacacatttagaagaaagaagaaaatttttaatggtaagagagaacttcagcctgctcccaaagatttgtccggagatgaggtccacaatatggtcaaggacataagcaatgagtttgggaagaaaagaaaacgtagcaagacaaaggagaagggtatgtggaagaaaaaatccatattttggcggctaccttactggaaagatcttgatgtccgtcattgcattgatctcatgcatgtagaaaataatgtgtgtgagagtttggttggcctgatgttgaatattcccgggaagacaaaggacgggttgaacgcgcgccttgatcgctta

SEQ ID NO: 43805 - DNA, 12883 bp, Oryza sativa
aactaaatgcccgattgagatgaggtcatctgtgacgggctttagcttaggcccgattgaggtcactagtcatctgtgacgggctctagtttaggcccgattgaggtcatcagtcatctatgacgggctatagtttaggcctgattgaggtgagtatcatctgtgacgggctctagtttaggcccgataaaggttagtagtcatctgtgacgggcgctagttgtggcccgatagagataggtcatctgtgacgggctatagtttgactggtcgtctgggtcaaagctatcggtgacgggctttacttagggcccgattgagatatattcattcgtgacggccgtttgcccgattgagataactcttcacatcagtgacttctagcctgtgacggacgctgtgcccgattgagatggggcttaccgcccgattgagatgagggtatccgttctagtggatgttttattatttttttcctttttactcctagcttgattgtcgaaaaaatatattgagaattacttagtaattcccgcaacaaagtacgggaaatcacctagtaaaatagcaaatcaagccttaggcgtgacaaaaatgaaaatgcaaactgcatgcattttgtggcttccttagtaactttgtcctactcatatacttcatttgataagcccaacgaactaaggatagcacacgtgcgaaagatgaatcaacgcgattgtgttcttgtaatatgccattgtccaatgcattgtgaacccaacaaaacgctgttacttatagaagattcacattgcttacgtacaaattataatttacaaacatggcgctaatgaagattgttctcaatggttctgctcagtgctcttgtgaagaacattatcttcttcaaactgttatcttgattcatgagttaagagcttactctagaaattgcacaacagaagtactaatgtggttaaacagggaaaacatacagaatggtgacggccagatgtgaattcctaccgacgcccatcgggatattatcaggcatgaagtctatgcgataaaggtgcatgtatttcagacgattaagagcgaggcgacttgttggctataaggttttttacagcctttttttagcccacacatataatagttagctatttataattaatatagcgtccacttgtttctctcacagaattttttggttcttgcgttcaagccggctgtaggtttataacccacttctcctctctttcctctcttctctcctccacctcagcatttagccgatttatagcctcctattatacttgctctaagggcctgccgaatctccaacgtgcttcagctttttagcgacatgcaaaacaagataagctattagcatattacaactttaaaaataagtttatttttatttgattatttttaaggaacttttatgtgaaatgttttttttaagaaaaaacatagtagtactccctctatcccaaaatgtataagatttgggtggatgtgacacatcctagtactacaaatttggacaagctagaatgtgtcgcatccactcagaatcccttatattttgggacggagggaatatcatttaaccatttgaaaagcataacataaaacagggaagtttagttgggagttgaagttgtagtttgttaattagtcagtagaatgaaggcaaattttgctacagaacatcgcgacttcgtggttttagctgtaggacaccgcacaaactctttttttattttgggggggggggcactttctaaacatggttatttgccagtggacaccacacccattaaaatattaattttcggttgaatatgagagacaaatagcgtgaaaggtcaaaaatgcccctgacctcacttgtcatattcttcttcctccttatttcccttttctcctagtcccacgccgccaccgatgacggtgtccccaccaccgacttccggaacgacgaccgcgtcgagctggcgacgctggaatcggacaggatgtgctgcaccctgaggcgacgcggcctgctgtggggatagccctcacctccacaggaggaggcgacgactactgctactgctgtgactatcctgtgctgcaccctgaggcgacgcagcctgccgtggggagcccttacctccacaggaggagccggtgactgctgctactgctgtgactacaagggcggtggcggtggcagcgtcgggcggtgtttgggaagcaacagcgttagtggtgggagtgaggacgatgccgtggacaatggaggcgccggcacggccgtggtcaggagcaccgacgcggtgtggtgggacatggcgagagatgggtggccttgcacgaaagcgggagagcgtggcagcggtgaggcggagggagcgaagttagtcagcgtgggccgaggcgagttgctgccacaatgctaccgcacccttcatgtgtcgccactgctccttgcactcccgcaccgtgtcctcctgctgcaccttggatgccgtgcatcccgtcgccccccgtgaactagtgacgctaccgccaacttcggcctgtgcaccgcatgctgccgtcggtgctccccgcttccacctctcgcgcctcacttgatctacgccacaactgtcaccgctaatgtcatcgcttcgggcgtgggcgtcgttgcatggtgtccccgcgccgccgccgtcctgattgtcccctttcctccgccgtgcctctgtcatcgtcgcacactccgcctgctagttgcgccgccactcgcggctcgcagtcatcactagagaaaagagaaaggagggagatagaggatgagataaggaagaagagaggatgaggaaaagaaaggatgggcaatttggtcactccgcataaaaatataggccccatatcgcctcgttagcacgaatacattattttaatgggcgcggtatctgctggtaaataaccacgtttagagagtgtttttccttaaaagtgagttcgtcttgttgttctacagctaaaaccacaaagtcgcgatgtcctgtagcaaaatttacctagaatgaaagaatggtgacatatcataaatctatatatagaaagatacggagaccaagttgattatacaataattaacaaattagaatatacgaattgaagaaattttaaaataaagtgccagtgtcctcagttcctcactacctgatcaacaagcatgaggagagacttcaacgaaaatttgctactgcaaatgcggaagaaaaggtcgatccaatcatctaatcatcgcaacattctaactaaatggatatgctgacaagcaatagaaagacataattactgctactcctggtgatatggagtattggtgtcttcactcttcaggtgatatggagtattcctgctactccagtttgcagccaacacattcctgctacttcagtgtgaactcaacgtttggtaggcagaattctaagtgctcagtcataaagtagcaagcataatctgaagtagtagcattacttgtttatgaaaaacagaaatgtaattattgttccaaattatgcacacttactatgctaagtgcagtactaaactactaaaccacaacccgtgcaaaagactcatacaaaatactaacaagcgcaatccatggacaaatcttaatgcatgtcaaaactacaccaaacatataaagcaggacctctctagccacacaaacttttgagtctaaactttacctaaccagaacacacaaagcaaagcgagcaaaagacattttttagataatggaagcttttattgaacctagtcaattacatcaagatgatataattaatctgagaacacttctggcctttgcataattaagatgcacacagccaaacatacaaaaccacactcaaatggaaaaaagaatgacatggagtattgaagaccatcaatccaggggcgtagctacggggggtgcctgagggggccaacatccccctatccaaccccctccctgttgtactaactagcgcattagcatgttaattagtccattatcaataaacatgatatagaaaattaattaataagaaagagacaaagagacaacgcaaatcaactcctcgtcttcattgcttcggcttcacatgtctctccgtactcccattgcgtctcgctgtcgagcatggtgtctcaagtctcaaactgttaaacattgaatgatacaactaaagagctaaattcaagcttttttatagcagaacacatgatattttgttttatcgtcggtattgcttactctgacttacgacttgtttgtcctgcccacacccccctaacgataaatcctggcttcgcccctgcatcaatccaaagactaaattgccaccaatgaacaactctttggccatctcctccaaaagcatagagtattaagagttcaccaaccctaagactagatcgtcacccatatccctaggtaaataattccttgaccaccttcttcaaatggagacaagctccaaatccggcgaaccaggcttctgtaggatagcccatgtacgaagccaatggacaagagaatatataacctgcaaagatgaaggtatgacttttttttttaccaaaaaccacattattcatgcatagccaaagagaccaacaagtagcagctgctcctaataggacacgtgctttcaaattattatgaattccagcaagccagctcctaaacatatgcgctacataatgcggtggaggaagtccagatgctacttggatgatggaccaaataaaatgggcaaaacaacattcgaagaaaagatgtctaattatctcgtcattgcaacaaaaacaacagttcttattgccttgccattttctttttgtcaaattatcctttgttaacaccactccacacacaagtaccaaagaaaaatcttaacttttaggggtatctttaatttccaaagacgcttattattgttgggaatattgatgtgagttagagctagataatgagacttctccgaaaactccctatttgaggttaagttccaatgaaactcatattgctcctaagttaattgaaaaccagtgatgcgtggtaataaattattccacaccgctagttttgatcctataaggtctcttctccatgaaaaagatggaggattgttttcgaagacttgtgcaactgtagcctgcatatgcctaactatgttgtaaaggcaaggatactgttatttcaaagttgaattgcctaaccatttgtcttcccaaaacctgatttgggagccatctttaattataaaggatccaaaatggagaaattcatgtttcaccttcatgaggctagaccaaaagtgtgattcctcggccttccactaaacttcagaaagaggtttatcacttagatacttattacttatcaactgttgccaagccccttccgtggagagtaacttaatcacttactaagcagagccatattcttaatttccaaatcatgaattcccaaccccccttgttccttggggcaacacagtatgttccatttagcaatatgatactttttttttctgaccatcactttgccagtacaacctgaagcgaaagtagtcaagctttgtaagtatccctgttggtatgacaaagaaggacatcagatacaacaggaggctacttagcaccgagttaatgagcgagcaaaaacatatagtacatcacgacataatcaacgggttaattccagttaaagcttgacaatgataatattagtgcaaacatctttactcgtcactaatagatcataacagaaccaactccagagtttggcacgacctaattatttatcagtagaaacaggagcaaaccaaaagtgatagaaacatagtggattgacttagaactagatttctttagcacactttcatctagtgcaccttagctattgattttactcgctgtagctgctctttcgctgttgcccttcatcttagctacacatccattagcttcaacacgagcatttcttcatttcctcttctcaagagtaaaattcttctcatgtgttgtgtattcattttcccagttctggacctgatagtcgtgcttcatgtaggtcttttcccagttagaaacctgatagggaacacctaccgctaccccaaccatgacagaagatcgccaaggttcaggttctcaattttcccgcgccctccaagcactcaatccttcccattatatcacaacaaccacctattctcatcatatcacaacaaccacccgaattattgggtaaaaaacaaaacaaattatacacaaggatgtcaaaccttaaaagattgtcaataagaattactaatgaaaaccacccaaagctttcaaacacacgacgctattcgtgtctcattcatattcctagtcctattttaataaaattactatatcatatgatttttcaaatacattgtttcaatatgttgaaacatatttttgctaatatttttaaggccagttaacatattcatcttctataaataaggtcaattttcattaacgaataaatatgtaatcatatagtgttaattgttaaacgctaattttctaaagctcttatttcgttcaacattaattttctaaagctcttatttcatttcaattgtacgtaagagaaggagtcatgatgtttatactttacacctatttatgcaatgcgacctatagctattttcacacttctcaatatattacaaattataataatacataagtaactaattctttattatgagaccatttacaaatatgcaactctccaatcaatatttatattgtaacataaggattgttatgcggcttatgcccattagatttgtaacaaatgttgtattctgcttttttctaatttaattctagtatttcttggactatctcattatttctacatatggaattaatattgtacactcaatgtgttatagacaactctagtacaacacagaggtaaaatgcttactcatttgcatttgtgtatatggtatacctatgcctagaagattactagatatacataatgtattatagcatatttcagggcagaattaacatagttattatatatactagttgataccctgcattttgctgcggggtatatggatgaatgcatgccactagatatacgtaatgtattatagcatatttcagggcagaattaacatagttattatatatactagttgataccctgcattttgctgcggggtatatggatgaatgcatgccatacattatagaaatggtatatgtatatgtttaaataatatgaaaataaagttaaaatattgatttgacattgcttgcatattgagttctgaaaacacaacaaaattttaaatgatatatcatgtttacatgatatttaagatagtctagataataattgctagtagatgataatgtgacacacttacatgtaatttaaaatactctagaaaataattgctagtgggtgattatgtgacacacttgcatgttgagctttagaagttagtgggcatcaactttatactaagataggataagttttatcactactctggtgtttgaaactgatgaagatgaagattgagttggttcacgtaaaatgagaaagctattagcacatggttaattaagttttaattattacaagttttaatgcaatatatttgatattttaaagcaacttatatatagaaagttttcgcacggaacacaccgtttagtagtttgaaaagcgtgctaacggaaatcgaggtaaaatatgtatcttagtgagaaaagaacattgttaggaaagttttttttttcattttttaagaaactaatcataagcaacatgctttacaacaaaataaaaatatttatatatatgtgaaagatcaattggagatcttgaaaagctcttgtaccaattaaacatgcactaaggactatagatgtcccctagagagggtggatgaatacgcatttcctacgattacaaaaacttgcagcatgttgaccagacattccgatgccgctatagatagtttgacaacacacagtgtcgtacaatccgacaacaaccggataatctgatcaaacacagagaaaaaaggagaactagcctactagagtgtagacccagacagtccgataccgcaccggacaatgttcgaaaatcctagagctattggacaattcggtcctatagagaaattgaaacctatgggagattaagtactttgcacactagttataaactagaactaggaggtggtcaacaagatacaagcgtgcaacaataagatcaccaaatagctcaacatgaaagcataaatgaaaagtgaagatagcaatagacaatgcactgactttgtttactaaagttcggatccaacctgtacacatctccattgagggtcttagaaaagtcggatccctttttcctcttccaagctaccacctccctattgagttgtgatccaaattcatttgtacttaataaaggccagcttctgtcgtagtgaagcggaggcctattcctgggaggcttgggcctaaacggatcgtcatcccttttagggttccaccatatatatacctcttgtaagccaccgtgcggcgatgtaacctcaccccagatatagtgaagatattttgctggttggcgcccgtggtttttttctctcctgttttaggagggttttccacgttaaaatctcgtgtcttctatgattaatctattgttctttatcgtttgtttgcctatcgtttcctaacactcccatggtgtattggtctcttcaagcaatcaccaagggcaagctcatcctccaagcgatccacttggtccaaagctcaaacgccacacaatttccctccaatgaagctttctctaccaagcacccaccgagatgtagcccagcttccactatttcctcttcccttggagaggcaaggtatcaaccttcacaaacttctcttgggcataccacactccacttggttgcctgcaggattctccttctcctcttacaatggctcaagttcttcaacttgaagcataccaactccaaattactcccaaatccactccctaacaagcacacaagctctagccttcttataaatgtgcaagaactcactctcaaggataaactctccctaaattcctaaaaggatattcaattagctcttggggctcttgggcaagcactcagcttgctcaagtagaagagggtccaaacgtattcaaacaactccatggcaccgactatatatagcctcaaaggaccctttgatatcgactgaagttctcactgcagggagtgcagcaattacctgtcctctacagggtatgaagtggtcagagcacaagaggctcctctccaccaaagttaatttgcaacctgacgcaaaactgatggaattggaaaggtgagtaaacgatattataaagactgcactgtttaaagagggctctcacactggattagtaactagcaagtctactgtaataagtgtgcatacccccatttgaatccagtaggctgcatttcaaattgatggaccatgtttcttgtttcatttatccaatggattttaaaacttgaaaaattgtttggcgctagctctacagtatatataatcgtgatgatcaaatcatcagttaataacacccctacccataccctttttctcatgttttttgttttttttgggctccttggaatgctgccacgctgttttattcgaagcagtgctcctcaattgggtaagggagactgacaacactctattccaacagtcatcccacagtttgaataaagcaagcggtcccctcgtgtccggtgtgcttcactggttatgggcggtgagggcttgcatggaggccacgcaccaccctacatatttgtcataaaagcccctgataatttgagaaagtaagaagcaacccttccatcatatttttctcgttataacttttatgaaaataaccatatacttctaagaaatataacacgaagaagagaaaattcggtttttaaggatggcgctgtaatccgaaccagaataaggatatttttgcaaaataacctcccaaacatatctcctcttgtctacctacctcatccccaacccgtcactggcgctactcccctcacgcgcctcctcctagcgccaccgccgctccaggactcctcctcctcagccttgctcgcgcccctcgtcatcgccgtccaccccatctcctgttgccaccctcctcccatgcccataaacgccgtcataatcccccacatccctacctccgtcatgcgtgcccgcgtgagccgtcgccgtctagctcatagatccatcaccaagcaatgcttctttcgtccggtttgtcagtgcagcgataacccagtcgacgtgctcttcgggcagcggaccgccacatcaggtctatggaagcctcaagcctgggaggtgcaacgccgtcggatctggcagcggcaagtgcagtttgggtacagctgcaccccctgcaattgcatttcaagcactatcctcctggctgccgttccacctcttccctatcctcgtcgaacaaagaatgcgataaagtgagcgagcaagtgaaacgagatgagacttcacggtgcgcctcctacgacgcgccatcgcccgcgacgtgctagtcccatcatcaacgcggcggcgacgccaaggtacgagagccgcgcgctggtggtggccagatccagacattacctgcccgcacaggcggcgcaaacagctgacgcagcatgggaacatcgggtatatatgtccttcgcagactcatctccatggataagaagcctgcgaggaatctcaccggctttcttgccaccactgctggcactgtcgtgaataacaacaatagtggaaagttgcctggtctatcacggaagttgttacagaaggcgctgtcagagcacaagaagaacgcactgacaaaggtcaagagcagtggcaacacgcgggagcactccatggtgctgcgcgacgagtgggaggacgagatcgctacactccgcctccagttcgagcagaaggacattgaggtacacacatagacacatccacctcttccccactcctctgtgccttctgtgaattccaacgtggccttacattgattgcagggacactaaaactaatctaattaatcttacagggacaacaatgtagctacacaagtctcatgcaacaaatattgaagacaccaaggtgtagtaaatggcaatctttatgattttgctttccacagatatcttacatacaccatctggctttgaggtaagaaatatggcattatctcaggcttttaaaaaacataaagaaaaggatagtataacttgaataaatgtaagatgttatctacactactgctaattctttatgatggtatattgatattcttgtagaactcaatgatatcaacaagcaaataggctttttgatatgggcaattggctgataaaacaagagaaggggtttaggtaaactacacacatcattacatgcatgtcataaaatattctgcaacactgaaaagtaacaaaattttgcctatttatttttcaatttgattctgttttgtttcaaggcaatttctgaacaatggacaagcaacaatattgatgaattacaacagcaatagctacaatcagcaaggcttctcttctaatcacaccatgctacaaacaacattcagatttaacacgcaaaaatatgcagtttagcaaagcttccctacatgtacttgaaaaaaaagagccatccaaaaaatatactgatacaaataaaaactccatacccatattcaaaaatcccagctagaaccaaacctaaaaccaaaaacagagggttcaaaaccagtagatgaatctgtatgccacagcacactcacaacatatacagatatacaaatcaacataagcagggcccccctcaaaaccaaagaatataaaaatgggggaaaaaaagaaacccaaacacagggaaaaatcaccttgaatcccaaagcagatagagcaagcgtgggatctaaaagcaaaccatctcaaactagaagaaatattccaaaaacaaaaccaaataacaggaggaaaatgaagggaaaaataacctaaaaccacaaaggggtggagcaaacaaggagcagatccaggctggagatgggaggaactaaaactagagaaaacacagtaggcaacgagaaacgcagccaccgagcctgtcgcctccgcctaggcctcattgccaccaagatgtctctaaagaaagccgaaagagacaagactatgacgcggtatttcactgttcaaaataggggaaatgctaacaggccggcccaaagtgaaacccaaaatgctcaaagcggattcggacccaaaccgtaacacgaatcttggcacaagactgaatggatgaaaaattgaagttttggacctcgaaagctatcaacagcaccatagcaaatctattaaaataaatggtttgattaaaaaatgattagcaaacttacatggtatgttcctccaatgggtataaaggtagaaggaagttcattagttcaactgaataaagaacataaaaggaaaatgtaatgtcaataagttaataagctttataaaacaaaaatcatgtcttgtcttccgatagttctgccttaattgaaaaagacagtgtttttataaactcggcaaatttcttttgatctaattcagctttgatcttctgaaagttactgttgaagtcatgtagaaaaatttccacctcaacctctaaaaccttgaaaatgaataaacttttgctgatttgaagtccaatgcgagttaca

SEQ ID NO: 43806 - DNA, 2054 bp, Oryza sativa
gtttaaggtggtgcatatgtggtggaggtggtatagcttttggtttgagctccaaagcatctaggtttaaggttggtaagtttatggaaagcagccaaaagaaggcaaacaatctttcgatttaaggctacaacaggtacaaaggtaattcaaagccaaaagagaccaaagtcagttatcattatgctttaaacaacattaggtgaaaatgaggcttcactaggtgcctactagcaaaggcggtaaatctaatcaaatttaattggtctaatagttttagcgcacttgagccatcagaaaattctcttcgacaaaacaatagaagaataaatacaatattttgtagtatagctgaaaaaacaggggcatggagttcaaattctcttataactaaataagctaaaattattcacatgatttggcacaatgtaaccaagctgtaaatagctaactgctctgtaactaggctgtaactggtctgtaactaagttgtaagtgcttgtagctgctctataactagcctaaaagtaactaatttctctattatgagaccatttagaaatatgcaactctcctatcaatatatatattgtaacacaaggactgttatgcccattagatttgtaccaaatgttgtattctaccttttaaatttaattttagatatttcttggattgtctcattattgctacatatagaattaatattgttgtacactcaatgtgttatagataagcctagtatgacagaggtaaaatacttactcatttgcatttgtgtatatggtatacctatgcctagaagtttacttgatatacgcaatattgcaagggcaagatttaacatatttattatctataaaagttttatcaatactatagaacatagttattatcagtcctcatgatcatcgttgttgcgtcgttgttgtcgccatgatgtcttcgcggtcctggcgatcatggtcttggtcaagatcatggttgtcgtcccgacagttgctcttctgacgtccatcttgggctcatcgattcccgtcatcacgccggttccctcactcctaccttcggccgtcaatttgattgcgaaggtcacgatcatgagggttttggcacctcattctcggtgtgaaccggagaggtggccactttggggggtgatttccgcttgcactgccattgttgcctcatcctcggtaggcattgaggggggacgagatcggtacaggagcgaagaccggaaagatgatggatccgacttggaccacagtgaaagctggctaggttagacctcccaggccaggctgaatgtagaagcccttgtcggagaatcctgctcttgaattcatctcatagaaatcttttagcaccaagtcccctacctagtgtgccactgtcaatggactatatccaaagatggtatttggagagtatagtgatcgttggaagaactagggtatacatgagatcagatcaagcaaacaaggaacaaggatttatactggttcgggccctcaaaatgagttataactctactcaagtttatatgtattatggatgggaataccatatagagtacaaatgaggaatagaacaactagatgaattcgcctactaggagctattgaataaggccttggcttcctcttctggatatggctctggttttggcctgtaatttgatgcccctccaacttcttctgcaagtacaactcgaagagattaagttggatgtaggtttaaggagaccttatcttccacgactaagaatttgacaccttctactctgatcagataatttccttctttatctcccgtatttccttaattgtagggtaccatcccgtatactattagggtggtgtttggatgagaggtgactaattttagtccctgtcatatgcgctaactaggagtattaaacatagactaataataaaactaattgcataaatgagagttaattcatgaaacgattttttaagcctaattgatacataattagtacatgtttactgtagcatcatatatatatatatatatgctaatcatgg

SEQ ID NO: 43807 - DNA, 8689 bp, Oryza sativa
ttcctgcagcccttggaaatataaattgaagatgttttcgcggtccgttatccgtgtttgagtcggttataaaaattggaaatgtttccgtggttcgtcatccgtgtttgagtcggttttaattttatgttttggttttaatctatatttcttctctatctctatctctactattataaaaattgaagatgtttttgctggtattttggtacatcatccgtgtatgagtcagtttttaagttcgtttgcttttggcaatacatagccatatttgagttggtttttaatatcgttcgcttttgataatacagaaggaattatataagaaatctgttttaaaaaaactcgtatgctaacttgagatgatcggactcctaactgcaactcatgattttctaaaagtatatatccaagcgaactcacacagtgaatttcatcttaactaaatcatattataataataataagattaaaatagacttcacccgttgcaatgcacgggtattttttctttttctactaaaataagaagataaagataagcgatggtgaccggacgttttggcccagctcaaaagaaatggaaaaggatcgcatttgtggaggtaatttaggaccatcccaactgcagcggctcaacatcaatttgaacataattcggagaagatcggagttcgatttggcatcggtttgaatttttatttttccaattctaaacctatccatatacctgatacacgcactcgtgtagtcccgaggaggcgcaagatccccaccaactcgggagcaacaggggaggaagacagacacgtacgagccaaagatagatggcgccctggagcaccatagcagctcaccgtagggataattctttgttgccatgaagaacatgtggtaggccaacgccacagagaaccgcccatcactcgtcagtttccatctgatcgatctcatccgccgactcaagttttctctccgtttctccagctcctgatacaccaacagaggttgaggaaattagggagccaaaatacactctactgttgtacagacaagaattaacatacgaactaattaacaagctgctatttagagcaagtttaatagtatagccaactactcactccaattcatctatagctaatctaatagctcattcatacaatagttacatatatataatacactattaatacttggtcccacctgtcatacatacactgtgtcttggagtctgtgctatagctggctacaaatctgtagtccactgcttttctctctccttatttatcttcttaaaatatgtttgtagctggcttatagtctgctattgtacctgctcttaacagccagcgaatcagcaactagtaagaaaaatcaggtgacatgtaccaacattgtgcaataaaaaccaaccaatggaaggaaaatgtaatacttagtacttatctatttcacagtcggatattgattatcttgtgcccctgaccgactccgatccgaggggaaattaaagtggaataaaatctatataagtatttttgagctacctacccacggagagagatagagagatagaagaggatggcgatggcgcggtcggcgttggctagggtttcccgccgcctcttcggatccgtgatgtgcccacgcccactcatggggatccccccagcctcgccgcttcccggaccagcagcagcgcgcacctggcccatccctaacctccaggtgaggtgatcgattcactttaggcgcttggtctattcagatatactacttccttcgtttcacaatgtaagtcattctagcattttctatgttcatattaatgctaatgaatctagatagatttatatgtttagattcattaacatcaatatgaatgtggaaaatgctagaatgacttacattgtgaaacggagggagtatttgttaagtttggtcaatgcagtgaagacgcaacccccactgtttttcacaatccctgcaggttttcagtgaattatcaacgcttttaagttctgcctgattttcctttttttcttctttggtatcaatgatttgtgttttgcatggcgctggctttcttgagttctagtttcacggaatcattctagtttacaattgaggtttcactattgtttgtatgggttccataacattggagtaccacccaatggagagcttgatagttttgcatgtgaaaatgtccacttggtcatgggatttctctgcaattgaaagtaggttaagtgatagtactgtcttccttgtcccactattttttcccaactgccggtacaaactgtaaggatctgcgctatgcaatgtaggagtattcatcttcttacaaagaaacagtttctctttgcccatcaccctataacttgtggttagggtgcaattacaacttggatgttggaaaaattttcctatgtggtcctctgaatcaaagaaatatctatccaaaaatcctataaattttctttcgattggctcaaaacataagggttttggaggaattttaatatcaggcccaaccttcttggggaaaaaaaatcctttttgtgttatctcttctctactattataaagattgaaaatgttttttccggtattttggtacgtcatccgtattttgagtcggtttctaagtccgttcgcttgtgctaatacaaatccgcgtttgagttggattttaagcttgtttgcttttagaaatacaaaaggagtcataagaaatctcttttaaaaaacaccacatgctaacttaaggtgaaagtcatactcctaattgtaactcatgattttctaaaatatatatatatattcaagtgaattctcacactgaatttaccctagctaaatcgtataacaataataaaattaaaattgcattcacccgttgcaacgcacgggcattcttctagtctcttctgaattctatgtttttatgcactctacagttattcctacggttgtgcactctaatcttgcatttttttctctatttctatgtgtctgagaatcctcaaaagaaaaaaaaagatcctacattatgaaggaccctttgatatcgaccgaagttctcactgcggggagtgcagcaattccctgtcctctacaggggaaccaagggtatgaagtggtcagagcacaagaggctcctctccaccaaagttaatttgcaacctgacgcaaaacttatggaattggaaaggtgagtaaacgatattataaagactgcactgtttaaagagggctctcacactggattagtaactagcaagcctactacaatcagtgtgcatacccccatttgaatccagtaggctgcatttcaaattgatggaccatgtttcttgtttcatttatccaatggattctaaaacttgaaaaattgtttggcgctagctctacagtatatataaccgtgatgatcaaatatcaatagtaggatgctagggctatagtcttataattgttttcatgctatattaatatgcattctctgctaccatgtgtatgcaagcattgtgtactagttatccatttcaatcacatatacttttgtaggtcggcagtcaagaggacaacagcatggatcgataaaccgtgcaacgcacgtgtggtgattttagtgttttgcactggtgctgcagttgcttacgcttggatggcgagactcgctttttttcccgaaagagctaaacttgatggtgatggaaaagctcatccgattaagcacgcatgacgacttagtaacttaattgcttgttgtcaggcagagtcaattacgtttcatgtccgtgagaaagtgtagttggacggtcgagttctaatcgttccggcaaagagcattattttatctccttctccctcctctgtttcatattgtaagtagcccgtttcatattgtaagtagctcttaactttttctctagttaaatttttttagttcattaagtgtaacattgaatatattttgataataagttggtttgtgttgaaaatattgttacaaccaatctactccgtaattattattgataacttatctagttggacggttaattacctgatgaatcatttgtcagttgattggctttacttccccacaaaagaaaaacaagagtttattggaattacaggtagatgaggggaagaactacactttagtggaaacaaaaaggagaacaattcagagttggaaaaaaaaaacaagttctcgatatacatcaacaagagtagttttggatttacttcaaatgatggtgaccacgaacaagatataggcaagcggcaggaacaaaaacaaacaaattttatctacactgaacaagtaaatgtcagatcgtcctggttggaatccgtcagaccgtctcagacctctgagcaagtagaagtgcctcaagttcttctctccgtttctccagctcctgatacaacagaggtcgacgaaattagggaacgaaaatacactctactgttgtacaaacaagaattaacatacgaactaacagaatatttagcagcgaatcagcaactagcaagaaaaatcaggtgccatagaccaacattgtgcaataaaaaccaccatattctgaccaatggaaggaaaatgtaatacttatatcctatttcacagtaggatattgattatcttgtgagcacgcatttacttgatgtcatatgttgtgactcaaaatacaggctcagtgtcatgattactaaatgaaattaggaaccaaagtactcacctccagatccttgactgcttgttctcgtgatgttgctttctgctgcctagaacgcttcaacacaccaatgcacagcacaccctacatattcatcaaagcttttagtacacataagaaaacatgtggcatgcagtataaacagggtcaaaattggattatttgttcaatgtgcattgcaagatcatcctctactacatatcattagaggcaatatctcattttatgatgctgatgcctgtatggaaaacgtctgaaaccacatttcaagtttacaacttcataatgttattagtcatttaaacaagctcaattagctactgaactaactgtccaaacaacaatgagaacaaaattgcaaggcatcaaattattctgccccagtggggaattattttctgctgaatttaatatctaggcatctgaaactaaccatgttttaaagttcagaattttaaaggctattacatggtactagtaatatttaaacacaaatgaacacccaaaattttgtagactcaccgagattatatagatcagtccacatgcaagaagcagatagctggcaatgtcttcaagcaaaatcaaatcacccctttcaacatttgggtatgcctttgtcatgacagcaacactgcaacaaaccaaatgaaaaacattaatccaccacaggaacagaatggagtacaattcaacaaggacaataattattattgaagtttttctactattcatctgttcattacactgttcacatgcaaaaacattacagttaagatgttcacgatcccaaaatttatggtgcagttggtgcatgcaacagttgtaattcatggttcatgtactgtgagtgcaaagaggccaatatggtgaatggcagttgggtgattacggttttactctttattcatggactaaacaagttctctgcagaagaatttttaaaagagactcaaatttgtacgcaaaatactactgagttgagagtatgttaatgtactaatgttttgagacctaggtaagcatgtgtgagatatttccagcaaaacttaggtgcatcctgtgttcaataagccacaaagggattcttgctgttcatcctagaatgggaaacctctggttcacagattgatgcaaatcaacatgtgagaagtacaacacactgagaggagcacagttcataatataccttatcaccttaatacagaactgttaagaggttatcactcatcaatataatgaaacataggtgctagctgggcaggcttaaccactttatatagaaatagcaccaatatggaaagagcatatcatattgtgaatttgtgatagtccattttagagccaggttctgaaggtactctgtgctcgtcatgttatatcaaaacaacatggatgtagagtgtttgtaaaatattcaacaagtattcttgcaccctgttacaggcttacagctaacccacctgtttgaaatttaataacccagctaactaattttattgatcttcaatttctcctattacttgcaaaaaagcaacaagaatgaagcatatgcactgagtagtctgtgcaatcatatattccaataaaaatgcagaaattgagaaacagatttgggatcataatagaaggaataggaatctaaattcctccaggatacttacaagatctgtaacattccccttgcaggccagtactccaaaatctagtcacatcaaagagtataaaacatcagtaaactaacgggtcaataaaattatgaaaaaaaaaaactcgagctaactagttgaaagatactgatacccacacaagacaagtctgcaaacgttccatagtattaccaaacaaataattgtgaggattcagcagaacaagcaagatttggaggctcaaatgcaaaattattcacaggttaacagcttagcagtaaataatttggatttatccacaaaacagctcatataggaaaaaaacaagctttacataattaatctatgtgtaattaacaaacatactcatatgaaacaacaagtgcaatcgcaaaacaaaatattactgcaaagttcattgccatctgcgaagtggcactattaatgaacaaattggacactaataatcgaaggacgccatccaataaatattttttttgctgtaactcaagaatacttattgaatcggaaactgtagcacctgaaatgtaaatcgagtgaaaaatggcgtgcaaaacaagaaggaagaagcaaaaccttgcagaatttcatgatgaatccccactctgtctcgaccacccccacgaacagcgagatgaccaccgcgtagcaccggaatatgcccccgaatatctgcaacccaaccaaacagcccaaatcagctcgtagccgcgccatggccggaaaaacgaaaaggaaaggcaggggcctacgcacgtcgaggccggtgcggaaggactgcacggcggagaggacgttgacggcgacgcagagcgcggcggtggcggcggtgacgacattaaagcagcggcacacgatgaggagcgggtcggacctggaccgcgtggggcgccgccgccgcggcgtgtccccgccgccggagagctgctgctgcgcctccggcgcggcgccgccgcctcccgacgccgacgcggcccccttggccatggctagcctttagggttagggttagggttagatttccgagaagcttcgagctcgaggcctcctcctcctcctttagtggtgaggtggccttcttctcttctattctcttctcatataaagcggaggtggaagaagacgcggtgcaccgtggacccggtccacgggtgtacgtggaccaggagactcaggctcagcggtgttggtgcacccggtccagggaaagggtggggtgtgaggggagggtggcagaatgtggggccagatgcgtcccgccacgtgggcgagtgaggtggagggatgagccaatgggaggtgagctcgtggtagctgacgtcatgaatgctccatgctgttaggtatgggaagcattgataaataaatctagtactacctcagtgcagccgtggatatccgtgtctaatgtttaaccgtccgtcttatttaaaaaatttacgaaaaatttaaaaatatttagtcacacataaagtactatttatgtttatcatctaatagcaataaaaatactaataaaaattttttcaaataaaagaacagtcaaacgttgaatgtgaatagtgtaaaactgcacttattttgggacggggattagaatattccgatggatgatgattaaatttccagaacgaggattagtagtgtacatgtgttcaaatgaggacagtaggagcatgagagttgctcagatgattcagcatttcaagaagtgtgttcgatttttgttcgctttctgaataagtattactagcagttttaggttgtgttcttaagctatggttattaacctccactctattatctcccgcgcgcacgtttccttaactagtaaatagtaaatagtattctttttaaaaaagaatctataaacaggctgctaaaaattcatattaatgaggttaattaggttttgaagcctaaaaagctcaagattacataaaatggtaaaagtataatttaatcatggaaattgcaagttaggcttcaacctgaacaaggtatagttatatatggaagcaagggataacttgctaactggtattccgtgcagctcactctgctagtttatgtttttttctctttttctatcgtagcaaatgcacatccattctacctatgcaacctctgcactgcaatgcagtcagctaaggtggtgtttggaaaggagggactaaagtttagtccctctcacaaaaattttagttcctctcatagagacttatgcttttgtgagagggactaaaatttggctgcagg

SEQ ID NO: 43808 - DNA, 7561 bp, Oryza sativa
cacctaaggttgtgtttagatgtagggatgtaaagttttggcgtgtcaaatcggatatacggatatacacttgaagtattaaacgtagagtaataacaaaataaattatagaatccgcctgcaaactgcgagatgaatttattaagcctaattaatccgccattaacaaatgtttactatagcaccacattgtcagatcatggagcaattaggcttaaaagattcgtctcgcaatttacacccaatctatataattagttttttttatatttaatacttcatgcatgtgttcagatatattgtaatcttttaaaattaatttcattattacataatggtaatagatttgatcacaacgcagtgtacatgacactgctgagtacatgagcttaatgcatgaaacaacagaagttccatccttctttgacacggacatttttaccataaacttttcgcatcatttcgaacaatgcaagcaaatcaattccaagtccttactccccaggtgcaaatgcagcggcgtcaaaggtcttgcagattccggcgccactcttgaaggtcaccttctccggcgacgcctcggcggcgtacacctcgacgatgctgagccagagcatcagctccttggtcttcacgccggtgatcttcttcagcttccccttctcgacgaacgccgtcacctcaccggcgtaggacacgttctgcttgatcttcttgaagacgtgctcgatcttcttcttcctctgcaccatccagatgaacccggtctcccggttgtagccgaactcctcgatgtcctccaatggcaggagccccatggggaggccgagctctcccagaagctcgatggacttcttcctgcagatgtcatcgccgttgacgatctccgcgccggcgcggtggctctcgatctgtgaagccattggagcggtagtttcagagaaaattagaagagaagtttttggtttggaaatgtgttgtgttttgtttgtgcaaatgggttgagagattggtgtggtggaagatgagatgtagggttctgtttatatagagttcccaagtatcatgttaatttgtttgttcattgtgatgaagatctgtccaggctgcagatgttgcgagatcccccatgactgagaatctgagatttagtgtatcccatagtgtcatgatattgaagaaaccttatgctctttataataaaatcagtcattatcctagagtgttgtcgtcacgtcgtgcattaataaatataagcaagtataaacgtgtatcatcaactattaccattgtatcaatgagtatcatccaaagtgccattctgtatcatcaaaggtatcctgaagattttaatagcttgagacgaaaacttcattgattctcaaattaaaaaggaaaagtagaaaagaaaaagagataaataaacaactcccttaccaggcgtgtgtttctagaaaaaaaaagtctctctcttcccaggcgaaggttggagtgatcgctgatgatagcaaattccaaccaaaattcagcattcagagatgcttaatggagaacttaatttgcagagaaatacgaagccatgttatacttatgtcgcgttgagttgagggattcagagatgcttgggaaagttaagggccgctgtctcacggcggacaacctggcgaagagaaactggccgcatgacgccatttgcttcctatgccaacgcagaacgaagactgtcatcatttgcttgtgtcctatgattatatggcggcggtttggcgcaagctgagacgttggtgcaacattaacattgcaatccctgcggaagatggcaggccgcttgcagattggtggatcgcgacaagacggcgttttcagaacacgtatagaacggatttcgatagtctgttcatactaatttgttggcttatctggaaagagagaaatacaaggatctttcaacacatcgccaagtcggttgaccggctagcggatgacatcaacgaggaaatcgcaatttggagggcagcagggatttttttcccaggctagcgagtaatcccgattagaggcgggacttgccccattttttccttttctttccgggcttgagtttgcttgagaccggcgcgacatccttcatgtcgttgtaattaaaactttatttccccccgatcttaatgaaattggccggcctagctttggccgtcccggcaaaaaaaaaaagatgcttgggaaagttgcagaatgtctgaataaactcagggatgaaagcatagcgattctccgatgaaccaactccgtggcggtggctgcattacctctcttcttctctggatccggcgaccgtgaagcagcggcgctccggttggctgactatgacccccttgggccgttcgataaaggccgtgcggcccagatagaagaattatttacgacccgtgggcctcacgagcaggcccatcttggccaatcgcgcttcaacgccggcatgtgaatcaaaggggttcggcgtttaaaattccgacccctttcgagggatctctttccgccgtttgatcaccctgtacggtccagatgatccaacgatttcttgagattatttcagcttacttgcccatcgtggtgatcatgaaaacatttcatcattctgatgcactctgttctgctgtgttgcggttaatttgcgtctccaagagtagttctaagttgttgcatcactttgttgcttgacttgtaagtctgaatttcaagttgcctacagtaagggctgaaactgtataatatctgccactcacccagtagtataagattttactgaaacacgtcgcggtgttggggttgtgacttgtgaggattggtcgcttgctgatgcttgcgaattccaagtaaaattcagcattttatccatacatgcaacctaaagcgtactcgtcgccggtggccggctgcaaatctatctgatcaaggcgcaaagtgggttcggagtttaaatttccgaacccgctcggtatcttttgatgaacaaatgcttacgaaatatgcaggctccctatatctcgctttatatatgttcgtggcagtgattttcatatctggtagtcctatactttcccatgttccctggcgatcaggaattttgttgttgtgacgcacccagctttttggaatggatgggcttacatgaacactggtttgatcaacgttttggaatgaatgaattcttcaacatttgtatttggatgtagtcgtatctggcacaatggctcgaggacaatcagtacgtcaaagagactaatacgcaaaggttttggattagctacaggagactgaaaaacttgcagtttgctgcagagtggcatcaaagcacaaaacaaatcatcaagcgaatgtgctatatccattcagtgttttcagaatagctacaggaacaggatcaaacatctcaattcaccatatttacccatctgaaaggataaaaagaaagaacccaacagaacctgctcataaagttcagagaagatgaagacgacacagttatgagttatcgacatggctcacctggcagatgggacaacccagaaccaatagaattttcaacaagttaaatcactcctagttactggcagtgtgcactagtctatcaaagcttacaattttttaagtggcctgtcccagtgttcattaaccaagttgactagggtcttgtgcaaaacagtggttttttaaaacatgaatagatacaggaatatactcatatatgtttgcaattgaatacaaaaagatggtagatgtaagatagtggctttaagcctttttacataattaatattatgagtcttgtcatcatttcttactccagcttattatagctgacctaagttcttactccccgagggcaaaagcagcggcatcgaaggtgtcagagagcccagttcccgtcttgaaggtgaccttctccggcgaggcatcggcgaggtagacctcgacgacgctgagccagagcagcagctccttggtcttcacgccggtgatcttcttcagcttccccttctcgacgaacgccgtgacctcacgggcataagacacagtctgcttgatcttcttgaaggtgtgctcgatcttcttcttcttctgcaccagccacatgaatccagtgtcccggttgtagccgaactcctcgatgtcctccaatggcaggaggcccttagggagaccgagctctcccagcagctcaatggacctcttcctgcagatggcatctccattgacgacctcagcaccggagcggtggttctcaatttgtgatgccattggatgtgtagtttcaggcaaagaagctttgggtttggagatgtgttgtgtgcaaatggttagagagattgttggtgatggaagatgagatatggggctctgtttatatagagttcgtactgataaagatctttgcagactgcttaggcaaaggttatgaactttggattccaacttgtttatacaccagccttttctgaccatgcagttgataactgcatagaaattctgacgcacaaagtccctgaccaagtccactaccgatgtaatacatacacttcttcagcaaaggatgactctttatttattcatttatttatttttgcaaggagccagagatgacttataccaattaattagcagtgttcaggtccaattcgttgggctcatgatcagtactccctccgtccccaaaaaaaagacaaaccctggtttccgtgtccaacgtttgaccgtccgtcttatttgaaaaaattgtgaaaaaaatttaaaaagataagtcacgcataaagtattaatcattttttatcatctaacaacaacgaaaatactaattataaaaaaatttcatataagacggacagtcaaacgttggcacgggaacccacagtttgcctcttttttttttttgggacggagggagtactagtctactagacactagtgccatatcaccaatcaagtatcaacatcatttcaatgttttcagaaaagctataggagcaaaaggcagagcagagcacaaaatcaaaatcataacattatcagctttttttttttgccaggtcggcagaaagagtggccgaccaaatttcattaaaatttagggagtttattacatggttcatttcacgacagtatcagcttcaatcagcaataaaaggcaaagtgctgtgttgtcaaagcggttcgatcacaaatgacaaactaatgccacagagttccacatgggaggcaggctagtctctactctatttacaacaaattcataccttgacgagtcatccagtcaaatccatttaagagtaacacggcctaaaaccccagttccattaactgaaactgttacagcagttttttttaccgaactgttacagcattttaaggcacagaaaatgcagtcaactctctcaggtttttgtgttgacgatttcgtcaagttataattcagtttatttttacagagcaaccttgtcactactcatccgagcaagaaccaagaacaaaggattcagtatatcaattccaagtgggcttccaaagccattatttctcacttgcattacagactgaaatcaaacatctcgaccgagcacggtcagatactactctcttgtctcttcatacttcaactccccatctgaaacgacaataaaaggactaggtctgtgtcacgccccaactagctccaaacggaaaccaatgtaagacgatccaaattaacctgctaacctataccagtcccagaaaatagagctggtacaataagaagataggatatcacaacgacagggattttattattatgagtagagatgcattcattgttggaactgcgaacagactccgagttcatagctgcattacaataaggcagaagtggagactaacccaaagccacaagtatgacttgggaactaagccgaaatcgtaatagggctcgaagctgcttgctcctagaaaaactcctcatcagctagatcaactatgtcaaaagagcaccatttttttcttccttctttgcttctggggactctggaatcatcgtcatgatgtgatctttcgagggatgtcgatatctctcccgcgcctagttgcaaaagacgctgctctctgggcagagcgtctgaagagatagaagataggattgtggtttccgtttggaaggaaatcatttcttcctcccttcgaatccccccctccccccgcgtgtaatataaacttttgtaattttcctccccttactaatgaaattcaggtggggatcctccccctccccctgaactttctaaaaaaaagagcaccattctcttaaaaaaagaccatcaatacaatgttatttattcgatctactccctccgttttttaatatatgatgccgttgacttcttgatacgtttgactatttgtcttattaaaaaaagtaattatcatttattttattgtgacgatttatcatcaaatgttctttaagcatgatttaactttttttatatctgcaaaaaaaattaaataaaacaaatggtcaaacatatataagaaaaatcaacaatgtcatatattaaaaaccgaagatagtatataataaacataattaattaaactatacataaattaatcccaaatcattccatgtatttctctacactcacctcttcttctttgtcatattcaactcctcaattagaagaaatcatttttttccttttttttaccctccaaagaacgggagttgttactgttaaaaaaaaaacattttcctccctaagcctgcgaagtgccaaggctagcaaaatcaaaacttcgatttttggatgggatctagtagtgtgtagcaatggcgacacgggatcgtctcctgttcgaagtgcatttggccggcgagctgctcgtcggcgggggacgaaaccaagtgcttggcggtcggcggtggagcagcaaaggcagccggatctggagattccggcgacaacggcggcgctgtacggacggcgatgcctctacaaccatcccgtctgacagacaggtgagccctgtctgctcttcattcaggtactcaatttccaaggatctggcgatctgtagcatattcagaatgttttatcttcccagagaaaaaggtgtattgatcccaaaaggaatttcagataagtggttagtcagctgctgtccaagtgattaaccatgattttttggtttaaggaatgtagcactattcagcagtttaaggagagagcaaaccacggtagaaaaataaaaacattttctgaatgtttcttctccgttcatatcatttttgcttgtcagaagaagtagaacaagtagaagtgaaacctgattgtatcaacctatataacgtggaactcaacaagtcaattatataatgttcagatcctttttttttctttgtcaccaactcaccattgtggaagtataaggccattgcattgtctagtatgggtgtactggtcaaccaaaaattcacatgcttttgaaacttgatgagagatctatgctggtcagtcttgtatggttatac

SEQ ID NO: 43809 - DNA, 11841 bp, Oryza sativa
caattagaaacacacatgcttttgaaacttgatgagaaatctatggccctgaaccaaatctctagaattttcttacttctttggttgtcttcgctgcatggtcaatcttgtataattatacaaaagcaaattgaaagaaaaacaaaacctctaattcaataggttgacgccaaaaatttgatctaagtttcagaaaaattctacatacgtgtggaattggtttatgtaaaccacagtgcaattctagcatgtggctcagtgactgccttagtttgtgctccgcttcagattatatagttcctctccagtctcagttcttgtcaacctattgtcgagagatcttcaaaaatattagattgcataattacagatggagacatttttgtctgcaattctgagtgatcttgccactagatccttatctttcctgatcaacaagtgctcaaaaccgacatcaccaaccatggaggagaaactgcaacggctccttcttcgggtccagatcatcttggaggaggcagaggaccgacatatcgcaaaccaagccatgctgcagcaactgaacatactgaggaaggagatgtacagagggtattacatcctggacaaattcagataccatgaccgtgaagaagaaaataccaaagatcaccaagtgagtaactctttcgcaccatccaagttcaatcctgccaagcgcattcggttctgcaggacaagtggccagagtttacaacagcagctgcagcaagttcttgccagccttgaagccaccattgaagataccagtgaatttttcatgttcctgaacagttatccacgcttgaaccgtcagccatatagcacgcacttggtcttagacaagtgcttgtttaatcgccagatggagatggagcacatcatgaacttcctgcttaaagacaatacaagtagtaatcaaaatccaggtgtcttgccaatcatcggtccaagcaatgttgggaagagcacgctgattgagcatgcctgcaatgatgaaagggtgcgtaaccacttctttcaaattgtgtgtttcagtgttgatgatcttgaagatgcaaacatggtgactcttcgaaattgtggtgtaatcaagcatcaaaaccatgcaactggtggagaaaggatactaatcatagtcgaactaatcagagacatcaatgagggggcatggagaagattgtactcagcttccaaaacttgtgccgcaaatggcagtaaaattatagtcgcaagccgatctgatagtatttcaagctttggaacaacacatgctctgagagtaaaattctttactcaagaagcttattggtactttttcaaggtgcgtacatttggaagcatggatgcagcggagcacccaaagctggaatcaatagccgtggatatggccatggaattgaatgggtgcttcatgggttcaaatgtttacagtgtacttcttagagaaaatttcaatgataagttttggagcatggccctggcaagaatcagagaattcaggaagctgaatctcttactctgcggtacaagtaattttgacgatccttggcagggtgttggacctgcatacgttaggagggtaaacaaaatttgctccggaaatcatgtgattcatgaggactataaagtatgttctattcagaacatgattcattgtcacacaaactctgctcacagtgaagatgatgttcccatggtgagtttgcaaaattttctcttcggaagtgttaaaccgcaaggaaaattcaatgttctcgcatggaggtctcaccttccacctcactacaactacattttcaactgtgaggtacggaggtcacatcatttgatctccaggaagaagagatctcagaagctttccacctgaccatctcagatgctgatgcaggggagcgttgccatgttgggccaaagcaaaatgagcattgtcattacagagtgcatgcatgatagtctctgattgcaagcacatgattggttcataggaaattatctgataattgtataggaaattgtcttgcctactccctctgttcaaaacaagacaactggatttgaacatgcagagggagtatgtgtggtataactagtttgtaaataattgtataggaaattatctgatactctcttttttttttgaaaaaaatgtcacatagaattaaatgattataatacatttgtctatgccaagttaattaaatccctacaagttaatagtgatgaaatcgaaattgcaaataaggagtttatgttttacacttttgttctggttattacagtaggccatgctaagactttgttcttaaaattaacatccccattttggaagcgttctcctttcacaaaattttcacgagtgaaggtgcctctgcctcctggaattaggttggagggacttttggtttaagcaatctctcaagtctctaaaaaataaaactgatattgactaactagcctattcaatcatgtccatatttttttctggttgcatactattcctgaaaacgatagcgttcacaatttttcaatcccataaataatggatgcattttcattggtcttctagtcaaacaagttggcataaaaaacacgttaccaaactacaacacttggcattacatgattcctctcaacctccttatctatccattgagtagtatctgcaaagtcttgatggggaaaagaaaaattggtttcattcccagaatgaatactctcttgtctgcaatcctaggagagcttgcaggtagatccttctccttcttgatagacagatgctactccaaactgccattgctgtccaacgaggagaagattcagagactcgaaaggatgctgcaccggctcgctgctgccatcgaagaggccgatgggaggagaatcttgaaccatggaatgcttcgacatatcaacattctgagacaagacatgtacagagggtactacattcttgactccttcagattccctgaagcccacgaggaggagatcatgagcgaaaacaatgacaaagtgagttactctttagctctgtctaaattcaactctgccaagcgtgctcgaatccctattggtactagacggcatggagatagaggagagcttgagcaggttattgacaacctagagatcgccatggctgacatggttgagttttttctgcttttgaacaactacccttccattcatcgtcagccatacaacagttacctgttcatggacaagtgcatgtttgggcgtcaaatggagatggagcatatcatcaatttcttgttgcgtcctgaacctccaaacacgctaagtgttgataaccttggtgtcctgccgatcattggtccagccaaagttgggaagagcacacttgtcaagcatgtttgcggcgatgagagggtgtgcaaccacttctctcgcatcctttttcttactgagggcgattttagagaggaaaaatcattgcttacactaagggattcaggagagataaggcatatgcacacatcatcatcggtttcaagtggaggagaaagattgttagtcatcattgagttagctgaggatgttgctgatgataaatggacaatgatgtgcgcttctttgcgaagttgcatttcagctggaagtaaaatcataatcacaagccggttagagaagatcgcaaagcttggaacaacacaacctctacgtctgaagtttttgtcgcgagaagcttactggtacttctttaaggtgctcgcattcggaagctcagatcctaaagaacaccctgagttagcatctgtatcaatgatgatgttcaatgtctactttgatcatgaattgtacaagaatttcactggaccattcatggacctaaatatcatggccagcttgatccaagctacattttatgagggcaactggctcagcctccatgcacacaccaggagttattttctgcttaggagaggtttaggtgatgattttgagttgaagacgaagtgcgtgcctattcccaagaaaaatacagttgtgcaacagtattgtgtaatttccgactattgccgagtaggggttgctcatgaagaagatcagaaggttcccaaaattgacatgcaagatgtcttgtcagggagagttgcacctgatgggagatttgatgttgtgctatggagatctcacctgccgccatattacagctacatatatagctgtgagatccatgagtacaggcctgtattagctacctgcaagatggaactccggcaaaagaggaaaaaaattagattgaactagatggttttccatatgtataaatgataaagagtctgtcctattttatcactgaattcagctgtatgattaacactagattcatctttttatgctgtctcttgtaaacttatcctacaagctctattagttgctgtcttattgtttcctcatgtgaatctgtccttgataagcaggtctgttgaaggaacaggatcagccgcagttgtagttttgactgcaacttttaacttcagcagtcaccatgatccaatcattcaatactcaaccaagatcaagaggctatttcttttttcattcctttgattagtttgcaggttaagtaggcgatatgtatgaaaacatttatacatggggtaaggataattacttaattacctagttatgctcgtttgtgtcaaattggattttagattctagttcagagaaaaactagcctctactaatttcatgctgaaagagtgccctacttatatcaaattatatttatatgagtgggggagcccctcacctcataggctagtttttggggtggaaaagaccctttatgatcctacattaaacaacagtcaaatagtttttttatatagagtcttatatgaatgaattttcaaaattgtaattactaaataattaacttggaagttcagaatgaattgatttaagtgtggtaaataactataataaatactactccagtattcaagaaaggcgagaggagagatgggctgttgatctagagccattggttacatgttgggtggttggatgtagggactgctaaagttgcagtcacaactgcaactgcagtcgatcctggtgaacagatgctcactgctcatttccgatgcacataatctctcatattttttgagtgaacaatctctcatattcaactcttgagaaaaaaatatccacgaattgagttgttacacatttttaagtccatacatctgtttacatatgaaatgtttttatttgtgcgattgactacatcaaaagtccattattctttttcacacattgcatcccgaaattcaaataactacaactagatcatataaattaaaactaataatcatcccatgtattcttttctcttcttagcattcctcttatttcatctcctatatcttctcacataatttctcaacttctgtaacaatatgggtcacacaccttctctatgatatgattttggctcggcatccatcaatagtatatatggggctaattatcaaaggtaaatgtttcagcgataaatcaaaccatatcctaactacaggcaaataattttttttatattttcagataatgggatctatactgtccattatccaaaaaaaatgttattttctttctttccttcattctgagtttatgactaacttaccaaaggctgccgaaattaaagcttcaattttggatgtacctgtggtgatactactgtgcctccaagctccctgatttggcagtgatcgacgtcgtccgccacgaagggagaaggaagcgagcatcgccggtggtggtgcagcaaaggaagtcgacattgatacagtggtggtgccggcctgatctggagacatcagtggcaacggtggctcgggtacttccgacaattggcagcatggatggtgatgcctcctctcctcccatgtctgctcttgatccaggtacttaattttcaaggatctgtagcctattctgaatattttatttcccagagaagtatattacaaaaagaaatttcagagatgtggctagctagtcagctgccgtacaagtggttaatcataattctattgtccaggaaacgtagctattcagctgtttaaggagataacaaccatggtatgaaaacaatttatgaatttttcctctctgttcatgtcgttttctttagtctttcaggtcagacaagtagaagtcaaaacttaactctaaattaacaaagagcaaagagttgaatttggccctgcaaaaaaaagaaggcttgaattttgtattgaggccttggaggcattgtccttagcaatgatacattttattgatatggactggtccacaaaatctgctatggtgcatcgtgaagtctatggactggtcaacaaaaaatacacgtggttgtgaagtctatggtgctaaacaaaatctgtagaattccctttactgctttcattgtctctgctatgtggtcagacttgttatgctaaagcagactgcagagaaaaatatagaaacttgaattttaaggagatgtggagtttctggagtatgtggctgccctaattctcactctgttttatcatatcctctaaaagttctgtgattacatagtttctctctggtctcagtccttgtcgacctgttgagtgatttacaaaatttcagattacatagttacatatggagacatttttgtctgcagttttgagtgatcttgccactagatctatatctttcctgatcaacaagtgcatgaaacagacagagtcagccatggaggagagactacggtggctgctgctccgggttcggatcatcgtggaggaggcagatgaacggatcatcacaaaccaagtcatgctgcaacaactgaacatactaaggaaggagatgtacagagggtatttcaccctcgacatattcagatgccatggatacaaaggtgacaatactaaagatcaccaggtgagtaactctttcgcactatccaagttcaatcctgccaagcgtgttcggctgagcagggtcagtggccacagtgtacaaaagcagttgcagcaagttcttggcagccttgaagttgccattgaagatacaagtgaatttgtcatgttcttgaacaattgtccacgtctatgccgccagccatatagcatgcacttgcttttagacaattgcttgttcagtcgccaattggagagggagcacatcatgaacttcctgctcaaagagaatactcccggagctgaaaatctaggcatcctgccgatcatcggtccagagaacgttgggaagagcaccctgattgagcatgcctgtgatgatgaaagggtgcgtaaccacttctctcaaattgtgtgtttcaatgacaatgatcttgaagatgcaaacatggtgactcttagaaatcgtggtgaaatcaagcatcaaaaccatgccactgatggagaaaggatactaataattattgaactaatcagagacatcgatgagggcgcgtggagaagattgtactcagcttacaaaaattgtgttgcaaacggcagtaaaattatagtcgcgagccgatctgataagatagcgaactttggaacgacaaaggctcttagagtgaccttacttactcaagaagcttattggtactttttcaagttgcgcacatttggaagcacagatgcagcggagcacccaaagatggcatccatagcaatggatatagccattgaattgaatgggtgcttcatgggttcaagtatctacactctacttttgagagcaaatttcaacgctcagtattggagcatggctcttgcaataatcagaaaattcagaaagctgaatctcttactctatggtgcatgtttttttgatggtccttggcagagggttgaaccggcatatgttaggagggtaaacaaaatttgtcctgagtatcttgtgcttcttgatgactataaaatatgttctggtcaaaacaacatagttcattgtcacacaaactgtgctgacaatgaagatgaagttcccaatggttagtttgcacgattttctcttcggaagggtacctcgaggtaaatttaaggttctagcttttagatcccaccttccacctcacaacaactatatgctccattgtaaggtacagaggtcatatcatatggtcaccagaaacaagagatctatgaagtttttacatgaccatcttaggagctgatgtataatgtaattatgtcgaactgtaatctgaatctgagcatttgttgaaatgctttcacctactgtctgagcggctgcgccatttgtagtccaagctcatgtgtatgtgctattttaagaggttgttgaactcaagtcgtcagaatctattaacattctgtatttgaagtttgatcatgtcaccatgcgtgaggcacaaagacacttgtccagaagtcaatgataattgacagcaactaatatattgatcctgtgtttactgtttctgaacattcattgcttgttgcagcttgcaacatacggaaagcatcctaatacaaacactccatggcattatgatcacactaattacaccagcttcagttagaggttcagtactagcatcagcactaactctcaacaaaaaaaaagaaagaaaagaagatatttctgactagcttcttcaaccctgtccagagggaaaagtgtactgatcccagagagaggaatttcagagaagtgattaaccataattctactgtttaaggataacatttgctgatctcgttttctccgttcatgccattttctctactgttccagacagacaagtagaagccaagacttaaatctaaataaaagaaatagcaataaacttgaaatttgtcctggcaggaaaagaaaaagagaaacaagactggatttgtgtattggggcctttttggcatcatcctgaggaatggatacgttggattgattattagcaataacagcggtagtgacaagaagttcagatcctttctttttctgtcaataacagtggtagaagtagatggtactgactgatgaactgaatctgtacaattctttttgttgctttcattgtctgcgccatgtggtcagtcttgtacagtcatgttaacgctaactgtagagaaaaacagacacttgaattcaaaacagttcactctgaaaaatatattccaagtacgcatggaacactgtttgtgtaaaccacagcacaatgcattttcctggagctacttgagtatgtggttgcctaatttctactctgcttcaccagatcctctaaattttcagtctacatagcttctgtcaggtcccagctcttgttgatccgttgagttatgtacaaaacttcagattacacactttacatatggagacatttttaactgtgtttctgagtgattttgccagtaaatccatatctttcctgatcaacaagtgctcaaagccgacagcatcaaacatggaggagagactgcaacggctgctgctgaggatccggattatcatggaggaggcaaaggaccggctaatcacaaaccaaggcatgctgctgcaactgaacatactgaggaaggagatgtacagagggtattactttttttttttgaaaatagagggaacaaagtacaacccctaggggtaaaaaaaggagaaactgtacaaaactgagaaggcctatacacaatttgatagaaaatcccgtagcctccttgctcccgccatggtccaagttcttgcctcctcttttatttttgccataagactaggggccgcagtttccttgtgttcgaaaacccgccgatttctttccttctagatctcccaaactattaaaagaattagggtccgaaggccttttttgggcacctcctttgtattggctagcatttcccaccaattttggacactctggcatggagcccagtggcacgagtccagttgctggtaagccacccaggcggcagtcaggctccagatccttctagtatatctacaatggacaagaaggtggcttgctgactcacttgtcacgcgacagagggggcacgtcccgttgtttggccatcctctagctgctagccggtctgaagtccacaccctgttttggatcacaagccacgcgtagaatttacattttggtggggcccaggctctccaaattaaggcgttgaagttggtgccagtggttcccaggcattgcgctttgtatgtcgacgaggctgagtattctccatggtttgaaagcttccaggtgatttgatcgggctcgctttgattgagaataatgtactgggttgcttcccatagggagacgagctggctaatcaggtccacagtgggaggaatggtgccgctgaggtccaggtcatcgatccaagagccgttctcaatgccttccctcagtgtttttcctcttttttggatatcgcataggctagtggcatggcgtcttttggtctctgtccctccaaccaggcagagtcccaaaatcgaattgtgttgccatccccgatcgttattttagtggccgtagcaaaaagccttttatcagtttcatcacacggtgtttcgaggcctacccatggcttagtgggatcttttcattcatgccagagccatctcagatgaagggcccttctgaacttttccaagtttagaactccgagccccccttgcgcggttgggaggcatgtcctctcccaattgatcttatgtctcccgtcccttgccaaaggagccttcttctcttcgcatcgagttggcctagagcttctttggttaccttgagtgcagtgagaaggtagatgggttgcgctgtcagcaccgatttaaccaaggttgaccgtcctgctggtcccatgtttttccccctccatccagccgttcgctttgcaatcttgtcaaaaagtggttgaatatccgccttcctcatcctccctaggactagcggcagacctaggtattttatcgggaagtgtgctcgcacagctggtacaccgtcaagaatggtgtcgaggtctatgttttgacatctgattactgccacctgagatttctgcatatttgtgaccagcccagccgcatgcctgaagcgtgtaagtatgtcagtgaaggtctggacatccttcctgacaggattgatgaagaccactgcattgtcggcgtacatggagattcttaggcgggctgctcttccccgtagctttgtgatggcattaagctccgttgcttttgaaagcagccattgtaggggatcaatcgccaggataaagaggagcggtgatagcgggtcgccttgccttagacctctgccatgctatattttgccccccgggattccattgaggagcacttgtgaggtggaggtggaaagaatagatgagacccagtctctccatttctgtgggaagccataatgctgaagcatagctagcaagtagtcccatcgcactgagtcgaactctttgggtatgtcgagcagagggtattacacccttgacagattcagataccatgcccatgaacaagacaatagcaaagataacaaggtgagtaactctttctcaaaatccaagttcaatcctgccaagcgtgttcggttcttctgggtcagtggccatagtttacaagagcagttgcagaaaattgatctaagagatagatttggggatttcaacagtaacattgatctagtcctaaagggcaaatataaatgtatacaagaggtgcgaaaaatactaaactacccctaatatcttaacagttggcagtatagaagtcacccttgaagatgtgagtgtgtttgtcatgttgttg

SEQ ID NO: 43810 - DNA, 13419 bp, Oryza sativa
  unsure (1)..(13419): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagtacgagagctcatcgtggctcaagaaagctctagggtttgtcagcttcaagataggacaatgttgctataagccagtgtttcatttcatgctctactgcgtgcggtgcatgatgcgatggccaaccatttgctgcccatgctatgtggtgtgctctccgctctgcaactgggtgttcaaattgcagcctagttggcagttgctcccaggcccttgttgggtgatatactccgccctctacaagttgtttggcctgcagtacattcaacaggtgctgacagacatgttgggcattagcactgcaagctccattcagctgcccattgaggtgaagagtaccgtgattgatgccctcgttgggatcctcatgcccaggcccaaccatgacagtgtcgtgttgtccagtggatcaacatcgctagccaagaatggcttgcaggacaagttcataaggcagtacgcttcgacaagttaccatggcggtagcgctagtaccattatccccgaatcaaagggcaatcaagccagcatcatcttgacctggcacgctgcgacaggttgctacgacaaagactatgagcaaaggaagaagatgaaggctactacagaatcgccgctacagcacaggcagtatcgtgttgtggccaccgctctatccaagtactgcatgtacttggtagcttatgtgcctcagctgctgcccgggcagcagtcctacacaacatctgtctacaacgattttgtgcgctcgccgtcctacatcttgcagagtggtacccagctgaaagatgagctctgcgaggcggtggtggaagatgaactgaggtggaaggtgctagctgatttctgggtcgagatgttgctctacctcgcgccttctgacaatgtcacggctcacatcgagcaactcgcacaaggtggagagttcatcacccatctctgggctctcctcttccacgccggcatcctgtaccggccgtacaaggaggaggaggagccagctgcagccgggacagtgtgacgaataaccacttaattattaattatcttgtgtttagcagtttgtttccatactttttatgtttgtagatgcatgcaagatgctgatttgcctgcgggaatcccaaaaatattgcaaaaaggaaacggataattaagcaagtttgtagtctcttctgtccactctagcactagcactgaacactgatgagatgtagggatgaatcgtgctgcgtgtcgcccgcggagagggggtggcggacgctccgcgcgggagaccgacttttccgttttttttttctttttctgtgttttccgtttctgttcggttggctgttttttttttctgttcaaattggttttccctttttttttctcttctgtttttttcggttttttagatgtatgaatacaaattttgtattcgtacatatacaaagtttgtatacatgatgcaatttcttgttttttttatttttttaatacgtatatatataaagtttgtatatatcgtacacaaagttcgtatacatcgtatacaaagtttgtatatgtcctaaataaactttgtatacatcgcatataaactttgtatatatgtatatatttttatgcattaaaaaatatttataaatatatatacacacgtgtatatatatatatatatatatatatatatatatatatatatatatatatgtatgtatgtatgtatgtatgtatacgtatgcatatgtagtatatgcataagtatagtagatacagagaagagactagagggggggggcgaactgaccgtgcgcgtgccggggcgcgcggctgattgcgtatcagcgccacccatatatgtctactccaatccatcaaaaatctcacggatggtcgcctggtcggttttctcccacgatgatcagtttgttggagcacacacacacgccactgaaataattgcatgccaaagcagagtaacatcagagaagctcccggtttcagtttgcccctcctccacagccacatcatgggccttttactgttacaagcccatatgtatgtattgattgtttgcaaactcggcccaactagacgggccgcacattcctcaaattgccgttccggcccaactagaccgtgctgttggacaacatatggcaccggcaacaaagcgtttccgggagttttgaattatactagaaaaattacccgtgtattgctatggaaagctaaaattataataaacaattgagtagagttcaattttcatgatccaagtgctttaagaaaatatttttcatgttgcgtgcgaacacaatctcgtgtcaatgtctagacaccaggtttttttttcaaaacaatctatttcacattacaacgggtaaattattttatttgtacaagaccgtggcacaaaaaaattgaatacggacgtactgttacatacagacatgaccttagtggtgcgcaatcatttctcgcaaattgtgttcttcactcgagctgatcttgaagatgaaagcattgtggatattagagatggcggtgtaatcaaacatcgaaacggtacctcggatataggaaggttgttggttattgttgaactagatattcagaaggactagataagaatattggtaagggtttattgcaaagattattatacttaacttacaaagctcgcattcctcgcaacagtaaaatcataatcacaagccgatcagacaagattgcgaggttaggaaccacaccacctctcagattacagctccttccaaaagaagcttactggtacttcttcaaggtgtgcacatttgggagcatggatgcttcagagcatcctgaaattgcatccgtagccatggagctagcaatggagtctgaaaggagcttcatggttgccaatgtctttggtagattactgaggtcgaataccaacacgctttactggagattggttcttgcatccctaagagagttcaagaagaagattcgagttgttctgttaggaggtgctgatcagcctcaaggaagatttgatgcacttggatggaaatcccagatagcacctaactatagctacacgtatagctgtgagatacagaggccaatgtgtattgttagtagataaaccttgtgtgtttgcattttaaatttctgttatgcatgcgcgcgagctccggtttgtggaagccgtgcgaatagctgtcatgccgcgagaatagctcggcgtggcgctagcaacggggagtgcgcgcgtactgcggatccgtggggatggacacgatcaatccgcgacgtgggaacgtttctgaagcccatgtttctttctgttgcatacctatcccctgtattgctctgttcttcattttcggatcagctacagtgcgtttgcaaagtgttcgtccaggtgttcgcgtgtgttccactcgccgattcgttgggattttcctgacatgtatggtcgccaggaagaagaaaatgcagaggaatggcggctgaatggctgaccatcttaggaatttatctgatgcactctagtattgttacatgtaggaattgtgtctttatatgtaacctctaatatgtaaaactttttccgataaccaaagaaaatactccaggcctctacatcccaagtatacatagttgttctcttgtggtggagcctattcatccgagttaaggaattaggtatggtgctcacgtttaaggctattttttttaaagtagtaagtaaagtacccattgacagcaatgcgtctgtgataactttatcaattgtaatatatgttggcccaatatctgaaggtgcttatattgatatggtttgcgtgtgtacatgcatttgtaagcatcggcatttgaactgtactttttattaaaaaaaaaagtataacatatatagctagagctaatattcattttgcatcacattcaaagtgagttttttattatgaatggttattataattgttattttctggaaaaataatattatggttgttttaatgtattctagtactttctcttgatgataaaagaaacttgacataaaatgagtgtcaaagagaaaaaggcacaaacggactacttcctgcatcttaaaataaatcaatctaacataaaatgggagtttacttagtacatgaatatagacagatgtctatctgcattcattattatataggtatttccattctattttaggctcgcttattttgggattgggacggaaggagtagtagagaaagatgggaagcacactgtattgaagtgctagaagatatgattgaggtgagatcttgtagtggtaaaaagtaaattgcagtattggaagaatacacataaagtttagagtcaaaatgttgaacttttaaaaatctatagcgtttcaattctggaactgagaatatttatcttgtttttttctgaatgaaaccagcacaagattgtgcttattcattaaatatagcaggagaaaaatacagcccctaaggaaaaaaggaaagcaagaaccgggaaaagctgtacactattcaaagcgcggaatagttgaggtttgaggttgcggcctccttgtgctcatatatccaccagtttcgctccatccaaatttcccaaacaatgagaatatttatcttgtgaattacacatagcaagaaacaaatgtatttgtttaaaagaatcaagaaacaaacgtacaaaagatattttcagtaataaaattttttaaaaataaaacatgtaggtatgatgtgaccactggcatgactagtctattttggtcaaaaagcttgcaagagaaacatataaagtcaattgaccgacctacattgttgtttctagaaagcgcaacaaaaaactgcacatgaaaatcaaaattacccatccagtagttgactgattcctatacatggaaatcaactttccatataactaactgcattccaagtcattcttccaaatctggctacattaagacggctaattatttcatttaatttgtggcagtcatctgcgcaggggtatacaagactattacactacagcttcgttattcttggattaagataaaaattttaactcggtttgagttagtgcttccgaaattactaaacaatctagacattgcttgataatattagataaatttattttcaaatttaaatttattaatacttaattaattatgtgctaatagttttttttcattttatgtctggagtttgaacgggacaaattaggggcgtgttcggtaatcattcctttacgctgcagtgcttgtgttgtgcggctgcagctgcagaaaataccagccgaataggtcctaagacaccaaaatccagccctgcctaattggattgggcttatcaacacgccaggccttacacggcccattacattgtttggaatgcgtgaactctacttttttttaaaaaaaagaaagaaaaatgatgacaaacaattaattcacttctagcaggagcgtacattttttttaaaaataaacacaatgcaaacatagatgcttaagtgcatctccattctaagcatgatgatcgtacttctgaaaatggtaaaggaaaaatacaatcatccatggtcgtcgtggttttggcattcaccatggacaagagcaccctaaaatattaaatgtgagaggaaacgctattaataatattgttgtgtggtggaattatatatgttgtccataagtgcatttttagttggtactggtagaaagtagaagcggggccagacatgggtcaacttaggcttgagcctcaggcttgactcgaaaaactccatataaatcctttagaaattatatagacatttcaaaaatatataatctctaactaaagttgtcatatttagtcttacaaatattttttgggctccacaaagaccataagtaatactccatatttttatttttttacaaaagagacttatagtgaagaaaatagaaaagtaattaatgggccattcaatctttatcatccatccaaacatctaatccaatacctaaaaacccatcagatctttcaccaaaagatacccaacgcccatctaatccaaccgcacgtacgagagcactaattaacaagttttttttagcatgatcaataattggggtcatcacaacacaatgcacctagccatcaatacatgatggaacatctaaaggtaacacactccaattagacaaatcacattagccccatatcatggaattaattaaaaggcatggcactttgtttttactagtactaaactagaagctactactaccaaaaatgggaggtatgttggtgccaggtggaagacaggtgggcccccaccaacccctgcaaagggcaagcagacatgatgggcctcgaaagcgtagctccatgccagtttgtgggccaggcctcttcttcttcttcttcttcttcttcttcttctccattcgccggcaaaaagaagagaaggcgacttgcaatttcagctccaatccgaaatggagatggccaatcaagaaggttgtggtgggcccagcatgtggcccaaaaggcctaccaagattaagaaaagaagttgtaaaagaaaggaaggaaaaatgaaagagaaagagcttgttcactttgatgaaaaaaaaccttaccgaattttggtattaacttcctttcaaaaaaaaattttggtattaacaaaaaaaccttaccaacttgctaaaattttgacatgatttcttatatagttaccaaaatttggcagcaaactaaatgtagccacttttttggcaactttatcaaaatttggtaaggttgaaaatgacatcaaaatgaaaaggcccgaaatttactcaacagcaaggctaataaagaaaagaagagatttggtttctagagagagaaagagaaagatgtctccatgatctttgctctagatttctgtgtaatatgatctctcttttttaaaagggcaagggtgttggaaaatactagtgattcttttatttcctttttcttgcacttatcaagcagcctgccacgctgacctgagaactaccggaaaacaagtgttgtcaaaattgattgcttcctgcactaaatccatagagactttttaaggtccaacagtactttacggtactaaatcttggtcgttggatctggtccgatccaacggctggtagtgtttggtaccgcgaggtaccaaatatgtccctattgcggtacctctcgcgtagaagagaggtggaagagcaaaaatgtaactttgtgtgcgatagatgggaggaatagacgggcggaaccaattttgtcacattttacatcctcttctgcgttgccgtcgcgtttctcttccccccgccgccgatgtgttcctcttccgccccaccgccgccgtgttcttcttccgctgccgccatgttcctcctccggcgccgcgacttcgatctgggcccttgcgccgaagcgagatcgattgcggcgtgcagggttgtcccctctcttctctgggattcgtggtcctccgccagtcactgcctggattgatgccatcaacgccgccgccgctaccgccgcctagacgccaactccgccgctgccgggatcgaccgccgccgcctcctcctggacgtcaactcggccgccgctgggaacaacgacttggacgccaccaccgccgggaacgacaacttgaacgccgcatccacccttgctcatcttttttctcccgctcctacccatcccagattcaacggttagatatcgatgtgttttggtaccgagcagtaccagtaccgaccggtacaacctgctggactgtaaagacgctcaaatctataacttaaacatcgcgatcagagtctacttagtgagtggacaaacctgttgtcgcagacatatggccacatatataggtggcctttttatttttctctctttttctctattaccttaaaagagggagttttatatgtatccgctacctttccctatccacacgacgcacaacaataatattagattatattagattgtatgggacatgttttgttgtttcatagcaattcataggtagactaattaaatgaaaattaatatttattttttatatggcgcctgccacctggtgagggggagaaggcatgtgttgctttctttttttttttggttttgtctgaactgatgagactataatactcttcatttctatcactggaaatggggagcaatgctctcctagtttaaaaaatatatttttttaagataatggaaatgagttacatatctaacctctgtaagatagggacataaccatagtattcagttttctaataacttgtatagaaagtatttacatgaaaattgctgcgcaactataactatgcagactatatatgcatgcacttccggaaaaaagaacaaatatatgattgatacccatgtatacataatgcatatggtgaaaccgtgaggagtcaaagtactgtcaaacatcagtttctcaaattcctctgaaactgttgagccatctgaatacagaaagagggagagagaaaggacacacagtactaccactgataagggaaaacaaaacagtagattaacgaataagcactgctgatgcaacttctgcaatcatcatgtccagggagctaaaacgaccttactacccttgccactattggccgccatatatcaatcaatccttttctctcttttgtggaagaagaagaagaagattaagatgctggtgttgagtcgtgtggcttttgctactgatcagattgttcagttcggaattcagataagaaactcatctcaggatcagacaaacaatgggtgggtgccagttcagaaagagagaatatatacggcagcaagtcagcaaccatatgcagaaaagagcagcatgctaatgtctttacaggatgcgcataaaatcactctttttcagttcttttctagcctagtaaagattttatgccttggggacagatgagattattattgagatcagaacatcatgctaaggatctcatcttcttctttgagcatccgaaatataagtctaaataagctagattccatattttaggactagcacaaagcttagactatatattcctaggatttcacttctccatgccaagtaaaaagcacataatatatacctcaataatacatctaaaaaaaatatacctatccaacatagtaggatttttctgggcattttacaattctcccatatcagtccagatgttaaccattttttctcttgaattccttcatttcaagctacatgtgcatatataggggaattaatctccctgagttaattttgaagatagtattttgtagtaaaataaatattaagtaataagatatgactatgttcatggcatgatgcagagtttgagatatttttactccattatttatttttgaatgaaccgatatcggcatgtctatttcattaaatatagtaggaaaagaaaaagacatttacaggtgtaaatagaaaaaacatggttacactgtaatatttgccaaaggactaagatatatagaaaggtgactttaccattctttaaaaaagtatcaagatgtatcatattttctagcgtaaaatttagtgcttttggatactaggtaactcgaggttgtaaaatttaggtttctcaataaagaaccgtaaaatttatcaagatagaaactagtcgctttgcgccagccatgcatctttttactccattatttaggatgtcaattattaatagctaagggaatttcactacttgtgtgatgcattcgatctctccattaacaagatggatgtggacctttgatgcctatgcaaacaccatgattgagtgtgtccatcaagtagctagtcggttagctaggtcaatatcttcaagttaaacacgtacaaatcgatctatctagcttcatctctttctttctcttccacagtgtcaaagacaatgtgtcggcatggcagacagctaccgtccgacttgaaagccatatatattactaattgctttcttcttacttaattattctatcctaattaaagtaaagatcgagataataaacagattaaaactattgtcgagatggattatattccctccttgggtaatactattaacatgaaagagaaagagataattaacgatggagatatatatacatacggatacacttgagcatcaacaatataatgcaagttcatgggcaactactacatatatagctgactaataagagcaagttcaatactatagccaactactagctccaattcatctatagccaatctaatagctcattcatacaatagttatatactacactattaatacctagtcccacatgtcatagacacactgcgtcttggagtccgtgctacagctggctataaatctgtagcccgctgctcttttctctcctgatttatcttcttaaaatatgtttgcagctggcttatagcctgctattgtacctgctctaatagtttaaattatttggttttggaggagtgtgtgtttagctttcgttttcccgggacttttgctgcaacagattgcaagggcccccatgcttgaggctgacacgacggctgcaattggccaaattcgagtgtctctctcatggcgcacgcttattagctttgcattgttgcccactaattaattaatctgatccattacatgagtaaaaccaaattacaacttgtgttcaatttatccaagtcgatcgatcattgattaattaacggcttgttcgatcttcatcgatccattttaaatccgctagttgctaattattaataagtttcatatgcttaatatacttttacttagtgcgtgctttttgtttatttgtcttatatatacggagagagttcaagtcgttttcctcattgaagctattttgtatcaacttaaagttttttgtacattctaaatacaaagacatggaatgtaactgatcatcttttaatttaattcttacctaaaagtatctcaatcatcgtaggatacacacaacccccatttgatggaggcactcaacctaattaaaaacaaatcaagatgtatatatatactagaaactaatccatcaatctaccccccatcaagccctaattaacttgtcacttaattgccgttaccgatcaatcaatcatacaaataaatccatcgtccatgcattgcaatgtattgcatccatatatctcgattgcgagtggctagctcgacgataaagttaattaactggtcgacgccatggcatggcccagcaggtctctcgatcaagatgttgaaatggaagttgaagggcaccatgaacacaataaataaaaatccccaatttgagatgctgaaagagacttcataattagcggtaactatgatagcggcacactatgtccatcgccgtagtttgtttttgacttttcagtgccctattcattaccgtcactatatactagtacgatttaatgatattcccggtgataagaataataaataaattgcatatgattgttaatatatactccctctgtcccataaaaaaaccaacctaatactggatgtgacatattttaatactacgaatctagacatacctctgtccaaattcgttgaactataatatgtcgcattcagtcctagatttttttttggacagagggagtatatgtcaattaacttatatgggaagctcgttgttttcatggatttccaccaaccaaactatttggtgagaaaatgatcattcctaacctcttaacataaatgtgtaagggttcgttttccttccttcctaccttcacctctagtggagatgacgtaatgccaaacatcggtgccttagggttcaaaatgaagagcaagagttagggatcatacataggtgcagattgatatatagtgagattgtatgataatggcactattgaagctatcgacgaggaagctaatagttggtaggctctacaagatctataagaatgagtggttttgaagcgacacctaatggtgccaacagctagacattgctaaataagatgacgaaagggagctagtaaatggaagatgcatgtttgtccgcaatgagagggccaacaccaatagtaattttgtcgaaaatgttcgagtggtttctaggagaggatatatataggtggtcgtggctagaagtaggagagggaatggctagaattgtatagggatggagtggcgggcttgaaccattcgataacacaaattcaatgccccaaaatttaatatagttctttgagaaaatcaaatagctgtaacataaaatccgatatatatatatattttttggtgcacgattaattgatcagttgtcgcagttttggcactattggaaactccaagtagaatggcatagctcacctccttattaaatgcatattactgtgcacaaacatgtggtttaattgtgcaaatcataacacacaccacctgcaacatgctgatggtcaagattctatttcatgtctcagatgattgtgcagttgcacaagtacaacacacctgttgctctgatggccctactaaaactcttgacactgttttgctacatgcatgtaaaacaaacagctgcaagattttaaaattagcttggaacattccatttccactagaacttcgtttacacaaaaggaggaaaaaaaacagaggaacatttcactaaagcatgcaaagacaaccaagatcacaccattaacacaaataattaagccaaactatatttataaaagtccattggtatattccactgatgtaagtatgaacacatcattaattacaccctcacaaaaaaacagcgaaattacacaaggctcccctcgacaaccctgtgccgtcggatgcgtgatctacggtagaattagcatcaaagctaaaactcccttgggttctacgaaaaattggaggtccccgggggcgccttgttccaggcgccaaccgcgcccgtcccgtagccgtcggccagccgcttgatccaccagagtcgttggccccaaggcccggccagtgccgcaacgccggcgccgaaccggctcgcacgcgccccaccttcgtgggnnaaatgacggcgcccccccgcgccgcgccacgtttgtggccgtgcccgaacagcgcccgcgccatgcgcgccgccggggggccgccgccgccgatgccgtagacgaagtggaagccgaacggctcgaacaggttcgggatggacgggatgcccattcacggcgc

SEQ ID NO: 43811 - DNA, 2042 bp, Oryza sativa
cccatctcccggaaccactcctccatcctctccaccagcctcctcccgatccctcgccgccggtggcgcggcgagacccggaggccgagcaggtacgccaccttggagaagagctggctgcgcccgcacgccacggtcttgacgcagccgcgcacgacgccgacgatctccgtgccgagcgggccacccacagcctccgcgacctgaaaaccacattccaatacccgatccagcaccagtgtgaggtctcgcgatcaacaatggcggacaagcaacgccccccgacgagacgtacgagcatgaggtaggccggcgagtggcggacgcggcagagcgggtcgccgaggaggtcggtgaagaggcagagcttgccgccgctcggacccacctcgcaggcgcgctcaaccagttcgacgccgggacggtcgcggccgccgtcgaactcccgcaccaggaccacctcgccgccgtcctccggcaaacaagccaccgccatccttgctccgatcaatcaatcaatcaaatccccttcttcttcttgatcgatcgagcggtgcgttgcaatttatagcggcgatggagtggcgggagaggagaaggcgcgcgcgatcgatggagatggaggtagtggcgcgagtggaggagtgggggagtgataggatgggggccacgtccccactttcccgccatctgtacacctctctctctgtgtgctccgggtggggcccacaccccaagttaaactgccccttctgctgctccatgctaaaactggatcgacttgctaattatttgtgtgatttaacaatgattagtgttgttggagtactatcatttttggctcatcagattggaggagtaagagagagctagataatgtaagattcgatagatctttgtttgctgctgtccgatcttgtcatgattattagggtaattaattagttgtttggaaattatctcttttctattatcatactcggggggatttaggagaagttattttctttttctatcttaattatattgaatgacctcctctaatcattctcacataagttatctttttttctagaaatataggagtatatgacatgttgaaattttgtagccagtattttggataatctttttccttaaaaatgaaaatgtttcacatcttccaatagacacatgttctaaaagcccaataaaaagaacttttcaattagagccagaaaacctttcaaaacaataggaatacaaaagaaaaatgtatatatcacaataataagagactctcggttatcctctatgtcgtaatactatatatccaactaaatataaactcaccacatgagtacaaaattaaaaccgacggctaatgaagtcagtcaaacacaacagtgcatacaatgactaaattatttggttggttagtctcattctctataatcggctgttatatctaaacgtagtcttgtcgctcgtggagaaagaaaacacatcgctacttttaatattgtcgttgccaatcaaataggaaaatataataattaagacgaatgctttaaaaagcaacaagacgttgcagcggcgatcggtagctaacgcaaaacaaacatttggtctgagttatcttttttggaataataattaaaaaatggttcaaatatttggcctatgctaaataattacccatgttgtaaatgtcaaatagaaaactcttaaggttatgggagttaggaactatctttgacacaatattagaaacatttcaaaataaagaaaaagagagtatcataataattagaaactctcgatgatccaaattatccgactgaatataacctcaccacatagaagcaaaattacacagctatatgcatcacatgatgtagaggctgagatttttatttgactatcttaaatatattgagtacaaaattgcaactatatatggactaacgaagctagtccaacataacaatatatataggtactacatcgtcatttggtcggttaatattctaatcaagcaggtctcactccctataattcta

SEQ ID NO: 43812 - DNA, 25833 bp, Oryza sativa
  unsure (1)..(25833): unsure at all n locations
catcgccatcgacgccctcgagctcgcccgcgcggcgacgccctccccttctccaacgacgctgcccccgccgacgccgacgtcctcctctttctcccgcctctcgggcctcttcgaccccgagacggtgggggaggggagagggcgagaaccgcggcgacggcctcccgcgcctaccctcccccgccgccgccgccacccagctccttccccggtggctgccgcacgcgccaagctccaccccaccggccgtgcactgctccacccccgacagccgcgccctgctccgtccccgacggccgcgctcagatccttccccggcggcactggcggcgtgggaggacggccgcgagaggccgtgcggcaccggcgtggcctccgctcctttcccgccgccctgagagaagagagtgagagagacgagaagagggggaaagagagggtaggctgacatggcacgatgacatgtggggctcacgtggatcccacgccgactcagcagccacgtaggacaaaaccgggatcaaaaccgccgagagacctattgtgaccggttttgtatagttaagggacccgtggtatctggttttgcggttcgaggacgttttcgtatcccgataacaagttgagggacatctggtgtactttttccaagatatttttcttcactattttcagaagtactaacacactacgtttggaatgcaggtaaattccctaagctcctcctaaaagtgaacttttttttactataataataacattataagtacaaaggcggtgctggaccttgcagtcgaacaagcccttgctccccggataatattgattctcacatattatgagaatatatagttttaaaatgagaaatatattaaaagccaaaaactggaaacaatatatgagagattagaggctaggattatatatctcgtttagttgtaaaaaaaaaaggttctactacctattactattaggggttacaatatgaatacatagtgcctacatgtgacaataacagggtgcataaaactcataatatgatcagccaccattcttcttcattttgttcttcctagcggccaaacactttggcctctgtatctcacaactatacatgtagctatagtaaggtgctatctgtgatttccatccaagtgcatcaaatcttccttgaggcctaacacttccaaacagagcatctaccagtgatatcttgggagcttcagcttcagcttcacagtgggaagatgcatgtgagcagattgtttgatagttatcaagaatcacaagaagttcagttgcttcttcacttggttcattcacccgatccaaagctttaatttgatctgcagcatacatgaatgaccaaatatgctggttcttcttcttgaactctctcagggttgcaagaaccaagctccagtaatgactgttggcatttgatctcagcaatctactgaagacattggcacccatgaaacacccttcagtttctattgcaatgtccatggctattgatgccatttcagggtgctctgaagcatccatgctcccaaatgttctcaccttgaagaagtaccagtaggcttccttggataaaagctgtaatctgagaggtggtgtggttcctaacctcgcaatcttgtctgatcggcttgtgactatgattttactatcgcgaggaatgcgagttttgtatatcgagtatagtctttccaataaaaccccatcgatatttttatctagtccttctgaatacctatccccatctagttcaacaatgaccaacacccttcctacacccgaggcacggtttcgatgtttgattacaccgccatctctaagatccacaatgctttcatcttcaagatcggctcgagtgaagaacacaatttgcgagaaatgattgcgcaccctttcatcgttgcaggcatgctcgacaagagtactcttcccaactctccctggaccaataatcggtagaactcctggttctagtgtgctatgattcccaggttgtaggagaaaattgatgagatattccatctccgtctggcgcccaaacatgcactggtccaagatcaagtacatgctatacggctgacgatgaaggcgagggcaactgcttaagaatgcaatgaactcagtagcatcagcaatggtgttctccaggtccccaagaactctctgcagctcacccaaactctgactgctactgtcactgcagaaacggatacgcttggcatgactgaatttagagatggcaaaagatggactcacttcaccatgatgatccttgccttgatgagctctgcacctgaaggtgtccagggtgtagtagcctctgaacatctccttcctcaggatgctcagctgctccagcatggcttggttggtgatgcaccgttcttccgcctcgtcgacgatgatgcgaaaccgcagcagcagcctttgcaggttctccaatctttcatcgtcgcttggagccggcttttgctgattcaggtatttgcttacaaggaaagatatggatctacctgcaagttcagtcaggatgacagaaatggttgcctccatgttggctggagaaaaccttgcagaatggttctgcaatggaatgagttacctctagctagaagtataacttatattatgtgatctgaaacttctgattgtgccaaaacaagtttttgtattatctttcaattaggattaggattaggagtacaagttgtaacaactaacaacaagcaatgagtgatcagaagtcaaaattggcaggggataacaaattacatagaatcaattagttgatgtcagttctcatggtgttctgcatgtcctgacgtcttgcgcatttgacacgttcaagcttcaactaatgaaagataatacgatatgctgacgaattgagtttgatggcctctcataaacagcacatttacataacagattggagtactcattcgctcagacagtcagacagtaggtgaaaatatttaaaaaatgctcagaactattacagtttaagataattacattatacagcagcttctcagataaacaggtgcaaatcttcggaaaacaacaagatggtgttaacaccaaaatttgacacctcgaacataaatagaaaaatatggccgaatttaaaaaggacctggtttcctttatggggctagtatgaccgccaccgtagagccggtcaaaccggtgatgtgggaccggtctgactggtggcatgtggtcggtcagatcgggtgagtctgactccgagttcaatttcgccgggtctcgagttcccttacttgagaaggtattttttgagttctaattggtcactatcctcaataaaacatggaaagggtcttgtaacaggaccgacccctttataagggctatggtcggttcgattctaacccccaaaccacaatccctataatctatcgaattgttcttttacctttacttttcagccatgctttctactttattttctacctaacaatagttcatccatctttgttgatttgcgccacaaatcatccgacttcactgcaagggtgcgatatctctttgtaggtttatcccgtaaaccttccgattcatccacgagacggtaaatcagtctagaggctaattttgatatctaaatcagctccgctagccagtttagttttgtatcaaggtggttggcgaccgcaagatgtttaggtgtcccgatcgtaattgtcttcttgctataagaaagttaccaacacgattttttgtgactatgctaggaaacgtaaaaaaaatttcggctatatatccgaccgaaatcaatccacatacattcactgccgccgtctacgtattacacactggatcaatgtattcggcagccacactgtccggtcatccgcaacagcaatcggattgctctcgatctgctgccaaaaattaaagaaaatcaaatcaaggtgagtttacaggaatagatcaacaccgtgagtgagtccgaggaaagccgccgtcgctgagtatttttcctatatatctgcagccgcgtgacgacgctgcatagatagatacggacatcgatcaattcgtcaaggccatcaggacttcagcgcttgccgtttcgctcttgtgttcctattttggccgatccagaaaaactaggagccgattcaacgtacgttgatcggcatatacaagccaactaggaagcctacccatcagtacgtggttgctctctgttgcgtacatccattgaaacaaaaaacaaaattcaatcaaagccattgcattgtttttgggaatacgcaaggagcgcatcattgtattaagaggaataaagtttatgcacatcggaaacgaaaaagagagggggacgaggtacaggagggtgactagaaaacgctaaatcttattctcgcaaccagttgggcgacctactaggcggagtttgaagaataagagctggcatagctgctctgccattgcattgtatcggctaaccaatattttggaacttttgctacctgcaaacgaggagaacagggaatatcagttagctatcttgtgtacacatctatttccctattcgcctacgacgggtggttaattatctccatatcaatctaaatcattctagaggctaattttgatatctaaatcagctccgctagccggtttagttttacaaaacccatcatggtttagcttcgtctaaatcgaggtggtttgtaaatccatatcaccgcaagacgtttaagtgtcctattcgtgattgtcttcttgtaaaaaaaaaagttgctaacagatggttaagtgcaaagtttgggcaatgccttgagccggacactcgatcaacgatctaaaaatcaggcgcccaccccgccccgccccgccccacccgtgcaccactctgcctttgaatataacttccctctcatcacttctcttattttgttatgcagagttctcttcacatgcatgtcatgtcatgtctagccatgcatgttcatgtaaatttttgatatatcattttgcgcatttttctctcttcttcatttttttctctcctaaaataatggtccgttctacgatccgataataccgttgtattgtttataattaaatctttatagtaagatatcacatgattatattttagtaaaaattcaaatgttgtttcaccccttgaagaaaattgtttcagtagtgttcaagagaaatgcaacatttaaaaataccaactgcaacaccaataaccacctatatagaactaggggtacggaaacggacggaaaccatctttatcgttttccttttcatatttctttttagaatcggaaacctcggatacgaaaacataatcgaatattatcgaaaccgaaaacggagcgaaaacgaaccggcgcgaatacggtaatgaaaatttatcggaataaaaaacccctcaaactgataaatccaattgaataaattatctatgtttaaaagagtaatgttgttgataaattccaatgtagaacaaaaaatattcttatgtaattttagatttgcataacaaatatttaaaaaaaaacaacagccaaacaccatggtattcactatttattgcttaaaaaaagaatccagggtatttcaatcacaaaatttttggtaattccgagaaaatttccagaattctgagaaaatttccggaaagtttccgaccaattccgagttccgacggaaaccgcccttagcatttccgattccgtttccgagaaaatatttccgaattcgtttccgttttcgaaaaattccgaccgacagattccgttttcgaaaataggtccagaatccgaaaagttttcgtaccgttttcacccctatatggaacattgagtaccaagaagcgaaacaaaaaagtcatatgagagatacaatatatttgaaaaaaatgatattgttgaaatattttgtattattacgaatattaagctgtaactattgaaataatataaaatacttgccaaaactttcctggaacaccgcgtgcaatatttacaaattaactagtgaaatatcatacgaatactagttgaaacatacacataaaacatgtgcaacattgaaaaatatccatcaaaaaagctaaatattcttttcatcgaaatataacaatgtgtggtcttgttctaaatatttaattgcaatgaatttaatagtgcaatcaaattgtagattgaagaagttatttaagagaaaaggatagttcaaatattactaaaaaaaacttataccaactcaactaaccatattttcttttttactaaacgcatgcatgtactagtagtgacttggttaatttctagtaggctttacaggctgcagctacaccatgtctctgtagcagctagctgacagagtgacggaggatgaggcgggtgcccgatttttagctaaaaaatcaggcacccaatccgaagtcgcgtccgcaaagttcccgaggtcgcttatttcttgcaactatatgctgcgacttcagtacctcacagctgaacatgtagtcgtggtaaggtggaaggtgagatctccagccgagaaccttgaattttccttgaggcctaacatttccaaattgaaaatcttcgaaactcaactggggaacttcaacttcactctgagcagagtttgtacaacgatggagcatgtttggaacagaacatgtctgataatcatgaagaatcagaatatattcagaggaaattccgtttaccctcctaacatatgccgattcaaccacctcccaaggaccatcaaaatttgcatagagtgagatattcaacttcctgaattctctgattcttgttagaaccgtgctccaaaaccgagtgttgaaatttgcttttagaagttcattgtagatgcctgaagacatgaagcacccattccattcccttgctatctccatcgctattgattccagctttgggtgctcctctgcatccatgcttccaaacgcgcgcagtttgaagaagtaccagtaagcttcttgagtaaagaactttactcgaagagcttgtgtcgttccaaagcacgcaatcttattagatcggcttgagactataattttactgccatttgcaacacaacatttgcaaactgagtacaaccttctccacacaccctcatcgatgtctctggttagttcgatgatgattaatatcattttgccaccagtggcattgttttgatgcttgattacaccagaatctctaagagtctccatgcttgcatcttcaagatcatcctcactgaaacacacaatttgagagaagtgattacggaccctttcatcatcacaagcatgcgcaatcagggtggtcttcccaactttcccggggccaatgatcggtaggacacctggattttcagcaccgggagtatcctctttgagcaggaagttcatgatgtgctccatctccatttggcgaccgaacaaacacttgtctataagcaagtgcatgctatatggctgccggcacaaacgaggacaaaagttcaagaatatgacaaactcgcgcatatcttcgagggtgacttgtagtctgccaagaacttgctgcagctgatcttgcaaggtctggccaccatcccacaagtatcggatgcgcttggcaggatttaacttggatggtttaaaatagttactcacctcatgatctttggcattgtcttcttcatggccatggcatatgaagttgccgagggtgtaataccctctgtacatctccttccttagcatgttcagttgctgcagcatggcttggtttgtgataagccgtccctctgcctcctccacaatgatacgaacccggagcagcagtcgttgcagtctctcctccacggatggtaatgttggctttgagcacttgttgatcagcaaagatatggatctactggcaagatcactcagaatcacggacaaaaatgtctccatgtctacttctcatatgatcagcaaagatatgatctgaaattttgtaaatcactcaagtggtgaagagctggtacctgagaaaacacaatctgaatgtttatagagggtattgcactggttacatatacaaagaggggatatgatctgaattaaggcagccacgtactctactaactccaagtctccataaagcgaaaggtattgccctgtggttacatatacaaagttacatgtatatctagaatttatttcaaaccatacttttcagtgtgaactgtttggatcctaatttctgttttttctttgcagttccaataatataaccgtacaaggttgactacatagcggagacgattctacaggtttggttcagcgccatggaattctcgtcaagtttcaaaagcacatgcattttagttgaccagttcgcatgctagccaatgctacaacagcgacaggttagaaaaggaataaacattcagaaaatggttttcttcttttgtctcttttgataagggtcaagttttagcttctatttcttttaactagcaaaaaacattcagaaaatgatcccctacagcggttgttatgtccttcaatagctgactatctatgtttcttgaacaataaattatgagcatttttcccatccttgatgaggtactatgaggtaccaatctaatctaaccgttgatttagttggggcatgatggggctaacaaaaataagatctctcttctaggtcagaaatcgccgcatcctctcttccaggtcagaaatcgctgccgccgtcgcgcatcgaggttgccgccgtcgcgcgtcgaggccgccgccgtcgtctcccatcgagcctgccgccgccgccacgcatcgagcccaccgctgctgttgcgtatccagccgccgccgtcgagcgtcgaggccaccgccgtcgtcgagcgtcgaggccgccgccgccgacgattcaccgcactatcccatttgtcctgtccagtcattcagaacattggtgctcgtctcgaatttgtggcaagtttccaaatgacattaaaggtgggtattaaggctctatagaatgacatcacatttgctattgagtcttatttcaccctagcaagataatttccaagatctaaaagcaggggaacaccaaattcccagctcggagcacaggaacgccaaatctgagcagccgaggggaggaagatggtactgacttgccgagcgcgggccccatcttgttggtgagcgtcccgacgatgatcatgcagtcggactgtcgcggggatgggcggaagatgacgcgaaagcggtcgaagtcatagcaggacgcgccggcgtgcatcatctcgacggcgcagtaggccagatcgaccccctccgcgcccagttcatgaggtcgtctaccttggagatcactaactctgcccgaacgacacccgccgccgccgtcgcgtaaccagtagcccgccgccgtcgcgcatcgagcccgccgcgcatctggctgctcctgcctctcgcggtctcgacgccacgccatctctcgcggcctcgacgccacgccatctctcgcggctctcccgagtcccgacgatttttttcttctcgtgaaacaggaaaggacacaaatcacattatagaagtgggagcaggtttcttctcttgttaaaagaagttaattaatgctgacaaattgagtttggcaacctcatgaaaatatcacatttacataggagcttggatgtacacagatgctcatatttatacaacagtttcagacaataacaagatctcgtagcttagatactaaaaggtaccacaacctaacaatatggattactatctgagatggtcaggtgcaaagcttatgagatctcttcttactggtgaccatatgatgtggcctccgtacctcacagttgaaaatgtagttgtagtgaggtggaaggtgagatctccatgcgagaaccttgaattttccttgaggcttaacacttccgaagagaaaatcttgcatactgacctcggggacttcaccttcactctgagcagagtttgtgtaacaatggaccatgtttggaacagagagtgtctgatagtcgtgaagaaccacaagatattcagaggaaattttgtttaccgtccgaacatatgcaggtttaaccgcctcccaaggaccaccaacaagatacgcgttgtatattaagttgttcttcagcttgaattctctgattcttgccagcgccatgctccaaaaccgagcattaaagtttgctttcagaagcacactgtagatgcatgaacccatgaagcactggttcatctccctggcgatatccatggctaatgatgccagctttgggtgctcctctgcatccaagcttccaaatgtgcgcaccttgaaaaagtaccaataagcttcttgagtaaagaaatttactctgagaacttgtgtcgttccaaagcttacaatcttatcagatcggcttgtgactataattttacttccaactgcaacactaattttggaagctgagtacaatcttccccatacaccctcatcaatgtctcccattaattcgataatgattagcatcctgtctccaccaatagaatggtttttatgcttaattacaccacaatctctaagagccaccatgtttgcatgtcctacatcatcgtcgttaaaacacacaatttgagagaagcggttacgcactctttcatcttcgcaggcatgctcaatcagggtgctcttcccaacttttcctgggccaatgatcggcaggacacctagattttcagcactgggaatgtcctctttgagcaggaagttcatgatgtgctccgtttccatttgacgaccgaacaagcacctgtctaaaagcaagtgcatgctatatggctgtcggcataaatgaggacaactgttgaagaacatgagaaactcgcgcatatcttcaagggtgacttgtaggctgccaagaacttgctgcagctgatctcgtaaagtctggccactgcccgtgcagaatcggacacgcttggcaggatttaacttggaaggtgtaaaatagtaactcacctcacgatctttgacattgtcttcttcattgttatggcatctgaagcagatgagtgtgtaataccctctgtacatctccttccttagtatgttcagtttctgcagcatggcttggtttgtgatgaaccgttcatctgcctcctctacgattacacgtgcccggagcagcaactgttgtagtctctcctccacagttggagttgttggttttgagcacttgttgacaaggaaagatatggatctactggtaagatcactcagaattgcagacagaaatgtctccatgtgtaagtatgtagtctgaaattttgtagacctctcaatagatcagcaagaactgggatctgagagaaattatgtagtctgaaaaattttaaaggatcaggtgaagcagagtaggaattaaggctgccacatactcttatactgtggtttacaaaaacacactttgaatgctccacatagtccagtatcccaacctagatatgctttttaatgtgaaccgtttggattcaagtatctgttttgtacattttgcaacaatataataaccatacaagactgtccacatagcggtgacgatgaaagcagtaaagaaagttctacagattggttcagcaccactggtttctcgtcaagtttcacagtcacatgaatttttagttgaccaattccgcgttctagacactgcaatggccttctatttctacaaatgtgacaaaaagaaaggacctgacgaacatgaacaaaagaaatggcaaacttcttcattatgaaactcaacatgttaaaactgttgaaatttgagaagtgcttgtggtgcagctggcatggatagtccttgttttttttttctctgggtcaaaattcaaggctttgcttctagttaattccaagtcaacttttattttcaacttgtctgactgcaacactagtgaaaatgtcatggacagggaggaaacattcagaaaatgttttcctaccatggttgatggatgtgcaaggaatcagctgacaagctaaccacttttttttttctgaaattccttttggggatcaatacgcttatatggagaattgaagtattctgagaaatatggctacagatccttgaaatttgagttacctggatcgaaagaagcagacagaacgttgctgtcagtcgccgccattgcaggaagaacccgagccgccgctgccgccgacgtctccagatccggccggcgccgcagctgtcgccgccggcttccttggccgctccatcgccggccgcgctcggcttccttctcacttcgtggcggacgtcatcgctgctaggataggggaagtacaaccttgccgccattgctggagagtggggatccatccagtcatccagccaccagcgacttgaacccaaaagctttaaatatcgtaacctttgtccttggtaattaattaacttccttggtagagttaaaaataaagagaaaaaagatttttaaaagatatatttgagaaaataacagtgcctttgccttgatgtttggaaggaccagctacagggcgctttcgacactcttgtgctgctaatctgcgggatggtttggaaggagagagatgcgcgtgtgtttgtaaagaactgttttattcctcttaatgcaaaaatacgcatctagcgtattcccgaaaaagagatgtgcgtgtgttccagagttagagccgagtggcgggcatcctctttgccttgattaaagagtaggtcgtgatctgaaaagaagctgggggtttttaaagatttaggagagtagcgtcttgctgtagcttgtttttcttttcggaagttgcttatgggacaacatcaatcattcacttcagcagtctcttgtctaaatttgaactttgtgaatgtgtacatacctttttattaagtaaatttggtccacctgtttgttttaggctgggctggctaaaaaaaatagtgcccatttgatacggttggatgaatgatagggttaattaaatctcctattacaaatttgtcatattggaaaaatgatattattatttatcaaattggctcagtgtcataagtattttgtaaaatttaaattatgccattatatatgtatgtacgagacgtacttgaaccaatattttgcgtaacgtatttttcctacccacaaccattgcgcgctggtctcctcccagccagattcatacgtggggggtgttacgaaaatagatgcacaacggagacacgaatttttacgtggaaaacccttgcgggaaaaaaccacgggcgccgaccggtaatgatcactatagaggagtttattacaaacgtaggggaataacaatgggaacgtcaccccttcccatacggcttacaagagtatatatacgggataatagaaagacacctaataggactctgttgatagaaaacacagggcctgggagatctgcttaactccagtgcatgtccaaaactcgccttcggatgtatgagcgtgccagttgatttgatcctgcaatcaacaagaaacaaagacaaagaaaccgtaattaaatccataaatgatagccgatcggctaaatgccgatgacatgtcatttatctttgagccgatgtcatatgtaaatcgatcggcaattgttaagaaaacaaatcagaactaaatctactcgatcggctgcaaatatcaatgatacataatccttatatcgatatataattgaatcaagtgattgggatagatcggtcaccttgccgagacagtataaatcacttagatcgaaatatatattaataatgagattatatatatatattcatagcatagctgatcagatagatctagcgtgtatcggctaatactccgatactactttatattaagatattaaagcaaatagaatatactaaacagaaatctaatatacttaaatgcaacaagatcttaacatgaaggacagatctaacatgttaattgagcatgtagaacaaaagcaattggatcagataagatcggctgaaactccgatactaccctaatcggcaaccagtaggcaggctagagattgaaattctaagcacggcttaatagatcaaactcaactgatacagcattaagtatgaaaagaagaacaatatctagacgatcaagccgctggatgtttcatagagtggtggatatctcatataatctaagccaacgtcgttatttaacctaatcggctgccttctggtagcagatgttagccgattgtaggttaaatgacgatattgtcaaggattatgcaagatatatgataatttgacggactacataaacaagattagagtatcataaagatggaagcactaatctcgagaacacaagccgccataacaagtttacctcttgttgaagatcgaaaccgatgcagctcaacccgaaagcaataactcgtcgaaataaaacgaaagcaaaaagagtggcgatgcgccgaaattgtattgaacgtgtgtgttaatcattacatagggctcggggtctatttatacccgagaaatacaagatatgtccatattggacacgactcttatctctaacaaactctaagataccacaagtctttgcggcagacttttgctcacatttatctctaaggaatttacataaaatatcctaattaatagatacaattgccttcccaggactctatccatgcgtggcaatcatcttgaagcacatcaactcgaacccaatgtcgcatacgggtcgtattgtcggaatcggctgtatcacttaaccagtccgactcagacttagccgatcccagtcgtagccgatccggactccagccgattattactctgtttccgaaaaaacccttatcttcgattctacttcgatttcattttcatctccaatactgatattaccaaatttggtcgttaacaggctcctactaggaaactaattcgaatatattgtgggcccaaaattcggatcacatatttaacaatatccaccttgagacgaatttcctcttgtagcataaaaacatcaatcaccaaaaatacctcatgtaggtaaaatcaccgcgcgccaaatagtctctaggactatactgtaacacccaccaagcttgagcaaagctcaaacttagtagcaggaactggctttgtcatcatatcaactgggttatcatgagtacttatcttgcataccttgacatcaccttcagcaatcacacctcgaataaagtgatatctcacatcaatgtgctttgttctctcatggaacatctgatcctttgtaggcatattgcactttgactatcacaaaatatattaatgcaagacgtaactccacaaagctcagtgtacaaacctctaagccaaatagcttctttacaagcttcagaaatagccatgtactctgcttcagtagtagataaggcaacagttgcttataaacttgccttccaactaacagcacatcctccaatagtgaaaacataacctgtgagcgatcttcttctatccaaatttccagcaaaatctgaatccacataaccaacaagtccatctctagatctcccaaactgcaaacaagcactagatgtaccacgtaggtatctgaaaatccattgaacagctttccaatgctctttgccaggattagccatgtatctactgacaacactcaatgcatgtgataagtcaggacgagaacataccatggcatacataagtgaaccaactgcacttgaataaggaactctagacatgtactcaatatcataatctgactgtggacataaatctgaagataatctgaaatgtgcagctaaaggagtactcactagttttgcgtcatgcatattgaaacgatgaagaactttttcaatataacctttctgactaagatataacttgccagaatgtctttctctagtaatttccatatcgagaattttcttcgctgcacccaaatccttcatctcaaattcactactcaattgtgccttcaattttgttatctcttatttgtcttttgcagcaatcaacatatcatcgatataaagaagcaaatatatagctaaatcatcaacaactttaagataaacacagctatcataattggatcttctaaacttctgagaaagcatgaaagagtcaaatctcttataccattgtctaggtgactgcttcaacccataaagagatttcttcaacctacagactaggttctcttttccagaaacaacaaaaccttcaggttgctctatataaatgtcctcttctaactccccatgtaaaaatgcagtcttaacatccatttgctctagttcataatcatgcattgcaacaatactaagtaaagtgcgaattgaactatgcttcacaacaggggaaaagacatcattgaaatcaatacctggaatctggctataacctttagcaactagccttgctttgtatcttgcctcatcacttggagacatacattcctttcttttgaagatccacttgcaatggataggtttcttctcctttggcaacttcaccaattcccaagtatgattcttttcaagtgactccatctcatcatgcatagcagttatccatctattgcaatcatcagaaacaatagcctcagaatatgtagaaggttcggcattaccttcaatttcttctgccacactcaaagcataagcaactatgttcgcttcttcaatatatcttggaggaggtttaatatttcttttgggcttatcttttgcaatagaacgttttggagattgatgaacaatagaagaatctgaatcttcaataacaggtgcatcttagttaatagcaacaaattcgttttctggtgcatgtcctgaactgatcaaatgctccacctgcacacttgctttctcctgactctcaacaggaacattagtagaaggtttgtcatgtaacataactgattcatggaagacaacgtttctactaatcacaaccttttttgtttcaggacaccataacttatagccttttacaccagacggataaccaagaaaaatgcacttaatagctctaggctccaatttaccattatcaacatgagcataagcagtacaaccaaatactcttaagtctgaataatttgctggggaaccagaccatacctcaattggagtcttcttatcaatggcataactgggtaatcgattgataagataacaagcagtggaaacggcttccgcctaaaactgtttaggcaaacctgcattagacaacatacacgggcctttgatataattgtcctgttcatacgctcagctacgccgttttgttgaggtgtgtgaggaacggtgtagtgacgcacaatgccttcagacttgcaatatgatttaaatatcttagaacagaactccatcccattgttagtacgaaggattttcaccttcctttcagtttgtcattcaaccatagttttccactccttaaacacatcaaaagcttgatatttgtgcttcaagaaataaggccaaacttttcgcgaataatcatcaacgatagtcatcatgtaacgagcacctccaaaagatgtcttacgagcaggcccccataaatcagaatgcccataatcaagaataccttcagtagtatgtgtagatgtattgaacttcaccctcttatgcttgccaaatatgcaatgctcataaaatttgagcttcccgatgctttgtccatctagcaatcttcgcttgctcaattctgccaaaccaatttcactcgtatgcccaagacgcatatgccaaagattagtagcatcggaattagataatgaatcagaaactgcagcaacattacctaatatagttgtacctcgcagatggtacaggttggcagatttaatatcagctttcatcacaacaagagagcctttagttaccttcaaaattccgtctccaccggaatatttgtaccctttgccatcaagagtacataaagagatgagacttctcttcaaatttggaatatgccgcacatctgacaatgttctgatacagccatcaaacatcttgatctgaactgttccaatacctgcaacctcgcatggtgtatcatcacccatcaaaacagtaccaccttgaacagcttcataggtggcaaaccaatccctatttgggcacatgtgataggtgcatgcagtattaagaatccactggtcactagtttgtgcacaaccaacataagcaacaagcaattctgcatcagatttctcatcagtaacaactgcggctttaccttcctcttctttcttaccttttggtacatattttccggttctcttgtctttgtcctgtagcttccaacactcagatatatcatgtccatctctcttgcagtatttgcatgacttatacctgcctctggactttgatcttccatggtagctacttgaacttttatctcttgatttgctgtttgtgttcttctcctgttgcctgccccgaacaaccaagccttctgcttgtgaatttgaaccttcaaagggtaccatcttcttcatcttttctttggcatgcaaagcatcataaacttctttcaaagttagagtatcatggctataaagtatagtatccctgaagtttgcatatgagctaggcaatgaacacaatagaataaggcctaaatcctcttcatcatactttacctccatagactcaaggtcagcaacaatttccttgaaagcagagagatggtccattacagacccatcatcttgcaacttgtgtaaaaataacttttgcttcaggtgcatcttactggtcagatccttagtcatgcatatctgttccagcttcaaccacagcccagcggttgtctcctccttaagcacctcctgcaaaatattgttagatagataaagatgaatatatgacatagccttacgatcccttttcttctcatcgttggaccaatcctgagtcctcttgtcaaatccagaaagcgcatcatcgaggtcttgttgtgcaagaacggctcgcatcttcacttgccaaaatgagaatcttgtgtcttggtccaggagcggtagatcatacttcaaactcgccatgggaattaatcctgaatttgctagaaagaaattagggtaaatctagcaaaaaaacgcgaaacccggtacacttctcgtgtgcacgtagcgtagatctgaaacttcctggtacacaagcttgtgtgcgcgtagcaattccacgtgaatagaaaatcacgtgaacaggaacctgatcgcttccctcgttgacttccttttcagcctcgggaaccgtgcgatttagtagatgtattgacgccggctgctactcctggacgtgcgcgtagacggcttgctgctgctgcttgccaatctcctgacgcgtgcgccgattccaggacctgggctgctgctgccctaatttcgcgcgggctgtagggatgacgccgatcagatcgatccggcgactcgacgatccggcgcctcgacgaaccggcggcggctgcgtgacgtgtagatcgatctccaaagctctgataccacttgttatgaaaatagatgcacaacggagacacgaatttttacgtggaaaaccctcgcgggaaaaaaccacgggcgccgaccggcaatgatcactatagaggagttgattacaaacgtaggggaataacaatgggaacgtcaccccttcccgtacggcttacaagagtatatataagggataatagaaagacacctaataggactcctactaggaaactaatccgaatatattgtgggcccaaaattcggatcacatatttaataggggggagtggaggtgggcaggtggccactgcccctgggcagtggcaaggtgtagaggttctagtacttgtgccgactacctcgacaccatcactacgctcctcctcatcctcagcgcccatccttgcgatcatcacattcctcaccactcctcagtcggatcccaccagagaacacatataaaccatccgcgtcgatggagctcctatctcgccacttcgctattgcagggagtggaatctaatccggggatgtccctttgtatattttttctttcaagttcatgtaaatggttatacaaaatgtaaataataatttgacaatgtagagtacagtaacatctatcgctccaccaataatcaacttcaaacttgatctatacattgaaaaaaaacaaattatgggatgaataatactatattgttcatatgttgaatttgcccttttcatttctcaatgtgtgagttgagtttaagtttaaattttattttaaagtgatatatgtatgtcatatgaatgttattttttgagatttttttaataactatttgagtggtgtttgagcaaatgagaggacatcccctcaagagtttaaaagtgtttcctgctattatgctattatggtcgctcaacatttagtctataatcgagtttgccgttattcattccacatccacaattgtttgctagctcacgtgtcttgcatgtgcgtcgtgggcaacgttgaggaaagcctcttgaaagcagcacattttacataggagcttgaagtaaacacatttgctcatgcactgggtgaaaaacaattgaaaatttctcagatttagattcagattcagataattacatcatacatcaacatctgagatagtcaggtgcaaagcttctgaggtctctcctccctggtgatcagatgatgtgaagtccatacctcacagttaagtatgtagttgtagtgaggtggaagatgagatcttgacgcgagaaccttgaattttccttgaggtctaacacttccaaacagaaaatcttgcaaactcaccatgggaactgcagcttcactctgaggaaagtttgtgtgataatctaccatgtcctgaacagaacatgtctgatagtcgccaagaaccacaagatattcagaggaaacattgtttatcatcctaatgtatgtgggttcaaccgggtgccaaggacagtcaatattggcaccgtatcctaagagattcttctgcttgaattctctgattcctgccagagccatgctccaaaacctaacattgaaatttgctttcagaagtacactgtacatgcttgaacccatgaagcacccattcatctccctggccatatccatggctatcgatgccaactttgggtgctcctctgcatctatgcttccaaatgtgcgaaccttgaaaaagtaccagtaagcttcttgagttaagtattttactctaagagcttgggttgttccaaacctcgcaatcttatcagatcggcttgcgactataatcttactgccttttgcaacacaccttttggaagctgagtacaatctactccatgcagcctcatcgatgtccctgctcaattcgataataatcagtagtctttcttcaccagtaccacggttttgatgcttgattacaccacaatctctcagagtcaccatatttgcatcctcaagatcatcgtcactgaaatgcacaatctgaaaaaagcggttacgcaccctttcatcggcacaggcatgctcaatcagggtgctcttaccaaccctccacgggccaatgataggcagaactcctgtattttcatcaccaggaatatcttctttgagcaggaagttcatgatgtgctccatttccatttggcgacccaacaagcacttgtctagaagcaagtgcatgctatatggctgacggcacaaacggggacacctgttcaagaacatgacaacctcacccatatcttcaatggtgacctcaaggctgccaaaaacttgctgcagctgctcttctaaactcttgccactgaccctgcagaaccggatgccttggcaggattgaacttggatggtataacatggttactcacctcgtgatctttggtatggtctgcttcatggacatggcatctgaatctgtcaagggtgtaatatcctctgtacatctccttccttagtatgttcagttgctgcagcatggattggtttgtgatgagccgttcatctgcctcctccaggatgatacgggcccggagcagcagccgttgcagtctctcctccacggttagcgctgtcggtttcgaggacttgttgatcaggaaagatatggatctactggcaagatcacctagaatggcagacagaaatgtctccatatgtaacaatgtaatctcaagttttgtagtttgagacaagaactgagacagagagaaagtatgtagtctgaaagtttttagtggatctggtgaagcagagtaggaattgaggctggcacatattccagcagctccatgtcttcataaaaggaaacgaattgcactgtgatttacctcaacctagatttatttttcagtgtgaaccgtttgaatataagcttcaggttttctctgcagtttggattaatataatcatacaagactgaccatattgtgaagatgatgaaagaagtagagtaaattcttacagattnnnnnnnnnnnnnnnnnnnnnnnncaagtttcacagacacgtgtatattttagttgaccagttctgcatactactactaggcaacacaatagccttctaatgtgacaaaaaaatatttgttttgatgcgggcgttatcttggtgacttagctaattggaaagaacgcaatgctcgtgtctttgaggggcacgcagtctcaccggtgaatctttgtgcgtcaattgaggatgagtggaaattgtggtaagaagcgggcttgaccacctctctttgagttgtatagtgggtgcgagggttttcccccatagttgttgtgtatagagggtttctttcttttttgttgtgatagcacgccgtttcctctcggcgtgctttgagacctgtaaattctttcttacctcttagtatattccggccagttattgccgaaccagcgaaaaattgtgaaaaaaaaggacttgatgaacatgaacataaggcatctcaaactttttttttatgaatgtcaacatgttaaaactgttgaaaaatgataaatgcatgtaacatgttaaaatgaaaaagcctgttgtcccaaattaattttccattaaactgttaaaaattttccatcctattacaagttaataaattcccctgttatgccccagtacaaattctaagtcttctttttctttttttttgttgggccaaaattcaagttttttttcattttgttaatttagagtcaatttttttgctgctacttgtctgactgaggagtgaggaccagcaaaaacgacattcagaaaaagcaattttacagtccttaaagaggtaccataaggtaccactttttctattgtaaatttggtatctcttgctacctaggtactataagataccaaattttacactaaattttgatatttgctccgatccagcaaaaaataactcgaggtaccgataccccacggtaccaaatcgtttccgatcgttggatctaacaatgcccatcctgcccagctagacccaacgatcgcaaacgatttagtaccgtgaggtaccggtacctcaaggtactttttctggaccggagcaaatctcctaaatttttggtacctcatggtacctcctcaaggaccgtaaaattgctcttcagaaaatgctttccctactaccatttctgcctatttatacatctgactagctacatttcttcaacgatagaattatggtacatttctggactatctagacactttctctgaaatttcttttggggatcagtgcacacttcaatggtaaatcaatatattctcagaatatgctacagattcttgaaaattaagtacctgaatagagagcagacatggatgtagaggagggatcgccgtcagccgccgccattatcgccaacgtctctagattcggtcggcgacatagcagctcgccggccaagttacagggccatgaagcaattcagaaattccccatcaataatcgacactttaatttcgttagtttttgggagtactacctccatcccaaaatgtagcaacctagaatgggatgagatccatcctaggataatgtcatgtctagatacattgttctaggatagatatcatcccctcctaggttgttatattatgggatggagggagtaaaaaaatgttttttttagagtcgacagtataagtggtactcactcccattccaaaataaaatgattattcgactgtactatatctgattatatatatagtacttgccactattgactctcactgattccatttcgacccctgattttcaaaatgttttttaataatggattaaataaaacccggtctccacatcccgaaggtcggatgtacacaaccacagtattacatcaccaagcacttgggcttacaaataagtttaaaagcaaacgccatcataggagacaaatagacgacaaagacatctagaacaagtctcacaacaaaagatttcaactaacaattcaatcttcctatccaattccacccagattttgagtagaattccataatggtaacttccaatttttggcacccaacagctttctcgtcactctctttaagaagcaaagaccactagcaagcccagcgtgtccccctgaaaataatctgcaatatagagttaattgttgagccattgaagactacatcattcctagcaacctaaagtgcccaacaaatagccacaactcccacgaaaagttgatccctaagcttagatactaatccccatgaccaaccacccagaggattagcaacggaagtaggcacttgtattcccataaccatgaaaagaatattccaaactgaatgtgcaacatgacaataaaaaacagatgttcaattgattcttcagagttacagaagcaacacttaccttttcgtctccttttaaccaaattgtcttttgttaagactactcctttgatataccaaaggaaaatcttaatcctaagtggaattctaagtttccagattatcgactttcttggtaccacattatggtacataagagccttgtacatagaactcaccgggaagactctcttcccattggcttcccatctaaaaatatctggactattagataagttaaacaagaccatttagcataccagcttgtatcacgcattcaggttatcccccaccaaagctctactaaagggcacatttagaggaacattgcccagtacatcgcttactctcgcatgcttgtttattgttagtaaatagagggagggatataacttatcaaaggagttagtcacccacccagcgatcctcccaaaatctcacttgttctccgtgtccaactaccatagatcctagttgcaaaaaatctttcttaaccatcataagcccggccctaaaatgtaaatccccagaccgcttttccacttgagtgattgttcaattggctaagtacttccttttgaacagattttgccacatgcttccctcgttaaacaatttatagagccatttgcttaataggcacttattttgaatgtctaagttttgaatccccaccctccatattccttaggcttacatagaatactccattttgctaccctatacttctttttatgttcatcacattgccagaaaaatcttcttgagaatacctttagttatttcaaaaggttaaactacttgcacaaaaaaagtcagattcagcacttctgataatagagcaattttacggtccttgaggaggtaccat

SEQ ID NO: 43813 - DNA, 4286 bp, Oryza sativa
aggaacctcatggtacctcatagtacctaggtaccatgaggtaccaaatttataatagaaaaaatgatacttcatggtacctcctcaaggaccataaaattgctcttgataatatgtacttcccctggttcgataataggttgagctcaagctgaagccccgcaaaatagacccttagtctggaatcgagtttcccgttattcattccacatccaaaattctttgctagcttttaaattgattttatggtcctttttagatggtaccatacattattgttgacgtatggttttcatataaaaagttgcacgcttcctctcctttgtccaaccaaaattttcttttcacatgaggaggctaagtcctctagtgtggagattttgcaaaacaatgaaaacttgaaaaaaaaagaactttaatggaaaaaccatacaactgagtgtaataacaatagatttttacatttatacatggcaaaacagttcgatctaaatctttctcttctgacggagcctaatcctgcaggtagttgcagacttgaactcatgaatctcggagctatatatgtagctgtaataaggcggcaaatgagatctccacagcacaagatcaaatttcccatgaggttcaactctccctgacaagatatcttgtataccaatttttggagccttctgatcttctgcatgagcaagctctactcggcaatgttcaaagatttcacagtagtagttcacatttccatctgtcctaggaataaccacacacttgctcttcatcccaaaatcacctgaacctttgttaggcagtaactggctctttgattccttggtcctgaagcgctcacgcaggctaagccagtcgccattgtaaatactagcttgaatgaaggtagccatgttgttcagatcaatgaatggtccaatgaaagtattgtacatctcacgatcaaagtatccattaaacatcgccattgataccgatgccacctcggggtaatctttaggatctgagcttccgaatgcgagaaccttgaagaagtaccagtaagcttctcgagacaagaattttaggcgaagaggttgtgttgttccaagctttgcaatcttctctgatcggcttgtgattatgattttacttccagctgaaatgcaacttcgagaagaggagtacatccttctccattcgtcatcggaaacatcttcagttagctcaacaacaaccaataatctttctcctccacttgaagctaatgatgagttgtgtttatgccttatcactcctgaatctcttaggataagcaatgatttttgctcgctcaaatcgctatcactaagaaagatgatgcgagagaagtggttgcgcaccctctcatcattgcaaacatgctcaacaagtgtgctcttcccaactttggcaggaccaatgattgataggacatcaaatatgtcactatatggagtttctggatgtaacaagaatttgatgatatgttccatctccatttggcgcccaaacatgcacttgtccatgaacatgtaggtgttgtatggttgacgatgcatggaaggatagttgttcagaagcataacaaactcagccatgccagccatggtgatctctatgatgtcaaccatctgatcgaactctctcatatctccatgtcgtctagtaccagtaaggactcgagctcgcttgatagagttgaatttagacaaagataaggtgttgtaactcacttcattgtcatcgtcgtcgttcatgtcctcctcctggtgtttctgaattctgaaggtgtcaagagcatagtagcctttgtgcatatcttgtctcagcatgttgacctgacgaagcatggcttggtttgtgatgtgcttcccctctgcctcttcgatggcggtggcgagccggagcagcatcctttccagtctctgaatcttctcctccatgaacgtcgccgccataggcggcgatgacggcttcgaggagcatctgtctatcaagaaggagacggatctactggtgagttctcctaggattgcagagaagagagtctccatttgggaaatggaactttccttctccccttgcaagatggttcagacaacaatttgatgaatggatcaacaaccagaataagaggaatcctgcaatcgtataatggcaagtgctctagcttgtctgagtagcatttttttgatgccaacttgtttgactagtaattaaaatgacatcgattgatggtgaacaaaattttgtggatgcagtggttctatagaaaagtatgcaatcaatcaacaccaattattctttttggggttgagagttgagagatttgcttaagagttctgtttgatgactcaagtactgaatctactataaagcgagactttcgttgtgcatgatattttttcttgtattttctgaccagtgttgaccaaatacagggagactacacctttctatagacttttacatatttcgtcaataactaattcctccaagcaattattgacctatacagatttaattaacttgttgtaaaactactcattttgcaaacacagaagaaggttaggctagttatcatcccagattaaaaattcagtcagaggaaccggaaaaaggcaacgctggaatcattgtttgcgatttcatttcgcacatttctacttgtaagtttggttggttgtgtacatctgtttggatgtagaggctggtttaatccattatctaaaaaaaatgtactttctattcacggcacgggggttcagagaaatttcagaaatcttgggaattttcagaacgaaacaatttgaaatttaaacaattttgactaaatttggaccaaattcacaaaaaatgaaaaaaaaaagggaagaaattttccgaccaaattggaaatatcagacctatgttatgtgatcttaaacgtctgatcgtgccaatacgtgtttgtactgtatttcgttaaggattaggatgctttcttgcaagttgcaacaaggaatcgatggtcagaggtcaacagtggcaggtaatacggagtagcaattaacataggatcaatcagttgctgtcagttgtcatcgacttctgaactaatatccttgcgtcttagcatgttgacatcttcaaacttcaaatagcagaaaattattagatgctgactagttcagtttggcaacctcttacaaatagcacatcttacataggatcttggatgacatactcgctcagatactaggtaaaaacatttcacaaatgatcagttttacattacagcataagataattacattatatacaacacatggtcagcaggagcacagcttcagaaaacaaccagattgtcagctgcaaagttccagagatctcttctttttggcgaccacatgatgtttcctctgtacctcacagttgaacatgtggttgtagtaaggcggaaggtgagacttccacgcaagaaccttgaattttccttgaggtctaacacttccaaagagaaaatcttgcatgctcaacatgggaacttcagcttcactccgagtaaagtttgtgcgacaaagaaccatgttctgaacagaacatgtgtgatactcatcatgaatcacaaggtattcggaggaaattttgtttactgtcctaacatatggaggttcagacgcctgccatggattctcaaaatatgtaccgtatactaggagattcgtctgcttgtattctctgatgcttgccagagccatgttccaaaaccgagcattgaaatttgctttcaaaagtccactgtagatgcttgcacccatgaagcacccttgcaactccctggccatttccatggccattgatgccatctttgggtgctcctgtgcatccatgcttccgaatgtgcgcaccttgaaaaagtaccagtatgcttcttcagtaaataattctactctaagagcttgtgttgttccaaatcttgcaatcttatcagattggcttgcgacgataattttactgccatttggaacataactcttggaagctgagtacaatcttgtccatacaacctcatcgatgtctctgattagctcgataacgatcaatattctttctccaccagtgcattggtttccattcttgattgaaccacaatgtcgaagagttaccatgtctgcatctttaagatcatcgtcactgaaacacacaatttgagagaagtggttacgcaccctttcatcgttacaggcatgctcgatcaaggtgctcttcccagctttcctcgaccaatgatcggcagg

SEQ ID NO: 43814 - DNA, 8485 bp, Oryza sativa
  unsure (1)..(8485): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagccttttcagccttcatattgtccaaaaccctcttataatctcttgggaataccttgacaaattttggaagaagagtatcaaaattagagagtatatctctagcaacaacactcccagtgttaagtcgatgttgttctatcatcattttcaatgtggtaatgtcttcctcttcctccacatgatagagatcaactaactcatggttacagcggacgctgaatttcccatcaatatcataaacataagcaatgcctccactcatcccagcagcaaagtttcttcctgttttaccaaggataaccacagtaccccctgtcatgtactcacacccatgatcaccaattccttcaaccacagcttgagcacctgaattgcgcacgcaaaacctttctgcagccattccattgaaatatgcctctcctatagtagcaccatatagagccacattaccaattacaatattgtcttctggaataaatgtactatctcttggtgggtagacaacaatttttccgccagacaatcctttgccaacataatcattgctgtctccttcaagctcaagggtgattccaggacagagaaaagcgccaagactttgaccagcacttccagtgagcttcacatgaatcgtacctgcaggtaatcccttcatgtgataacgctttgtgacttcatgactaagcatagtgcctactgctcggttagtattctggattggagtctcaatgaaaacacgaacttccttctcaagtgcagcttttgataaagctatgagtttgttatctaatgccatgtcaagaccatgatcttgcttttcaacacagtactgagcagccccagggcgaatctctgcagctggtttcaaaatcaatgagagatcaatgttctcaagtttctcgttgctcttcactacttctggatcaacctcaagcatgtcagagcgcccaaccatttcagtaatggtacggaagccaagctgagacatgatttctcttagctcctcagcaagcatgaagaagaagttgataacatgctctggttctccagcaaacttttctcgtagcactggatcttgagtagctataccaacagggcaagtgttggtatgacatttccgcatcatgatgcaaccaagtgtgatcaacggagcagtactgaaaccaaattcttctgcgccaagtaagcaagcaacagctacatctttgccagtttttaactgcccgtcagtttgcagaatagctcggccacgaagcccatttgccactagagtttgatgtgtctcagccaatccaagttcccatggaaggccagcatttttaatacctgtccacctagaagctcccgtccctccatcatggccagatataaggacatggtctgcatgtccttttacaacaccactagcaacaactcctacaccagcctcagaaactagcttgacgcttatgcgagctctaggatttgaattctgaagagtacaagcaacaagaatgtcaccatatatcaggaagcaacatttgcaaattgcatgcatgtgttcaagttcaattgtaaaatgttgcatggcaaatgagcgatcatgagttggtatgatatctcagaaataaatctagtactaacaactatacaaaaataacaacaaatcgcttggtttcaagaaatagcaatgcagtatcacattaagttaccttaaggtcgtggataagttgtgcaagatcctcaatagaatatatgtcatggtgaggaggtgggctaatcagtcctacaccagcagtagagtgtcttgtaaccgcaatgtcaccaataaccttgtggcctggaagctcaccaccttcaccaggcttagcaccctacatacataaagaagttataacaaaaggtaaatttctgcaacatggtaggtgctttcaatagactgctgcaatcattttaatgattttgtagtgcacaatgttgacaagtacctgagccatttttatctgcagttcatcagcgttagtcagataatagcttgaaactccaaatcttccactggcaacttgcttgattgcacttctttttggattcattgaaccattagcaagtggttccatacgagaaggctgttcccctccctcaccttcacagatgtattagagttagtgcataatggtttagaggttatggattctactcaaaatagcaaaagggtaaaaggagatattttagacctgggaataaaagtaatattaagttctagaaatatgttaaacaagaaagaaacagttaaataaaataaaacacaaaaaataaagtctcaaatagtgcaatatgcttcttgcaggaaagaattttctgtatagcaaggaaaaaactcaatcccactaaaaatagtgatattttgtcttcagaaggcactctccacaccaacagaagattttttaaaaaaaatagcaaggtaccgtataagtttctttgagtgaaatgcagtaaatacctttttgtttgatagaatcaaaataagttcatttgtaagtacaagtatgtctaaaatagtggctcagaacagaaggcttgttttgaaaggtaattccataaagtgttcttactgcagattgtgcaaatggtagcaacaaagggacaaatgctacatagtatttcagtgtacctgtattagatttccctccaagtttgttcatggccatagcaagggcagtatgtgcttccaaagaaatggatccataactcattgcaccagtaacaaagcgtttaacgatctcacttgcaggttcaacctcgtccacagaaatcatgtcagcagtgtctttaaatttaagcataccacgcaggttgcaggttttgttgagctcctgaatacgcctagaatattctttgtatgctgcccggctgtttactctagcagcttcttgtagttttgccattgcaaggggatcattgaggtggacttcaccatttttcctccagtggtagtcccctggattgggaagggcctttgcatctgcacttcctggtggaggtgctcttgatggaaatgccaactcatgaagacgtagagcatctcgtgcaagcatttcaaaagtggcgccttcaattcggctaggtgtaccatcaaaacacttacggatgacttcagaggaaaggccaagagcttcaaaaatctgtgcacctttgtaagatgcaagggtggaaattcccatctttgcaagaactttcatcattccatagttagaagcatagaaatatttcttgacaagttcttcctttgagtagggtttcccatcaccattaggaggaatcttcccatcattctgcaagcaccaaattgcttcgatagccaaataagggcatacagcatcagcaccaaacccaacaagggtgcagaagtggtgcacttcacgaggttcagcagactccaccaacaaacctacgcgcgtcctctcaagattggccacaagatgctgatgtaccgcgccaactgctaagagcgaactgacagcaacacggtctgaggaaaatcctgcatcaagaatttaaacaaaacagtaagtttcatgcgagaaaggtcaaatgttgaagaatgtcgtagacacggaaatgcataaggtaaacgaatgttataactttgttgataataacagcgctacacctacttaattgataatattcgacctattatattccaaaattatatgcttggagctacatttaaataaaaataaatttgttgaatgcgtttgactaccgcaggaatgattacaaaattatgagtaatgagtaatgaaacatcagtagtatatattgaatatttcactgacctctatctgagagaactaaaacagtgtagcccttctttatagctccccgagcttctgtgcaaattctgtccaaagtttcttccaagcccttccttccagacttctttggataagttatgtcgagcaccttgcttcgccaaccacggtagttcatcttcttaatagcctccatttcatcaatcgacaccaaaggaccctcaagtgcaaggcggttgcattgcttttcagttgtttccaacaagtcaccttctggcccaatcatacactccatagatgtaacaattttctccctaattgggtcgattggcgggtttgtaacttgtgcaaacatctgtttgaagtactcaaaagtcaacttctctctgtttgacatgactgccaagggtgtgtcatttcccatggatccaagagcttcaactccatctttagccatcgggagaagcagcatttcaagggcttcaactgtgtatctgcagtaaaaataaatttgataaataaaccaaaaaggaactcaaaacagcaaagatagtcaacaaagtcgaaaccttgcttacccaaaggcttttagtggagtcacaatcccattgacgcctgcatgttcctttttctcattcttttgctacaccaaagtgtaaaaaaaaagataagtaattatagtgtaaccaaattctcataaataccagctaaaattgtagccagtgaaaaaataaaataaaatgttaaaacactgtaacagacttactgtgagtgaaccagaaattccaggagcaactctctcagtttctggcacagattctacaatgtctttgaggtatattttttgtctcttgagccactccccatatgggtgagctttcgagtactgtgccttcaatgcttcatcatccactacagtatggttctcaaaatcaaccaacagcatcattccagggtttagtctaccctttctcaatacatctttggaaggaacatcaacaacaccaacttcacttcccatgactacacgtccactgtgtgtcacataaaatcgaccaggcctcaacccattgcgatccagggtggctccaaggtaacggccatcagtaactgcagatgaaagcaaagtaaccacaaatagtacatgggaaatgtgtgatcaggaaggaaaaggtcttccgtatcttcttacaagatattagagcaggtccatcccaaggctccataagggcagacaagaactcatagagagctttcttctcaggttccatgttcacatcgttctgccatgcctcaggtatcatcatcatcacagcttctggcaggcttcttccaccacggataagaagttcaagaacaccatcgaaagcacctagaattgaaatgattctatctaattaacaaatctctaaaaataaggaaaatcccattttctaagtgtacttgatgtttcactgcatgaaacaattagctcttacctgaatcagacgaggtagcatccacaattggtagaatttttgaaaactgatcctttgttaggccaagcttctcacactctaagagaccttctcgtgctttcatcctgccatgcatgcaaaagcagttataaaaccaagaatcataaacaaaaatggcatagccatgtggagatgattacatacaacctagaaatggacattgtatggagcattccaaaaaaaaaaagcaagattaccaattcttgttccctttgagggtattgatctctccattatgacctaatacacgcatcggctgtgcacggtcccagctggggaaggtgttcgtggagaaccttgagtgaacctgtttggatgcatgaaacttagtaactgtattatactcaactcttgtaattttacaatgttgaacaaaacttctaaatgaaacaccaacacactgaaaaaactgaagcatcagttgcatagaatttcatgcaaaacagttggaagccctaagctacctcaaaccaaacacaatttcttcccaccacctaattggaggtcacatccagaagagtcggcatagcagtcggccatagcagaactgcagctggactctgcaacatggttatcgggtatcaactaataaagatttctaatacttcacttaaaggcatcaagaaccaggactgaaatatcatatgaatagagcagtgatggtaagacaattcaaagtttgatgcctgcacaggagtcttgatcttacaactgccttgctattattggttcccatccgccgactatggtcatgactttttttgtataagaggatcaaggtattgtatttaccagagccatataacttgtgaagttttcatgacctagatctgcatagtagtaccccttaagttggcatggcttaagctggcccttgtagacaatagtcctggaaatcacaagaaagcaaacattgaattactcacatgaatagaacacaattagaaagttattacactacaggatccttaagagagagctcattgttttttctttctttagtcccatttgaaatagaaaatatttgctgatgatccccccccccaaaaaaaaaaaagaaatgtgaacttgattgggatttgggtatcatcatcgctttcatccttcaacgtaatcaaacacaggaaacatgaaatttggaaaatatttgctgatgatctcttccaaaaaatgaaatgtgtacttgattgggatttgggaatcatcatcctttccatccttcaactcaatcaaacatagagaacttgaaatatggaagaagagagaaaagaggaagaagtaccttgaggagagagaacacatgtagaagtccctctttcctccacgacggagattcagagctgcacggatagatagaatcgagagcctcctcaggatatacaactgtaataattcattacaaatgagttaaatacacagtctactacatacgcattcataaattcaaaatgtaaactcgtggaatgacctgctgctcaaaatcagcctccgaacttgaacttttggtgaggaaaacctgctcaataactggctcagtctggagcgcagattcacctaagtctgagttgtcagtgggaacccggcgccacccaagtattacatgtcccagcgattccgctacctggataaatgaaagtaacagaaaacattagtgtaaatatcacggccatgaattgaaaaaacaaaagaaatgaaaacaactaaccttctgaaactcagctttgctccgctcacggcgcttctcatcgattggcaggaagaccataccgacagcatactcgcctggctgcggtagctcaaacccagcatcctttgtcacctgcaggagtacaaacggtaacagctaagatgaattaactgttaaaacgagctgcctttgccttaaaattttattgagtttctagctcgcctctctgaaaaagttatgcggtagagccacaaggatgccggcaccatcgccagtgttcttctcacagccgcaggcaccacggtgcgccattctctcaagcatctcgagggcgtcattgacctgcagagaagtgaaatcagatcgatatcgcaaaggtgatgttcagaagagagaacctgcagagctaccacctaccgtcgcgcgcttgtaatcgcccgacagctcggcgacgaaaccaacgccgcacgagtcgcgctcgcgcgaggggtcgtacagcccaatgctgctctcggggagcgtcgaaagtggcctgaccggctcggcgtcgcgcgcggcggcgcggggcggccgtgcggcgacgcgctcctcggtgagctggcatccgccgaccaaaccgccctcgatggacacgccgccctgtaccagcctagccgcgcggtaaggcgccgccacggaggagtggctgcgccgagccctgcggccagcgcccgtgggcgccgcgtcggtgcggagcttgtaggccatcccttgcgccgccgacatggctgcacctcacgactctccctctgctacctgtcacgcggcatcaaacgacgagcattagaccgtacttctaccaccaggaagaagaaaacgaacaaaatcccatcacaaaaatacagagcagggaagagaaaaaaaaagtagacaaacgaacagaaaatcctcaaagcaatctccctttcccacatgtcaccaccaaaagcaacgggagggaactcgtgtcatgctgcgatggaacacagcacagcacttgcaatttgcaaaacgagaaaaatacacgcacacagggcaaacggcgacacacgcgggggatgaacagatctaccaacccccacacggcgacgcagattccatccgcccccacacgac

SEQ ID NO: 43815 - DNA, 8288 bp, Oryza sativa
ccaccaccaaccacaacgcacaacccaaccaaacaaagccaaaccgaaccccaaaagccgagcaacttgttttttttttcttttttggaaaaccgtctcccgatcctgtcaagttgggaggacgacgatgaggaagggtgcgtgcggccgagcgggtacctctcgctcttgtagcccggaggtgagaccgacgccgacgccgcgtcccgatcctccccacaccttcgcctcgcggctctcgtccccgagcgcggtttgtgcttcccccttctctcccgcacgcacggcggccttctctaccggcgacgcggcggacggcgtggttggcgaatgaatggatcggttttggggacgaaacggggcgccgcctctctcgcgggtctcttcccgtttcctcctccgagttgagcggcgactagggcactcggcgcctctgcatttatagacaggggaggggggggcaggccaacccatcctctctcctctttcgtcgctcgcgtcgcgtccccacacccgcactatattttagccaccgttttttctcctccgaattcgcctctttttttttccctttgttttcttaacattcgttggttgtaggttgtgacggtatctgcatctctacgggagtattttcgtacgggtccccgacaagatcagaatttggggtccaaagcttaagcccattgtgctgtgctagctggagtacgattgtaagtacaatggaatgaaagaaacacaagattgacgacaaccctactgtaccatggatcagttattacttcaaacattttcttttgttgtctactggagtaataaattggataggagtacttcaaacatttttttgtttggttatatatgcacgtatgactagcaaaagaaaagagaacgtctacatgagaatggtatatcgtaattagttttgtggttcattttactcatggtatattcttactgcatatacactagtagtacaaagaaaaaattaaggagattatcttttacaagcaaggacctacgcgcaatacaacaatggcacggggaccccgacgaaagaatctttttgatcccgaattaaaaacaggaaagcagttgcaattttgcaatcttccgtttccgctgtttttgcaatctctgcccccgcgggccgcggcccccgctactgtccaccgagagaaagagagtgaaaaaaaaaaaacaccgcgagcacgggaccaccgccaggtcagccgcgaccgcgacctgtggtggtggccatggtgggcccaccccgctccgaggagcaaacgacagccgcccgtggcgcgtggggcccaggacgacgcccgatccgacggccagggttcggccggcgcgccgccgccgcgccgacgccgacgcggggagccacagccgattcggagataaccacgccgcgccgttagcttttttaactcgatctccttatctggtactcctacgtaattaaattaaatcaaattaaatctctaatgcgggatttggtttgtaacaaaattccaaaaatcgcgatggattttttgtgtttggcgagtcctacgtgtcgctatcacgtcgggcggccgcggcggaggcggagagagaggcgcgaggcggcgagcgggtgggggcgtgacagtgtgcagaaggcggacgggcccaggcgcagcgagggtagggccccgcgtgccagtctgccagacggcgaggcggtgaggtgctttctggggaaagcttcttctgcacgtgttcgtcgcccacgccaacgagggacggattcgatagatcctggattaaaatgctacacgcacaggtttaacttttaacggtagagaaggaatactattatcggtaaggattactcttatttctttttacattcttatccttgcaatacccttctttacctatatcaaaatttcatatattagaggactactccctccatctacttttgatagtcatatttccaaatctgaaaattttatttttgatagacatatttcaatccaacaacttatcatcttaatgactttcttggatttaatgcatgactcttcattcttctacacatgattggctacatgggcattgagaaatataaatattaatgaatcgcttgtttacgaggaatgactagtagcatatttaaatagatgataagtagaattacttatcattggcctgtgtgccaagatgaaatatgattatcaaaagtagatggagggagtagtacattagtattactttagtacaactgttacagtatgtgcagcaacttatattttgtaataaagggaatattaattagttgttttgtttctatactaatgtgttactgatattataataatcattttattttgagataaagaaactatatcagtatatcaatctttaattaacatgttttatataaaagacacgaacattagaaaaggacctaatatcaaataactagaaggtgtggggcttcgaacctaagtcatttagcacaccaccttgtgaagctagctggaagacccctgggtgtttctcattaacatgttttattatagtttgttattatcggtccatgttttatttaccgaggacatttttagttattttatatgaacaatatttatagctagtattgtcatgagaattatacacaccccaccacctaagttagaggtatttattgaactcaaactattaaacttgcccagccatcgtactccttctgtcccataaaaagttaaattctaaggatgaatctagacatatacaatatccatattcatcctaaagatttgttttctatgggagagggagtgtatatgataataaaactactactcgtagtcaatatgaccatgctatgtcatgcgatcagaaacattatgttatagctagcatgctcatatccacttctaaaatggtgaaagtcaaatgatagttttccaccatcagcgtttgatggatcaagagaagttatagtatattcaaggtaaactagtgaatatggatgtgaagaccatataaataagttactagtgctagtaatatatttaacatcactggcctcgtcgccatggccaaaagaaatctgagaaaccaatcgttgaagtgttgcgcactgcatacctcatcaattaagattagaatcttgtccaccatccctattttagtggattacttctcgttcaaaattagcttatcctgacaagctgtaaaccaagattagcaccgctaaaagtaaaagatccaagtggaaagctgtcccaagttaaaaggacaacatattaatgcaagtgtggaaattggtgcatatatattctattgcaaaatactcctagtactccctccatatccctaatcatcttcattttttcgagccatcgaaaccagtactccctccatctacttttaatagtcatattttatctcggcacacagaccaaggataagtaattttacttatcatctatttaaacatgctactagtcattccttgtaaacaagcgatttattaatatttacatttctcaatgctcatatagtcaatcatgtgtagaagaatggagagtcatgcattaaattcgagaaagtcattaagatgataggttgttgaattgaaatatgcctatcaaaaataaaattttcagatttggaaatatgactatcaaaagtagacggagggagtactacttagtgttattcttcttttttttctgtattaataaaaaataaaagtagctttgtacaagataggactataggagtgtcttgcttaatttgccttttgctagtactcctatttttttaggactgtaggagtagttcccttgtctgtattttcatagaagtttaattttcgatgaatctgcttgaactgttgaacatgaatcccgttgctaacatccaaggtttccttgggagatgtatcacatggtcgtcgtatattagttgcatgactctttagagcaggtataatagtactgactcagccggcgatagtaatcaccacatcagcattatcatacgttgaggagggaaaaagcatgagagagagagaagcgagcgcttctccaagcaccagacgatagcacgataaattaggcaagataaaatattttattcgctttgtgggtctatagttcagttacttgatcttatgtgcatatgcatactgtgtggtttcaagtactaatttagtttcatgctgaagcaggacgggctacagagatggagtttagttttgatcacctgtacatgcaacaattaaacctattcttgtatccgtaaagaccatctagaaccaatcttttatataaacaatctacaatattaactttagatgacctagacatatactaccgccgactactactttcactattagccttgctcttatcagaccgtccaaaactttacactactgtatctgattggctcttgagctgtgacttgggggcgttggcaaggggaacatggcatggcatggacctcctgggcccacaaatagctgggtcccacgtagtaacgcggcagcttgctgcattgccacggatttgcacttccctgcagtcctccaccaccatggggcccatgccgacgcgacgcatgagcattttgggaaaaaagggcacatagttgaccacggaagcgatgcgcacagtggcaccgggagatgcgctcacacgtgacgccctcctgccttgtctgatccccttttcccttcttcctctcggtttcttcacgaggctctgtccatctgcctacaagcccaggcgccacgtccagatgcaaatatactcatgtcgtattaatcatttatttcttttacccaaactgaactacagttctaaccatcccttatttaattgaaatacatataggacctgttctgctatgtttagcagctgcgcagttgcagctagctaaaaaaaatactctagatgttggctgcaacacagtaaaaatgagtgcagtcgaatctatatagactatttgccctctctactaatttatgttttatgtgctaaaaatatactaaaagagtaaatgatttcaacgctatctaaaactaaccagagtagattggactgatgaaaaaatgaattcgaaagatggagtagggttggagccattccgcaactctccttgagacttcgctagttagattcaagtgtttgagttattggtggaaaatatttttcgttttactttgtgaagctctcgtcgaaattttcataggagtacgttttctcggggaactccaaacaaacggggctgaacacttgttcgacagatccaatgagcagtttgtagatttatttgtagggaggtgtcattactgattgagcattcccatgcttatcaagcaattctctaattcctcgggtatttccaaagtttgccgattttcaaggcgagtgctcagcctaggcttcacatggcatcgtggggcatcccgcatcccattagccaaatggagcggccatcaaactattttaactccacggtcggagtaacacatgttgcgtggcacgcttggtgaatactacgtccatctcgtatctaccacacgggttagaaaaatgtattgtaccggctcatgtctaacaagttaaaataagtaactctactcattctttttcaagtaaaattatgtgtaaaaagctctaacattggtcgctaattttagtaatacacttttatattttttttaactatcgtggtaaagaaaaaattacgaatacataaaacataataatacttccttacacacccacaattatttatatttttaaaatagagagagtatatgacatggagtaaattttgaagttatgactggttttatataaggcaaattttgctataggacactcaaaatttgtttattttgatggtagagatcgtaaaaatatgctagagatcgtaaaaatatgcgacggctgaaagatactctagaaaattggtaatttgctgaaggacacttctagctcaatcggagagacaaattcttcaaaaagacgggaatgacatttgggtctaaagctttttgagcccagactatagtgaaaatgaaacatgatgtatgctaatgatgtacttgaggctataacaaatttagagttgcataatttctaaattgttttactctaacaccatgctttaagcatgtggtcagaggggcattatcgtcttttttaagaatttatctctccaatagagtcgaaagtgtcctctatcaaattaccacctttttaaatgttttttagccgtgacacatttttcaatgtttgtcggcaaattacataaattttactcactccatctacttttgatagtcatatttcatcttgacacacagaccaagaataagtgattctacttattctccatttaaatatgctactagttattctacgtaaacaagcgatttattaatatttacatttctcgatgcccatgtagccaatctagtatagaagaatagagagtcacgcattaaatccaagattgttggattgaaatatgcctatcaaaaataaatttttcagatttagaaatatgactgaagaatagagagtcacacattaaatccaaaaaaaccattaagatgataatttgttggattaaaatatgcctatcaaaaataaatttttcagatttagaaatattactatcaaaagtaatcaaaagtaaatagtaaatagagggagtatgtgtcatgtaacaaaacttaacgtatactccacccactgtagtagtgggggacaaccgggaattcttgatggacccaccacagcacgtccaatcgcctccctccacatgcacctggggggaccaatcattgcgccctacaagttggtgagaaaaaaagaaatgcgaaaaagaaagcaaacacgcagcgtggggcccaggtgcttactcctacccctccctacgtgcttatataagcacacgtgtttatcagtatatatgccccccgctttatctatcctagtggaatcttatttcccgcgattacttatatatgcacaggaaaagagagaaattgatgcaggaaggaaggaaatacaggtttttgtttcattcatttgctgctgcatctgcctgcacggttgttcgttgcggagatggccgtgataaagattcttcaaacacctgtcactcccaccgcccgtgacgtgcaccgctgcacgtggtctgcagttgttgctctagacccacttggcaattttgctggggacaccccggaatggggtcaagtgaggactggccgagagaacatggagtcgtcttatccttctgtacatttttatatgcaagttattttagatcctcttgatttgaaaatgccgtaattaggcaaagtcatttacttttttttaaaattacatggtacaacacagacactcacaacgcacgcacactcatccctataaacacacgcacgcaaaaaccctacccctataagcatcttcgaagactgggacaataaatcctggagattgacgaagtcaccacagcatcttgctgtcgatgggtacgttgcctaccactaaaagcacaataccgataaattctaaaaaattcgctacttcttcttcttacttaatggtataattaaattatttatatttaaaatcagagaagatattgacatcttctacgtcttgccgcgaggccatgtatagctgccatgtctgtttaaaagctcaatattttataccactagtctttgtgttttttaaacgtgtgttagaagcacaatataaaaaaactaaaaagtttcataatcttatatggagtactatatgagtaaataaggtagtttgtgggtatttgggctatttgagaaaatgggataccgcatcatatatagctgatgcttgccaccaaattagactagctagtacaaatgtttgacaaaaggtaggtttgatttcagcattgcaaccacttggggctaccttggcggcctcaatcatatgttaggtggtcgacaactaacgcgccatgtatggtcgatcagttcgttggttctttgagaaaacattgaagaagttcaattgtggggtcaagaggtatcccacctaccgcgaagagggaaacatcaaaccattcgttgctactacctctagcccccccacaaaaaaggacaaaataagtagagataaattatttggcacgatatctttgtgaagtccaaagtttcattggatacataaaaactgaacggcatttaaataatggatgcgagtacaggctgcgcttcatgcaagtatgca

SEQ ID NO: 43816 - DNA, 87139 bp, Oryza sativa
aacatttgatcaatgtgcagaccagccacattgtcagatcactcatcgttgtacatctggttgttatcatgtcactttccgttaagaggttttggctgaatcaatgccacctgccatccatgatctccaggcatgtcatggtgtgtgggggaatctcgagctaggcaagataccatgtcgtcatcccaccgatcaacaatctagaatcttcattttaggctacaaggcgaaaaccacaaaaattgtataggtaactatacaatattttaccacagtaacttttttttctgcgaaaaaaagagactaagataccatatatcccccataaaacaattaatttaagtgctatgttcataacaaagtacatttatcataattgcttaaatcttactcctaaaatggtgggagtaatttttttcggtccctcttcaagtaactatgagtaaaactagaaattttttcccagaaaatgtcaagaatgggaaacggacctcaaatcaaatcaagtgtggtccttgacatgcatgttccctgttcattagtgaggacaccgaccctacgacggaaaggagtaggtagaagaaaacaacatcccgagaaaatgcctccccggagactccccaaaagcaatgcgcactttagcgctttgagagtccccacatgataaggagatctacgaattgatgcttgatcgatctctctttgccttaaattagcttcatttaactcgccacctctcgtgtttcaggcttccggttattattcccgacaccatcacacaaaaaggctaaagcactcgccagatttcaggagtagtagaatttaataattttttgctgcatgatttggagaattagtcccctagcatctttgtgttttgtatacttgtgtggccagagagtaatcgccatgaaagcagtaagattttttgcattactacttttaattattcagtccttgccttgcaagtctggatcttctttttgtaccgcatcatttttttttattttttttgctttccgctgatgctttgatgttgatgcctatcaacccacttgacacttgaaaatgcgccttgctatctttgagctcctaaagaaacgtgcaatcgagaaagaatcttgaagaagaaatgatcgagttgcctggccaaaattttacataaaacaattcaattcgtgtaagaaccagggaaaaaaaaggtgtatgctctacatttattcaagacagtgaaagtacatgcctctacatggggcataatattgttttctgtcgcggttagaatactggaatttgaataattatgtcctcgatcttgtacttacataggagaagcaagattcgaaatgaccacccagactaaacatcatatgtccctttgtgctttgcattatttttgctagtattggattggtcagaagtggataggtaggatgggtttatcagcttctgagatgtgatgcagctgatctcttcatgacttggcccagttacattgtactactgtgatgtaggagtactgtgtgataagggagtggaccaactgacagtaacatgatgataatccattgcctgtatcgtttccgggatgaaacagaacaccttgtatcttctgctgcagctatggatgctctctttcaggaaggaatcgtgctagtgtttgtgtgttggacatagcaggagaatttatgatatcaggttgctcaagttgggatcggcaagtggcaacagctagagcaatcagagttacaggtgcaaggcaagaagctagtagtacctaactttgctagaccatttgggacattgactgggatcagattaagcaaaagaactactataatttttttcaaaaaggagctgaaagtttgcttgtcaagcatggaagccattgctttctgcagttttctttcgttttcccaatggttcagagctctgttcccttcttgccttgattaagaaataaagcatactactccatattataaggagcaaggtttctcgcatgtcttgattaagaacagtaaaatttctgggaaactgtagagaagactccaaattgttgaggtcagatatagctgtggccttgcagcaaagtcgcaccaacagtagtagaagactattacaaatcatatactacaccactagtgtggttcagtcatgcatgtgactgttgcattcactggattgaaaggaggagagcaacacaagccatttttaatcttaagagccagaagtaaaccctccttctggctgacatttttattttgccatggaacagctaggcttagctgcaaggttgcagttctcatatatttttgtaaactatatattaatgcctgagccgtttgccttagaatattttgtaatgctaactgtcaaccaggtgataaattatacaatattctctgagattctactaaatgattatgcaagatgagattctgtttgattttttaatgtacagtttaggaagggtctgcatcctttggaggcagccaaggtacaacaagcagcaagacagaagcaaacaatttcttctttcacattaataaaaaagcagtactaccttccaacttcatgacatacaacttgagagaaaaaaaaatctaaatagaagagagttggaaactgcctatgacctcatgaactgctacatgcattacaaaaacaaaaacaaaaggcaagtcagacttagcaagccatgagataaagataccctgaatcctctctgttttcttcagattattgagcaaacaaacaagtccatattctctttaagccctgatttattattgcctcacggcctcgacttgcctcatctagaacaagaaattaaaaagaggctattactttaagccgaaaccaaacggcaaatcgatcacgaaaccaccaattatacaacggaccctgcagctggttcggagctaggccccccaagaaaaattcaaagaaaacatgcatgcagcctcatcctcacatgccactcgaccaaagatccaaatgaaaaatccaacttgatttggcgcattgccatgcattttcttatactgccaaggccggtcaagagcgagctagccatgcgagcgtgaggtccagtcatccagcattagccggccggccggccgctttcctttatcgtttctctaaatacgtcgtcgaattgcctcatcccaataaacatttgcacggttgcggcgtcgtttctgccacaaaaccaaaaaaggaaaaaaaaagaaagaagttttcaaaaaggaaatggagtcgtcgtcggcgttggaattatattttctttgggagcaggagaacttagagaggtgtgcaataccacccctcagttgcttacgacttattataaaccgtaatggttttttagcgaaaaaaaattacaagtaaaatttttatatatgtattcttaacgacttaaaaatccaatgtttaaaagaatacgttgaaaaaaaatcaaaatcaatggcatcttttttatatatgttcttaacttcaaaaacaatgttttaaattttaaattttagtattgatttgtaagtcacagggcacatattaaggcccgcaaaatggcttctttttgcttttgatttctggtgcgtggtcagcttcgcatgcagaatcatgggcaggcagcacgcaggacggggatgttttccggtgtgctgcgattaattcagtgtgcgtggcgtacagagaagtcagggtcagaacgaactcggagtctggaaggcagaaggcgtttgcttttcaacttctgcttgagctgtttagcctcttttccgttccttgcaactagaacacctcatttccacgcgctgatgcacgcagccacctacggtagggccgttgcccatatcttctccaggggacatgacaggccaggggacatgccatctacaggagcagagtgatgatgttttctgttattatctgctctagatgcaatgcaagaattgtcttcccggtgatgtatatattcagagaatgatttcatttgaggtactctatccgtttcaaaatataacaacctatatcgtaaatctaaacatttcataggatagttctaggggaaaaaaatcaatttcaagcttcaatccatcagggttaagaacaggagatttttttttctgtgtttggatatttgatttctggttatctagagaagttgactttgctctagagaaaagctcacacattttcgcgaggatatacggcgctgtggaccagggcgatgggaattttgatcttgacataaccaacgtgagaacgactcttctgttttccattggataaataaatgcctgcactcagtgtccatttcaagatatgtcactgtacacgaataaattacaatgtggcaatcgaattgaccgatcaacatgtactacagctatgtttagtttagcgcaaagtttaaattttggttaaaattggagatgatatgactgaaaagttgtgtgtgtatgacaggttgatgtgatgaaaaaggactgaagtttggatccaaactttggatttaaacacagcctacatatgtgcgtactgtagctataccatactgtatctgcgcccatacacagcttgtggctgtgtttagttcagcgtaagattttggttaaaattagagatgatgtgactgaaaaattgtgtgtatgacaggttgatgtgatgaaaaatgactgaagtttggaccccaaactttgaatctaaacagagtctgtgtataaatcggagcgaggcacaacttcgtatgctcgtaactggtgggcaccaaaataaaagctagaagccgtgcattttacctaacttcacaccagtgattgattccaatgtcaacttcaagagatgtcacgttgctattcgcatgacggagtggggggcagtagtaggcttttactgctgaaccgacacaattgagttctggtgaggtgcaatttaactgtgatcaatgatcgatcagagttcggggtttctacaaagccaaacgccaagggtccacgctagaaagaggttcagcgccggacaaaaacagttcgatccaacagctctcagtttggaagctgtagcacttgcagtcgtaaaataggtgaaatatcagtgtgtgcaataataacactgcctgtctctgccccctgaacctgacgtgcttgcactgcaggcagtaccactatagtgtactaggagtacgtttcttgaattgatttcctcggatcaagagacgcacatatcgcaggtttcaaggtggtacggtgagagtacgcgtatatctttcgctgatgcgatgattgcagcggaagatctcaagataagaaatcaacaagcgttctatctcgatcgcctggaaaactgctactgacaactcctccacgggtgagtgagaaacggagaatgtgagatccgagggcgagatttgtttaagttgtacacttggcaaattaacaacaaacaaacaaacaaggtggggtcaaagttttctcaaccctcacacgctcctactcgatctcttccatcgcgttccactgggaatttgggatggatatataatgacgtcgtcgcggctcggcaatggccacgaggccaaccaacgcataagttccaagcttccaatttcccgctgcattcctgcagccgccgcccacgggaacagccgagccggtcccgttcgcccatccgtacgtcaccccgtcgcgctcgcgcatcgcacgcacccacccgtcgtcgcgcgcgtcaccgtacgccgcttctgtcgccatggcctcctgtgagcgaggcgtcaaacgtggtacacgcccaggtagggagcagaggagaggagaggaggggacaccaacattggccgcggccgcagcggcgagtggagggatgagcgacccgcggcgtcgcccaaggggcgcgcgtcccctccgcatgcatggcggccgccgggcgaggcgatcgcgcatgcacgtccttgcatggcggacggggcctaccgccactagcggggaggacacaataatgcgagctcgatctatcgctatagattacggactagtggtaggataggtgaattctgttgcagattaatctactatagtatagtccttggcacaatttgagttcatgataggctattaggctgtgacgatgtgttccttttagattcgacgtagatggacaaaaaggtctgtcaggtgttgaccatttacgtcacgactatgaaaatggcttctggcgagcggagagagcatttggcctgagatatttttagcctagcaatctagcatggtgccaaacggagttgatgagcctagcgaactgtacgagactgacgccccttttcttcacaggaaagacatgtcaaggaaaaaaaacaaaacaaaacaagaaagagtaggataatcgaggtatcaaactaaaccgagcccactagcccaccaagcccaagccgggcccagccttgcttgggctcacccgtaatcctttccccagtcccagacggaccaggccgcctggcccaccccactgctttggtctggtctgtgcttcaatcatcgtgcacatgtctagcacacttcatatgcacttcaagcacataatattcacatttccaaccaaaaggcctatgcacggagcacattcaacctgaatggcatcacctatcaacctgtggcattccaagccactgcatgtccacaagaaaggatgtatgtagtagtagtaaatactggagtggtacaaaatggccacattcacgttccaccagcttttctacaactagccaagagcccgtagacaaactaagtttctaacttattaaatcaattaataagcatatatttagtctaagtagtattatgattttccttattgaacaagtaggtagattagggaagttctattgattgctgctttctccagaccgccggaaaaagcatgaaagaaaaggctcgaattgtacgatccctccgtcacttagattgaaaggggtgatctttttttccgaatgagaaagcctttggccttgcaaatccgtttttgccgggcacaatagacatatctgctcagtcacaacataaggaacccccaatgttccgataagcctacccggcctgacagctttagttgaatgatctgatcccgaagctaatttgagaaggagtcaatagtttcgttcaaagaagagtcaatagtgaaacaggaaaggacacgttaaagggtatagattatgggtactaaatgtcagtggtttgagtagtgtgacacaacaaacaccaccactatagtatacataagcaggctttactatcccatccgtgcttcttccaaaagaaacatcaaaaatacatcgatgtttctaagctgctagtcctgcatacaaaactaagttgctgctttcaagatgttggcaaccaaagcacacccaaaatcaggaatatctattacagacttgcagtgttctctaacctcaaagcaatgcgtgaccaaacaaacgctactcctgcttcatctttgattcaggctggtagcatggatgcagcaacacatggatgcacaagagccagcagggaagatggacaagaaatacatacagatatgtcgcgctgctccattcccacaagaactccatccacagccagaaatcaccaacaatgtctactgtccatgatcccttggatagacctttcatgataagaaatgcagctggagggaaacccaagacggtgagaagtatgtttgaggccaacaatactgtgcgaggtaggaaattcatctcgagctgtgccctcagcggtcgagaaaacaagcacattgggatcaatatcagagccccaagctgagcagtagcaaaatttatgatcgacataagccccattcctatggtgatggaagtgatcatcgtagcttttagaagcttccattccacaccagcacgggatggagagccaaacattgcatacaggatgatcaatatagtgatggagagaacggcccaaatcactgcatactgtattggcatagcaccaggaatttggctaatgtagtatgggagtaaagaaacaagtactgcccaaaattggatgataagtagtactcttgcagatttaagccatttccacgatccaccctccatttgcaggtcatcagcattaccctttgttttacattcatcctccaatttccccttggttttactaccaccagcaagagcagcagcaactattgggaggggtgccaggagtaatgcaaacggaatcatatatacaccaactgaaatgaacttgcttggggctgtaaggaaatacaggaaaaacgattgatggaacttctcgagcaggttatttacagagcgcaccaccccttcagttaacctgaacaaaaggcattctcaaacatgtttagataatcttgtggtgagatcaacataaatgctgtgctaagcatctgctctacaaaatgcagcaggtgtattttactcaaaaataaagtgaaccctttaatatgataagtcagaggtcttgtgatcctgctcctttgttaagttcagtccaaaacttcatcaatttgggggaaacgccaatataccattgcccgcccccttatcgccctatatgaaaataccgtgtgttgcgacaatgacaggtgatgtcgggtatggcatgtcattgacacacactggtgtttttggcaaacttggattcaggcaaaggcaacagtacccttcccttatcgtttccattttttttcttgaaataagttaaattgtatgttctatcattggataagatcacagtatgctaatgccattagcaaatcctactatggaataatccagacacacatactgacataaggacagacctagcaaatttttgactgttatgaggctgacatgcaatcagacctctcaccagaataattccgcacaagaatatgcaaggttaacaggccaaggcagttacagaattattttataatcagccttttgttgcctgagattatacagctttagcatcgaacatgtgctttaatgctcactaatagtatattttgacaataaaattaattgagcatcacaaagcaattagatatatgaaattaggtaatgtttgacaaagctgaattactttggttatcagagagaaatacatacatacaaatggcacaagctagagtttgtttaaaaccttcagtatgtattcagttttctggtatctgacaatcaaacacttttgaataggtaaacatgcactctaattaagtaatgaactgcttaatgcatgtcaacaatacctacttggcaacatatcctatgcacacaggccctcacgtgtacacacgtgtataccaactaaaaaatgtcaccaaaaaatctagaaaaaatcatacccatactttcaattgtattacacctagggttaaaatcttaacgtcaaattcattatattttagccgtaacaaaaaatctgacagttttaaggttgtaattttgtcagaattttatcttttttgttattctctatgtagaatgaatttgaagatgcgactttgcacgtagatgtaatactattgaaagtacatgtatgaattttcctagaattttttgtgataatttttagttggtgtacacggtgtgtacacgcgagggcctgtgtgcataggatacgctccctacctacttgctctaaaaaagagcagcttaaaataacacaaccgtaacacaatagaaactgaccttccacccctgagaagaaatgaagatttagcattctcgtttttaagatgaaatgctggtgcaaattctaaagaaactgcatcaacttgatagtcacggaaagcaccatgagaacctgtgggcactccaagagcctgcagttgcaaagccaaacaagaagggattaacagagttgaaaaaacttatatttttatagaccaaatggaaatgaatgaacaatatatatttcaattacctggttatacatagaactagcaaggtttgcagtaccctccacataatcaggaacggtcacgtcaagcttccagtcaggatttatttttctcaacaaactcccaagattttgaaatacttcagcaataaccctaagccatgaagagctcaacaaggaattaaatgtctcgacattcacgcgaaaaccttgtctatgaacagctaaatagtgcaccacattcagaaggtccaagtttggcatttggccattagatgcctctgcatacatcgtgacactatctctatcaccatatttcctggtttctccaactttaaatatgagtgcagcagccattgttccagcacgtttgaaagccataagttctgccttttctgcagtgccatcaggtttatataaaatttgatttgcaccatagatcttggtatccaaattcactgggtgactcagaaacataggattatgatactgatttaaccatgaagagaccgcagagtactctccaaattgtgagtctgcagacagccagacaatatcctttgatagccatgcagctcgacttaggagggagaagacagagaatccaagtgcaagtgataataattcatttggtgtaactttctgagaattataaggagtaaccagtacaattgcttctttgccatcacctcgtggagcccgtataatgccaactgtgttaatgccaaagttggtgtaggttccattgggtttggctgccatattatttgtcatggatgtaaagaacttcagaggatgaaaacatttgctgtcagggaggaactcatggtaatacacttctgctcccagattttttgtttgttgtgctatgaattttgggatctccctacaataatgcataaaattagacattgagaaaatcatataaacttacaagctatggaaaacataggattataccacttgttccttcacttcttgtaatttattatcacttattcaatgtgcagagtatcatcatcattgcacaaacttataatttacttttagattaatatttcataagcaaaaatgtagaagttatatttacatgtgtgtctcaataggaaaggacatgacggtgcttgatgatgctctgaacttatgcgcagcatccaccattctactcatgtgctagggtttccactcaagtgcatgtatggtgtgcgcttgtgcatctacattgttttctcataaaaaacctgaactttgtatatctctgacttttattttatcattcgtttgttactacccatgaaaaaacttctttgcgtttagagttatgtggataccatgtctatgctcaatagtataactaaaatgcggtattaaggatgtatttcatcagaggaagccccttaacagtagactcaaaatagagcatcacatgataattaaacattatgtacacagtgcaatttttgttaaagcccattgtctatgaaggaagcagaatatgaaccaagggaactctatacagaataacatacgttgttccacctcttgattccccaattgcagcttcaattcccttcgcaaatctgtttgcttcctggacatcctcagtagaaaataatgtattcgcagagcctacattttaaaacaacttaatttgcagctaataccaatgagaaagaagcgtctgacaatcagcatcggagatgattgtttcatggaatagcagtataagaaaaaagcttaccgggtataagagcgttctctgataggtacgtgttcttggcaagcgaagggaggaagaggagcgcgattatgcccgccgtacaacacacagcgctggtcacagagggtgaacaatgtcaatgtctcagacagaaagaaacaggagaatcaagattggatcaaagacgaagagatgagagcgaacctgaagagtatgtggtgcgacgcgaggaataccccgaggcggacaatgaggcgcggcttcggttttgcctcctccttagctgacgacgccatggcagcaacttggttcaggtctggagaccgggagactaatcttggagcggcacagatcctgtctaccctcgccgcgcggggcaggatcccatcaaaaactgccacagagctggacctccgcctccgcgtgagcttccacaagtagatatgccgatggagagcagcgggagcgggagccaccagcggttctcccggctggggaagggatgcggctccggcgaagtggcttggtgggcaagacgagcggatgcggcgtggccagggctccgcggcggcggaggcggaggaggagagaaggcgagcgaagcgggcggcgaggggaagctgctccgtcctacctgctcgccggaggtgggcggggggtgccggcgagtggtcgccggtgggtcgccgcctcgctggagatcgcggcgaaccggcgagtgaaggagatgggggaggggcaggcctggccgcgggccgtcagaagtaaatgggtccagagagaaaccggctcgtggacgggcagctcggcccacctaaggcccacgagtcaagcgaaatatttatccttcttttttctaaaattaaagttttcatgactggcaaaaacccacaaaataattttgggtactaatatttatcgactgaaaatttttcacctgctgtattgtttttccacgcttgtaatggttacctctcgttcacgattgctcgttgttggattttcgttaatgatggagaagaggtgcaaagtagaggaggataaggagtacacacgactccgtggtggccaaggaggccggccttgttgagctatcggagaccttgaagagtttgtgtcacctcatcgacacttgctctctctattgtcaatgtgtcacgctggactttcccacagaaagccaaaagagtcaggacatctttccctcctaactgattggcttatttctcctcttcttttaacccatcgtctcataattatgtctctcaatttcgaagggaggagtgctgtagctactctctccatctaattttgatagtcatatttcatcttggtgcacagaccaacgataagtgattctacttatcatccatttaaatatgctactagtcattcctcataaacaagcgatttattaatatttactccctccgtactcgtaaaggaagtcgtttaggacagcgacacggtcttcaaaacacaactttgacttcttgtttctataaaaatatttattgaaaagtgatatatgtatacttttatgaaagtatttttcaagtcaaatctattcatataatttttgtattttcaaaatcaacaacttgagagttattaatgatttatatttccaaggtttgacttaaacattgtcctaaacgacttactttatgagtatggagggagtacatttctcgatacccatgtagccaatcttgtgtggatgaatggagagtcacgcattaaattcaaaaaaatcattaagatgataagttgttagattgaaatatgcctatcaaaaataaatttttcagatttggaaatatgactatcacaaatagatggagggagtattaattatagataaatgaaacgggtaggatgcatggattgttaatcaatgggtgcattatattggctcctcgaattttgctatagctagctcaaattttgaacacagatcaattaaaaaaactaaatggtgaaaaagaatattgtgcctagtcgtactcatcgtgatgaagtttgtccgttgtgttttgtacgtgcctatgacatttttgttcgtttgtccgttgtttggttgcataggagatcaaataaattttactccgtgttagatccctcgtctcttgatatttgacaatttcatccatgaactgagatacagatatgtttttttttcgaggtttagataatatatacaacaagattccccccaaaaaaaaagatatacgactagattggccaataataattttccaagcacgagaaaacaaacgtgactacacagctagtggctaccactctatttataaagagaccatatccacctatacttcaaataaaattttatcttaaattactcatacgatctacgatccgattacaccgttgtgttcgtaacaattaaatctttataacaagatctcacatgattatattttgaggaaaaattataaattacttttataatatatctaaattacttttagatttcactaaattacttcttcgatatacaaaagtaaattcaataaagcttaaaagtaatttacatatattatagaagtaacttataaaaaaagaaagtaactttaatgcatgtattttttcattggatatgactgcttgtttgtactccaatagtatatatcttttttaatctctttaataacttatatcttttaaatcacatattgtttttaagatctatttgcatcattgtactccactcaaaatatgtgacaaaataatattcatattgaatatattctcattttattaatttaaaagtaatttattacatgttagaaagtaacttccatgttataagattatatcttatacatggttaattcttatgatttattctatcagtgttatttacaatccatcaaaggtttttatcttcttttttcatcctacatgaaaaacaaaaataaaaggaaaaaaacaatcggtgattaaacatatgtatagagagttacttctaaaccagaactatgcaaaagttaattccaattaacattgaagttactttttaaaattgttaaacttacgtgtgttgatctgtgctgattaaatttaatatctagataaagtcatatttttatccctacaacgaatctacttctaatgtcgtgacaaagttacttccgttttgtttttagatatttttataatatatatgtaaattatttttagactttattaaatttacttttatatgtctaagaagtaacttagtcaaatataaaagtaacttatatatacgataaaagtaacttacacatataataaaagtaatttacaaatataaatattttttcattgtaatataatcgtgtaagatcttattgtgaagatttaattgtaacgaagacaatagtgtaattggattgtagatcggataggtaatttgagataaaactttataaaaaggaagaaaaagacatgcatgtctaagaggaaaaacagcatatacgctaacacgtgtagcagtactttttctcataattgtttcgtcgctggttagcactaaatcgagagactactcggtttagattttgctgaaaacaaaaggcaaagaagactgggatgaacatgggcctttttacgctttgacttcaaaggtagcccaggagaagcccgataatagtcaggcgaactgccgattgccgaagggtctctcacactctcacagcagcatcgcacggtcgcgcagaatgggcagaagagaagatgtcgtcgaagtcgaagccaaccaaaactgtgccgccggctgctcggctgcgtacgtgcacggcgcacctgcgaatgatctggccaccgccaccgagcggcgcgcggtttgacccttgacagcctcagcccgcgtctcggctctcgagcctcgcgaggagaaagcgaccggccgcgtgccgccgtgcaggagctgcatcgagaggctccctgcactccgcgcccaatcctgaaaaatcccctccgcccgccccgcctccaccccacgtcctcctcctccccagcagtcccacccgcgcacgcacgtcgatccgggagagagagagagagcgcgatgacgccgctccacgccgccccgcaccatgccgcggccgcggccgcggtcgtctcctcgccctcatccgcgccgctcctcctccgcgccaagccttaccaccccaaggcggcggcttgctccttcaccgtgaccgccaccactccgtcgaggaaaggttagcaactcagacatcattagaaaaaaaaaaaaccatctaatatctgcgtgcgtgcgtacgacgagaggtcacggcggcgcactgtggcaaccaactaggagtactttggctcgtctgcgctggtctgtgccgctgtgcgcgcactgtttctcttctcttgtttattgcttgcttggccttttccgtgctcgcgtaagcggataagggtcgtgtgccatggtgttttgcaagcgtacacctgcccctgcgtctgactcgacgagccgtttctttatcctttttttttttagctgcagagagcaatgtttgatcatccatataaaactctcgcgcatccgtttttctctctcttgctggggtcaagaggtcaatacacagttcggtccttcaaagatttggtcctttttgctatagtttagatcgtcgatttctcaggttcttgacaccgcatggatggtaggatcaagaaaggcatcgccgcgcaagtcacgattcctctcgccattttaactgatcgccctgtttctttctttgcgccagctttcctgtcgtgcccggatcacggccaggcggcggcgggggcggcgccgccgcgctccgccccggcgtcgtcgccggcgctcatctcctccgtccaggacctgtacgacttcatctgcagcggcccgctcgtggacaggatcgggtacaccaaggagaagatcgccggctccatcgaccggtggctgcgctgcggtgtgcaggtggcccggctgttccgcctcaacgagctccacctctcggaggcggagaaggccaggatataccacttctacatccccgtcttcctctggtgcgaggaccaggtcacggagcacagggccaagtacaaggacggcgacgagatccctccattagtggtatgcacatgaaacatttttctctttatcatagaagaagctgatgaaatctgacatgtagctttgtccactagtgcctgatagcatccattccaaacctctcatggcatgttccatcaggtggacatagcagaacatattcctctgcattatgagtacatcgcacaaaatatttcatcatgaagcatctattgctttaatcagcatgacacgcactcatggatcgttttatcacgaagggatatattaattataccgaaatgggaactgtgaatatcaagtcacaagaacggacaagtctttatctgattctaattcacattttgtaaatgaatcgtctttgtgtgatgtagattggggtcagcgctccccaaggcagtggaaagacaactcttgttttcgcacttgattatctttttcgggttgctggtaggtgagttcttcttgtcattctagtcatgttatgtttacccgtatcaatgaaatttaaaagacaagacttttccgtgccttaggaatgccgctacattatctatcgatgacttctacttgacggcagcagaacaggtgtgagtcttcaaatattgtgcaattatccgttctgttttactactccaagtacttggcaaattagtgaaaacaattaatgaatatttccagggtaaattgagggaaagaaatcctggaaatgctcttttggaggtacaaagaacaccccagatccaatatacactgttttggttcaagtattgtattgtgaactgagagtaaataaccaaaactttacagcttcgtggaaatgctggaagccatgatctcccgttctcagttgaaacacttgaatcgctgcttaaactaactaaagaaggtactgatttttgacaagtatatatatcctcttcagaccaattttattatatttgaacagccttgcacatagtatattttttattttggagaatttattgaaatgatatgcatcctagtttcaatgtaaaatagtttgtcactgatattacaatatatttaggtttgaagatgaagcttccacggtatgacaaggtaaaaggttgcagttatcgtcgcctagatgatttttataattgagtagctgcatgatacatgtcacatgtccatgtagtctgcttttggtggaagaggtgatcgggctgatccttcaacatggccagaggttgaagggcccttagaggtaagctcatgttgagctgtagggctttttgagatgagaaaattgtaatttttgaacattttctatgtctgttttctctgtcctaggttgttctttttgaaggatggatgcttggattcaaacctcttccaaatgaagttgtaaaagcagtggaccctcaggcgggtttccgatattaccacattatctgatttctttgtttctcttttacttaatatgacttgccttttttcatcttcagcttgaggtggttaataagaaccttgaggcatactacgatgcatgggacaggttcattgggtcatggatggtcataaaaataaaggaacctagttgcgtgtaccagtggagactgcaggtcattaccagatttatctaagtaactaatggtgtcagaaaatgcacaaccatgaattgcaattttcttatgttatttggatttacaggcagagatagctatgagagcagatgggaaaccaggaatgtctgatgaggaggtttgtttctcacatagctatgcattcattataacatcctattggcttcctttccgtcctagtttgataatttgctaatgccttgctgttactaaccgtcaagtaaagtagacaaattgccaccaattaggaatagctcccactgaattcagttgtggccaaactgagtaagtacaccactcacatcagtacatttgagtaaaatcttcagggacgcaaaagtacttgctactcagtgaatcacctctaaaaacctattcatgtaacagactggttttccgtgttgaaaattgaaagaaaacagggaattcccgtgattggaaaaagaaaaaaactgcatcacttcacctgaaagttgagcaacaagaactgttactagtattgaattatctgatgtattcttcagtgaacaattttatgctattcactgaagctcattcgagtcttggattctctttctaatgcatttgatgagctaggttaacatgcttctggtaattcttgcaggtcatggattttgtgtcgcgctacctaccagcataccacgcatatttgcccactctatataaagagggaccaaacggctcgaacccagaccacctgctggtcgttgacatagacgaaaagaggaatcctatgtggggtagatgagccctgaatgtacattgctgaaagaaaatggatcttctgacccaatggtggagtttgggatatctgatctttctgagaccacatattccaagcaagcaccactggcctcttgtttcttgtggcttgaacaagtactaaacgtgtaaaactttgatgtatacgaaatcttgctattacttataaggaaatcggaatcccaattcattttgctgagtgcatctgtgataccgtgatgtgatgttgcatttgggtgttttggaatttggacatgaggttggtgtatactatcgacaggaatatatataattttataatcttatagtatgcatgatccgttgtagtctagctggttaggatactcggctctcacccgagagacccgggtttgagtcccggcaacggaattttttttgttcagagggcgaacagatttttgatttttttttttttgttcagcttgagggcttattcgatttgtaggattttcaaaccgtaggaatagaaaatacataggaataatgtgggaatacatgtgcaaacctatagattaaaaaacatatgaaattttcctatggttaagttgcaaacaatccaaaggattgaaaacattgggttgttgtcacaccccaatctttttttttttggttcagcttgagggcttattcgatttgtaggattttcaaaccgtaggaatagaaaatacataggaataatgtgggaatacatgtgcaaacctatagattaaaaaacatatgaaattttcctatggttaagttgcaaacaatccaaaggattgaaaacattgggttgttgtcacaccccaatctggcaccgccgtacaacggcacctgacaggagcgtgtcgtaggaaaacggcatgaaccgtgtcctacgaaaccgcgatctcagtaccagtcccaggacatagcgctggtacccacggtgacaaacatgaatcattacaaatccttataattaatagaagacttatttaccttaacttagattgcagctcaaacagcccgagaatgcaaccgacgacacggacgaggcaaacaccaacaacagcagcagcggaaccaaccaacggactaacacccaacgccacaggcaacggcagggaactaggacgaaatcctaatattcacttcacttcaacttcatcttcagagctggcagaactatatttatatagagagcaagggtgagtacttacgtactcagcaagctaggggaacttaggtggttaatgcaagcttcaagggaaggctgttattttgcaaacagttttgttttcaagttttcaacaatctaagtgtgtgctttccacaaccagagcgagacaagtctcagctcggtcgggaggtgagaagtaacaaatttatttatcaagatttgcacaactcccagagttggcttcaaatctggttttcccaaaccaaaccaattttccaaacttcccgataatagtggtccccaaacgaccaatcacttccagggactcccggtcccactgtcccccggatagctaaatgcttcccaagcattaggtttccaaaacttaacaccttttcataaaacagggtaaaacaaaaactacgctaaggaatcacctcacatccgcccatgaccgtgggcacggctgtttgaacagtttgttaacctctgcagagggggtacactttacccacacgacgttactaacccgggtcacccaacccgtgcagaacagccacgtctggcgactttgaggctttcacgacaaggcatttccaaagccgacacagggttgccatatgccaacgagaggggtcccagaccaacaacaggttaggtcccagaccatactgtgccaggaagcccgggggttctccccgacaccaccccgttgaatccacatgtctcttggcatcaaggcacccctgattagctacttactcagccaggggcgtcccattccacccatgtggtcgcactattgtatgctcggatgtaattccaaaggaatcggtccttagatgagaccgcacaagtattccgcccaggaatggccttgtgtcgcgagttttatttttaaaactcattttctttcacaaggcaccgacccaggcgtcgggttttccaaagcttttgtaaaccaagttttacccaagatgtttctcagattttaagtttgaaggcaaccgtcgatactcgtgcagagtgcacgaataccgaggcgcaactaggtggttacaagggaacatgatataacaattaacaatggaaggatcagatgcaacaagttaggtaggcccaccggtctgccttgcagacggggcaaacagattaagtgcaatcctatcaatgcataatattttgcaagcaatataattaagttcaaatataggctcaatatgttcaaaggtggcttgccttgctcagggtcttcacgaagcttcacaaatcttcgagaaatccgcttgaagaaaaatatccgataaccgcaactaggcgcaaacaatcaaaaacctaagcaaagaccaaataaaatgtcctatttaggctaattaatagtgccattagatagatcacaatttaatggaattactggaagtggaacggaggcaatcggacgaacggattaagggatatgaattttggaagtttaaatgaatttttctggacaaggagatgatttgtcggaattttctggaatacgagaaatggtttatggaatttatagaaataatattctcaataatattattgacatccactgacatgcgggctcgaggggacgaattattggaatctctggattaagaggatgggtttatggaatttgcaatataggaaatgatttattgaatttctagaaaagagaaatatgtgtggagtattgaaaaagatattcccaagaatatctttgactcattgacacgtggggccaacaagaaggtgagagagagaggagcaattggagggagtaattgtggacttttagctcttgggtgtgtgggcactggactcggaggagggactaaaagtgaactttttccgtgtcatcaggcctaaggggaggttggctgatgggccaagcccgcgagcgagaggaagaggaggcggctgaccgagtcaagcggggccgggtggctgaggtggcggccacgtggtcgtcacgctggcaggagacagggggagaggaggagcgcgtccggagatcggacggctcacggcggcacaacggcgccggcgagcggcggcgagccggagggaggggacggcgccggaggcaaaaggaggagaagttgaactcattccacggctcggattagggcgccggggtcggagggggggcggcgacggcgtcaggcggcggcggcgggagcggcacggcgcgggcgcagaggccgaggctagcgactgcggcgacgcttctgggaggtccgaggggtcacggggcggtgcgcgaccgtgcgcacgacggcggtggaaaggacagcacggcgcaggagcaaaagaggaggccagcgggcggagcgacggttttggggtggctcaaggggactcaaggagggtggcggcgcgaggtacggcgagaggggagagaggccgacggcggcggaaaacagagccacggcgaggcgagcagctagacgatgtaggggaaggatttaggctcggggctcaccggcaagaggaaatgacgtcgacggcgattttgtggtgggagagggaaggccgacgggggagtgcggccgggatttccgaaggcggtggcgaatcgggaccggcgcggcatccggaaatacggggacagggcagggcggcacggacgggttttgcggcgaggtggcaacgaccgtcgttcggccaaggaaggagaaggacgcggcgaggatggaacgactcgacggcgagatgcctccggacatggagctcgacgcggcggccaggagttcccatggcggcagagcttcgccgcttgggggaaacgaagcaaggggggaggaagcacgggggtgggttttatagagggggtgtgggagcgtcaaggtcggttcgggggagcatgcgagctggcgctcggccggcgttcacgggcgacgtcggcgttttcgtgggcggcacgaaacggcggatggcgcggatgcgatgggcggtggaggcggtggatcgtgcggtgggaatcgaaccgcgagcgcgggctggcgcggctcggcgtggtcaaggtggggcatggcgagctggcgcgcggcgtcaggggcgctcgctgccatggcgctaggtgccaagcggtggaggtagggcgtcggttcgagagaggaaaaagggagaaaggagggggaaaagggaagcttgctccatgtcgcttcgggaaaaaaggcgaaggaggaagaggggcgagaccgagtgctggctctcgcccttggacgcatgcgtgcagagcagcagggccgggcggcagcgcgggcacgggcggcgtcggggctgacgcggcggcgaccgagcggcgagcgcgcgcgcgggaaaccgacgggcgaattcaaacggcagcggcggaaatcggcgccggggagaggagttcgacgagaacgagagatggagagagagagagagagagagaggaaggagacgagagaggcgctccctctcttgctcggcgcgtgcagcgcacgtgcggggaggaggaggagcgaccgagaggagaagatgggccggaaaagggaaaaacggcccaacgaccgagagggaggtgaaatatactttttttgaggaatttcttcaaggaatttaaggagcatttgacattggatttgaattcaaattggatatttgaactcaacaaaatatggagaagccaaggaggggattcaaatagcgaattcgatactttcggaaatgggaaggaatttcgatgaggcgtgattttcgatgtcgatgagtggttgaagttcaaagcgagaattgatattttaggaatatgtttgtatttggcagctcaaggattatttgagagggaaacaaaatgagaaatcaatgttcgggggtgaatcaaaggatgtggcggtagaatgcgatagatagatagatagatagatagatagatagatagatagatagatagatagatagatagatagatagatagatagatagatggatggatggatagatagagcgatggagacgaggagagggggaagcttggatgttagagctagctcaaggagggaatttgatcggagaggctttagggttggagtctggttttggattccggaattaggcgatatttgtgctttagggttggagtctggttttggattccggaattaggcgatatttgtggttatggtttctggagtgaaatccgaatagaaggattcgaacttcgagattattttggaacagaaattttgaggaggcgatctttgatatcagggtattgagacaagggagggattttaatttgagatatatggcacaacttagactcaacactcaaagaatgaaattttcgcaattaggatttttgtaaattagctttttaatgccacgcgaaaagcggagcgttacagttggagtggattattttttttcctttgttttccccctaagggcttattcggattacagggtaggaaaaaatgcaggataggaaaatcgtaggaatatgaaaggaaatcacatagaaaacagaggattgaaaaacacaggaatgtagaagctaagagcattcggtttacaggatagggagagaacaagagcttggagtggatggaattttcctccgtttttcctgtggaatcggcagcaaaggatttttccctacagttttcccacaaccactttttaccatctgaatgataagataggaaaaatatccaagtgaatagtattccaatgaaattcccgtaaaaaacctacaatccgaatgagccctaaaagtggagggatatgaatttttcctttgatgcattcctttgaaacgaatgatagtatagtgctcattccaaaggattagatatttctatacttttcctttacaaatcctttgaaacgaataagccctgaagttgaattcccgaccttttttgttcagctattgaaaatttgaaatcactaccatccacgcgcgatcgtgtggtctacatcgcacagccagatgaatccggattacgcatggacgcagccggtgggcctgcatgacaagtgggcccagtgacactgacaatggctgctcgagtgtcagtgtcaccgtcgtgggcctgattgtgagaagtgagaacacgtcggtgcggtgagccaccaacaggcaggcagcgcctcatccacctttttctcccaaaaaaattcgaatcaggcggagccacctcacctcgccgcggctgtttctcacgccgccttcccccgtcgacgcgcctcgccggaaccctaccacccggatctccgcggcggcggcggagatggtgagcgcgctcgcggggctgcaggaccacctcaagctcgcgcgggactacgcgctcgagggactctacgacacctccatcatcttcttcgacggcgccatcgcccagatcaacaagtgagctccctaccatcccccccccctccgcgaagccgccttccctactacccttctccctctctctcgattcagtcgcggttggggcgtgtgcggtgacccccgatttcgtgtgattcgcggcgtcctcccgcccccctgcggatctgcgcgtttggacgcacggctgtagatttgtgcgtggctgagccgtttgactgccgtagcttagtggattctattaaaatgtgctctgcggaaagaattgggggttgtggttgtgtcataagtttgtcgctagttcgctactttggggttgggggaaattgtcgccagttctcgttggtgaggtgtcatatgacttaggtaaaatcgagcggtttaactgggtttggtacattttgatgtacaagtgcccaaagcgacacagttaaactggggattatgattgggtgttagatatcatcaggcaatgtatgtaataacgttgaagttaggtgctccacatttgagtatctttggactttcttaagaaaaagcatccttgtttcttcaaaacatcaacaatgttcgcatcattgaacctattggacattgatgctttattcgtaggcatgtgctcacatcagaactcatacattgatgtgtaaatgtattttttaacaaaaaaaaaactgtgctgaagaaagatattcacatgcttgttcatttagtggttaaataaatgtttgaaggtaaaacactgagtatgacaaaatttgaacataacaaaaatgcatttatccttatattgatccatattatgatagataagattcgattgtgcaggcatctaactactttggatgacgctctgattcgcacaaaatggctgaactgtaagaaagctatctgtgatgaagtagaaatcgtgaaacagctggatgctcaattaaaggcgtttaaagaagctcctggggcaaggcggtcctcgtcaccccccattcgctctaataataaatcctttgttttccaaccactggatgagtatccaacatcatcaccagcgccctttgatgatcctgatgtctgggcgccaccaagagatacaccaaatcgtagaccaacacgaggtcaatctagtacaagaaaatcctcccaagatggagcttgggcccggggtccatcaaagactggaacacctagtcgtggtgcaaaacctaatggaagtaaaggaaactctggggcaagatcatccactgcctctagcactggtgggaggaaagggaagtcaagttcaagcaaggctgattcagtggtaatttctgtcaaacagttgttcttctcagttttcatttgagcaaatatgttgtgttcgtgttcttagttttctcctgtaaatgataggcaaaacacaactgttttttcttttggaatcatcaccgacttatctgcctagtgcaaaattatagattcgcaccaactagcatacaaacttcttttgtaatcagtacttctatgtatttatattgccaaacatgactgtattgttcgtttgagcatacttcttagtgtatacaaagtagagttaaccgtttttatgagatgcaagcacttgatgcaacttagtccaacttatctttctttgttcatagcacctattgttaaattgtaatttcgagttgtccctaaatctagtctagagatgttctattttaacttcaatgtaggaatattatcatgaccatctatccttagttcctactgtgctattgtattcatattgaactagcatggtggcccgcgcagattgcgcggctagcatcgttatattgtctctcatataatagcatatttgttttctcattatattattcaaatatattaaaatgacaatataattttaaattttgcagtaactttataaaactactaatgtgtaatattcatattgtattttatatacgtgttagttattaattatttttaatatcaaattttagttatttgtaaattataaatattcctatatggactctaaactcgtcttttaatatttcttttttttaattccgaattttttgtaaattatatttctatatagactctaggctctttttccaatattatttatttttatttctgaatttttattatttctaactgtatttctatgtggactctaaactcatctttcaatattctttaatttttaatttcgaatttcagttacttctaaattgtattcctatattgactttaaactcttcttcccatgtttttcttaatttcgaattttatttatttgtaaattgtatttttatacggactctaaactctacttttaattttattatgtttatttcaaattttagttagttttaaattcctatatggactttatactctacttctaatattccttactccctccgtcccaaaaaaagacaaatcctggtttccgtgtccaacgtttgaccgtccgtcttatttggaaaaattatgaaaaaaaattaaaaagacaagtcacgcataaaatattaatcatgttttatcatctaacaacaatgaaaatacgaattataaaaaaatttcatataagacggacagtcaaagttgaacacggaaacccaggatttgtctttttttgggacggagggagtattttttaatttcgaatttctattttttttcttaattcttaattgtatttctatatggattctatactctacttctaatattccttatttttaatttcaaatttctattatttcctaattgtatttctaacctggactatatactctacttctaatattccttatttttaattccgaatttcagttatttcctaattatatttctatatagactctatactctacttctaatattccttatttttaattccgaatttcagttatttcctaattatatttctatagcaattttacggtccttgaggagataccatgaggtaccatttttttctattgtaaatttggtatctcttggtacctaggtactatgaggtaccatgaggtaccaaattttacactaaaattttggtacctcatcaaggaccgtagaattgctcatatttctatatggactctatactctacttctaatattccttatttttaattccaaatttcagttattttctatttgtatttctatatggactctagtctcctcttctaatattccttgttttaaattccgaatttcagttatttcctaattgtatttctatatggactctagtctcctcttctaatattccttattttttaatttcgaatttcaactatttctaaattgtatttctatatggactctagtctcctcttttaatatttcttattttttaattccgaatttcatctatttctaaattgtatttctatatggactctgctttttctttttctccgattaatgtgagaatttctaggccattagaacgaatgtggaggctcctttttctattactttaataatataatagataggtacaaaatatgatgtactaatgataatggcattttcttaaaattaaccttctactgaagagggggaacctagagcctctatctgtttatcttcatattccaaatacaaataagggcattgaaagctttagttacataccatatacaattctttgcttatcttgtctcatccttctggataggttctacagtatgttcttctatatggtggtcaagtttcttgaaaaccatgtattttcttattattttcttacagagtagcgatgctgaagaaggcaagtccaagaaggggcaatatgaaggaccagatatggacttggctgccatgcttgaaagggatgtcctggattctaccccaggtgttagatgggatgatgtcgcaggtcttagtgaggccaaaagacttcttgaagaagcagttgtacttcctctctggatgcctgaatatttccaggtaatgatttttactgtgctattctatcagattctgtaaccttgcctgaatttatttttgatgctagccaatgttatggccatgcacatgatctggcatgtgcttgttgctgccttttacttggtagcttgaaagttagctggacttgcatacatgttatggccatggacatgatctggcatgttttggactcattcaaaacatgccactcaaatcaacatgcacccaaatcaccgtaccctcaattcagccttcaagttttgatcgtattcatttcagtcttttcttcttgcatgtgaccttgttattcagtttaaatttgttttgatcctcatcctatccatgctcactctatttctgaccagggtattcgccgaccttggaaaggggttctaatgtttggtccacctggtactggaaagactcttttagcgaaggcagtagctacagaatgtggcacaacatttttcaatgtttcttcagcaactctggcttctaaatggcggggagagagtgagcgcatggtccgctgtttatttgatcttgcaaggttctatgctccaagtacaatcttcattgatgaaattgactccctctgcacatctcgtgggtatgtgaatgctatctgtccatacatgttcatcttgtttaatgtctccaaagacaatcaaagttttctcaatactttttagcataatcatgggtgcattgttctgcccagtatataaattctttttgtttgcaagagaagctgagaagcaacatacttgtgcttctgtttctatttttctgaaaaacaaagctcaccaagaaaataaagtagagacctcattacttgcattttttaaagctactatcatcatagaagtactatgtcatcatttagaaaatactatgaccagatgtatgagctaatgtatttaccaagttttttaccaactttcagagcttctggtgagcatgagtcatcaaggagggtgaagtctgaacttctagttcaaatagacggtgtaaataatagttctaccactgaagatggtcaaccaaaaatagttatggttctggcagctaccaactttccatgggatattgatgaagcactgaggttgggaaaccctttccattcacatttgctttagaaatttattgagtctactaaataattggaaatttataagataaatcacataaattcaattatatttagtattggagcttgtttgcttgaggtgctgctattggaattagaatatcgatttcctcaaaaaaaaaaactgtggtttgggtccggtttaattttttttttgcatcacttcttatgggttaagagcgtagaatatttgaacttatggacaggcctcaaaagccttgttccaaatgtaaactccttttggggctagagtcatttatagtcaatagcacttaaacccattggtaccatcagaagtggcatgcaattatctgttactcctattagacttgacctggccatttctttatccgtcaatgcactagctacatgacattactgttaccacatactcccttcgtcccagaatatactatgtatctggacagggactaggtagctatgttttgggacagaggaagcacttttgttcttacttttaatcttccgaacggtgtccgtatacaacctctaactcttacattcttgattcactcagacggaggctggagaagcgtatttatattccacttccaaattttgaaagcagaaaggcactcatcaatattaaccttaaaactgttgaggtatgatattacttatcttttctgtgttgtaattccatcctagttccctttctgtttactccttcagcgttttatgattgcctccttaatcaaacagtgcagttcctgcacacaccataactgttgcacagcataggcagttatgtctctgaattgtgtttgctatgcatgcagtgcacatacctgtgtgatcgcatgcatatgtaatttctgtaaatgacaccttttgaccataagcttcatgcctactgtacaccataacctgttgactatcgaagttttctactcagagttgtaccttatacgtgaaaatgaccaaatactgttcgctacttgtcatctttgatgaaaaagtactgtgccatatcttctgttgtttgttaacgcctcttttatatcggcaggttgctaccgatgttgacatagatgaagttgcacggaggacagaaggctatagtggtgacgaccttacaaatgtttgccgtgatgcttcaatgaatggcatgagacgaaagattgcaggcaagacccgcgatgagattaagaacatgtcaaaagatgagatctcaaaagacccagtggccatgtgtgactttgaggaagctctggccaaggttcagaagagtgtatcacccgctgatatagaaaagcacgagaagtggcaggccgagtttgggtccgcttgaaatctccattctgttcccgttcaaatttctcagatcattgtttctccttggttgcttgtgttcgcaagtatttcattcatttgtaccgctgttatgttgtttcaacggccttatgttgatcggttgtattgcctgcgccggtgttgtatcatagagacaaaccagacagtaaactaggaagtgagaggtctctgcccgtggaactgctttgttgatttagtttcagtgtcactggcactgccgaagccaaaggttgcgtcactctgtaaccatttcgaacagttgatatccagcttccatgtttcgcacgggcagttgcgacgtgcgcgttttaacagtatgcttcttgactcattgatctgctttacggagtacatcactgaatcaggctctgttcaggcttctgaacagagaaaaacaggtgcccagagctgaaacggtgcctgacgttctcaggtctgatgctggaagacccagatgccgtggcttttttacccatctggtgccatagccagaaaacctacttgtcctacacgcaatctggatgaaggcctgctgcagatgccagtcgtggacttgactttctttcatgtgacgtctcatggtactatgcatcaatagcttccgtggatctgaacttatacagtgatgctatccctgtactactatacttcgttaaaaaaaagtcagcaaaaactgagccatcggacatttggactgtccagatttatgtaaaaagaaaagtgaactaattttgagatgaaaaggaacatgcaatcgagctgctcgaggagatgtaactttagttgccaaaattttggtaggatttctaatatagttaccaaaatttggcagcatactaaatgtagccacttttttggcaactttaccaaaatttggtatgtttgaaaatggcatcaaagtgaatagacccataatgttaatgcaaaaaaaaggtacatatatcgccgttgccgttaaaatgatatgtaaaaataaaagtgaactaattttgggatgaaaagaacatgcaatcgagctgctcgaggagaggtaatgcaaaaaaaaaaattgatatgtaaaaataaaagtgaactaattttgggatgaaaaggaacatgcaatcgagctgctcgaggagatgtaatgcaaaaaaaaaaaagaagaagaaagagcaaaaatatttttgggatgaaaaggaacatgcaatcgagctgctcgaggagatgtaatgcaaaaaaaagaagaagaagaaagagtaaaaatatttttgggatgaaaaggaacatgcaatcgagctgctcgaggagatgtaatgcaaaacaaaaaaagaaaaagaagaagaagaagaaatgtaatgcaaaaaaaaaagaagaagaagaagaagaagaaaaaagagcaaaaatatttttgggatgaaaaggaacatgcaatcgagctgctcgaggagatgtaatgcaaaaaaagaagaagaagaagaagaagaagaagaagaagaaaaagaagaaaaaagagcaaaaatttcgccgttgccggggatcgaacccgggtcacccgcgtgacaggcgggaatactcaccactatactacaacgacttggttgttttcgggaaaacacaattttatctttatagagttagccctcttttgaatcgcatgcaagatagagttcagtcgcgcatacatccgtatatgtataatctagttatataagcacaagttacatcactcctaatacatgcatcaactgtacagaacgtagcccgtgttggcctgtacgtacacaacaacggcacattgccttgtcgcctctaggcctggtcgcgcgctgcaccaccagccccagcgaagtcaaaagcagcagcaaatgtagtagtaggaggaggaggaggagggtatacccctacctacgctcgcacagtagcaagtaacgtgtgcgctttacacgcctcacgcgcgccaggatcgatcgatcgagagagcgagcatgcatgcatgcccaagcccaaccaccgcgtggcgcgcattaaccagctgcagatgctttgccgttgcatgcagcgccgcgccgcgccggggcaacagcgcaacacagtagagagggcacgggagaaagcgctggtgtgaacagtgcagcggtcggagagatgagatgagatcgacgacccgatcgatgtcggggtagatgtactgtatacatagaaaggacagtggacagatcgacgtacatgcacacattgacacatactactgcgtatactagtctagttgctgtacgtagtagccgtagccacaaccagccaaccacgcctctgcccctgcactgcgcacgattgatctgtcgcatggattgatcgatcgtgtgtaccgctgcatcgataattcggtatacgactagtagcatgctctactactactccatccatccaaaaatatagcaatctagaatcggatggaatatatcctagtactagaatctagacgtgcccccgtctagattcatagtactataatacatctcatctgattttagattgttatattctagaacagacgatgtactatcttattaaatatgcgtgtcgatggatcgacctatcaatcgccaaaatacctgtgcgatcctctggtagtagtaatagctagcctgcgtaagtgcgtatgcttgcttgcttcaggcctgcagctgtggcatgcgttcgtgtaccggtcaccgcctcaccggtgtacgtacgtgcatttgcatccctctgtcaaaaaagaacgtgggcccttttgaatcaaaggatttatgtaggaattttataggatttaaatcctataggaaattttcctatttggccatttaattcaaaggattgaagctttccaaatcctatgaaatttctatggaatggcacattgcatgtggattttggaggaaatttagcaagagctccaacctcttgaaaaatttcgtttgagtctatctctctcatccgattcctgcgtttttcctgcgctccaattaaacgatcattcctgtgtttttcctatgttttgcaatcatctgttttacactttaattcctatcagaatactgtatttttactattcttctgttttttctgccctacgattcaaagggtccattaacatgtgatcctaagctgataagcattcaggccgcctgcttgccgcaccggtatgggtacgtgtttggggtctctttttatcgctttggagtttgcgcagagtcttcaaaagttggatgcttggagcagagcctatctatacacgcagagctagtttacgatttgtctcccacagccaagctagaggcattgccgatcgagccgtctagctagctgctagaggccaggataccctatactcgggtatagtctgggcttcagctggatgcacacagtgctagagagcccagcagcgtgcaagaaagattgtgctgtcagcgatggaattgaaatggtgcttcaccaacccattcttcattcttcaacctccctaaagacaaaacgaaaggcatgcttcaacggcagggaggataacatgcacggttaaagcatctcaaacaaccccttcaaatataactctccaaatatttatttgatcaactaaccaaaaaaattaggtagtgaaatatatccttcactccaatagtttttccattatacactccaatctaacagtggatcccacatatcaggctccctacttcctgtacactcccccctctttttctcttctctttcttcttctctaacgaactatcatttgaatccgcacaaggaaagaggcggtagagtggaggctggaatgtgatggtggaggccttcgatcgcgctcccacgcggtacccggcttgacatcccacgcaatgaaggcggtggcagatcgacgatgacgacgggcgcaggggatggggaactctagacaacagcaacgatgacgagtttacttgatttaggagagtgcagagagtcagggatggagagagttggggagagcctctctaggcgtgggcccatggttgacaagctaattttggcttgccaagtttgaccaacgagggagccagcttagctagtgagatggcttggtcatttagttgtgaggtagttggagcctgtttttattcataattgctaatttttatgtgaagagtgggatagtcgtactgttggatacgctcatacatatctatatatagctcatctacggttttagctatgaattaagagttcaaaccagcaggaatagtagccaacaacggaaataatcaggtgagatgcccggagcagatttagagtgggattgtagataagagcaaggataataatatagctcactttctactattagtccatcttaaaatcaacacatataatagattagctataaggttggctataatttttttctcctctctctatctctcacctatatattcaatgtatttgtcttggagcttgtgttaagctagctcttacatgagagccaacacccttctcttttgtttacctctctcctccacataggggggcctaatgggcgatcgtgcccagcgatcggtttgcccccccccttccccctatactcctccctcttctccccctttctcctccccttcttctctttctactacagtacactacacaattttttttaaaaaaacaaaagttaaaaaaatttatgtatagaaatactattatataaaaaatttgaattcaaattcaaatttgaatcgggtatgtaaacttttgacttataaactttgggtctataaactttagatgtatagaaatactatatatagaaaatatttgaattcaaattcaaatttgaatcgggtatgtaaacttttgacttataaacttttgatctaaaactttaggtgtataaactttagatgtatagaaatactatatatagaaaatatttgaattcaaattcaaatttgaatcagatataattcaaattcaaatttgaaatgggtatataaacttttaacttataaactttagatgtatagaaatactatatataaaaaaatatttgaattcaaattcaaatttgaatcagatatataaacttttgacttataaacttttggtctctaaactttagatgtgtaaacttaatgtgtataaactttaggtgtataaatttactaaaataggaaagtaatgcggtgccaaaaaaggaaaccaggtggagggagggaggggggaggggatcgatcgctgctccatccctagggcgatcgatcgccgaacagcatttccgctccacataagcttataatagatttatagctcactattatacttgctctaaggtgtctataattcagtgactcgctctgttcacgaaatggtgttttttcaatgcgcatccaaacttgcattaattactttgggtagctattattgatcgatgagcgtgcatctcttttctcactactccatgtatgtgggggtagctgcattacacgtaataattgtcattatgtacactgacaaattagtagtagtcctgccattttagtttaagattgggaaaaaaaacatgcatgcagccgagctaaaatttacgcacgcatgtgtaatgtacgtgccccatagctcttgtacccgggaatccggatcttggtgccagggaaggtagcccaacatttgttcgcttcctcccagacactgcgtcgcaataaaatcgattaggtagtacgagttcttccctgacaaaatggaagtagtggtagcagaagtagtaaaaggggaaaatatgcaaatacaaaaaacctctggttgttgtctgctgctactacttcacatgaaaaacatatgccgatcgatgtgatccatcagtgaagaagcagcagcatggccacaactccctcctctccaattcgtcaccagtgccattatggtcaaaaataacaaggcatcatcgtatccgctgtccccctcttgctcaatctctgcatgcgcacacagttcagtcacactgtatcacctaacctttccagtagctccattgtactgtgttacagtagcatatgtaatcagtttaaacggcaaagcagattaaactcagctaagcccaaaatataacagagtgaccgtgcaagcaaaagagaggttaaaagaaaaacagagagagacaaggaattacagctggggccggcctggcccagaatgaattgatgagccgtggtgtcgtggtgtcgcgttgcgcgcccgacaagcgcagatccgccggacgagccgtcgtaggggggtgagagagcgcgaggtgcgcgtatgcatctgccgctgcacgtttctgccggcgcgctgccgcgttcgcgcgcgcgcgcgccctcgatctctatcggctaagggtgtgtcagttaacgctaaaattaaaagtttagttaaaattaaaataatgtaataaaaaagttagaagtttatgtgtataggaaagttttaacgtgatagaaaaattaaaagtttaaagaaaaagtttagaactagcctaagctggagctctcaacctagtgtctgcccccgtgacatttcggcctttcggggccatttggttgttgtgtaattttgccgcagctaatcttgaagcaaacaaaattatataattagccgacaaatgtttgaatgacatgcatatctaaagtttttctttttaaataaaacaggtggtaaaattaaggtgtgacagtgaaacaaatgcctaactaataaactatgacacgactaaagcatgtcgtggcaagatgaggcgaccaaccaaataccgccatctttctcctaagcttgcagcttaattactcccgcaatcatgtttagtttatgctgactagatataactataacgatttatcagcaataaaaaaataatttgtaacaaaccttttatacatgtgttctaagaaataaaaaaaaagcaaatgttaaaaaataaactgcaataggaaaaccaaattaacttcaatatcaacttttaaaatttaaattttacttgtagcttataagatgaagagtaaatgatgggattcctttttttcccttgttacgtcccctaaacttttggatatataaccctccaaactttacaataccatctacataataacaccctctaaagtggttttggttggtgctttttgtatattttgatgtttaaactagttgttttggctaattaaaatgatatattttcattgcgtcgatgctcagtccttaagctattgtgatatcatactaacatgcatgccatgttgatctatattggtctgattaattatcagtgagagaaaggtaataaaagagatacattcaagtgaagattttgacatatatcttcaatatgcatgccatgttgcaaaaattttccattgtacctgcaaaattagacactactttaggggcttatatgaacgatattgtatatttaaggtgttggatgtctggttccaaatttcagggaatagtgttatatggacaggggggaaccacaaaaaattaagttaggtttcgacgtggaacaagagcaaattttgaggcaactttcaaatggttcttgatatattcaaatttaaattagtaaatttgagcgaaatttagtcaaaatttgctaaaaactattatgccaccgggggtcaagatcccacggtccatcgtaaaagctaacatagatagactttcagtcaaagcttaagggagtatgtatatacggacttcttcctctcctttttttcccattagataatcagagaaataatgagcagcatataatatatgtgcactatggcctggtttatttcctaactttttcttcaaacttcaaacttttccattacatcaaaactttcctgcacacataaactttcaacttttccgttacatcgttccaatttcaatcaaactttcaattttagcgtgaactaaacacaccctacgtgccatgtttaaaaatgctaggataataaccacttaatttgttgcttgtcttactaagccgatttagaattagaaaccgcttgataaaccgactaaatatgaaaggattttttgttttaaaaaactgtccaaataaaaaattactggttttcgttgttaaccgtggttatgaatgaaacctagggagctcgtgtttagtaaccttgtcacatttgaaatagaaaagttttttttctttttttctttgtggggcacctgagtgctagaaacagtataactgtagtctattaattcagagcagagagttaatctgccctgtcggaagagcaatatatacagtacttgctactctctactatatataaatcagaaatggaaatgtgtgtagccaccagttgatcatccgcgtcttgttgtatatgtcacatatatgacgcaccactaaccttccaatacatttacagtgatgactactgatgactatagcaggggcatgcacagatagctgtgcgagagactatttactctggcgttgttactgtcaagccaaggcgtggtcacaaagctcacaactcacgtctcacagtatagctggattgtcggcattgtagcctactacagcccactgttcaacgacgaaatggacaaagcacaagcaacaaaaacgctatctcgcgtggttgcgttgcctaatcgcctgtgatctactactactagctgcttctgtccttattgcatgcatggcctttaaggctactactaacaactctagagcatattacgtgtgtagtacttcctcacaaagctacaaattaatctggatacgtacaaccacacgcaggtgcttaacctcttcttggccattaattaaacacacacacattctcttctcacgtacgttgtgtcgctctctctggtctgtcttctcctgcatgagcactcacatgagatagatgagatgagagggccaagcacaagatgccaacgcaggagtaagaggcaagcatgcaagatgttgatcgatgttgcagccctgcagtgtggggatatgctagttggagtagtatagcatgttggttgtgccaagcctttgctaatttagctctctcttcttgtacctctagccatctaatgcatgcagcagaagccagcggcggcagcttgtttcagtggcccaagggaggggagggccagtagtaccatggatggactatggagtactctcaccgctcttgaataaacaaatgtaacaacgcattctaatattacaaatttgaataatacttcctccgttttatattataagactttctagtattgtccgcattcatatatatgttaatgaatctaggcacatatacatatatatgaatgcggtcaatgctagaaagtcttataacctaaaacggagagaatagttatttagatatgtagtaataagatgtatcacttcttatattaaatttatttatcatagtaccaatggagtatatgaacttttctctgtcccaaaataaatcaactttatactataatgtgacacattctagtacggatttagacaataataaatttggatatagagtatttttaaattcgttatattaaaatatgacacattctaatatgaaaggttggtttatttttagatggagaggagtatgcatggatcagtctggtgcaggaagtgctgccactctaattaaaagcaaaggagaggaggtccccataaatgaggtagtacagtggttgcatgcattaggctcctgcacagccgctgaatattccctgcaacaagcattaacagccagagttttgaatggttgtggagaggagacgagcagcatactatctgagcgccactgtgcagctcagccgcagctgcctcggacagtagtagctcagccggccagccggccagcccattctgttgcttctgcattgcaaaattgcaaatgcagcaaaggcgaagaccacgctagctactactatagtaggagtagtagcccacatcacaggcggcacaaggagctggtctatcgcactgcacaccgcccctgcatgcatgtacacgcatgcagcgccaatgcagcgtagtagtatatgaccaatcagatcagggcaggccactgcgccaaccacacaaggcggtagcagatgtagaacggtgaaacgcattcaaggccacccctgtatgctatctagaacacagcaggttagtgtaagttgtgtgtgtgtggatggagatggaatggatctctctctcatccacttgaagagagagagagagagggggggagggaggtgtcatagatgcagtgccctgcactcatctcgtctcttgctctggcctcactgtgtgtgtggtaccacctacaattcctcgatctttattctccctgcagctagctggtttggaagaagaatgttcataatgctaattgattgtgggtgtaattaaacagatgcattaaacacttctgaggtagcctacatttaggatagggagtgcttgtggggatagggaatttgggcatgtacttatcatttatcaaagggagctttcttgatgtatatcagtatatgggccgagcacatgaatacatgcatgttaaatttgaggtagcaataagtaataaattttcaagagaaacataacatgttttctcgtgatgggaataatatagaaacgaagaacatcagtttcctgcgacgacgaccctacaattacaatacacattacagatttacagtactatggctagctagactatttctcagggcctcacgcattggatgtagtcatgtagagaaaaattgatacagaagatgggtattattcagtaagttcaaatataaaatcggcatatatagatacagattcaagttcctactaagtaacaatactagtagaatacaataggcagagacagaaacgaggaaatcgggggaaaaaaggaagattacatgcattacaaagtgtaaatgatgcattctaggcttaaagactctctccaactcttcacactatgttactcaagaaggctgttaagatgtctgaacatcacaaacaagctccataccaagaatgcgtcacttacagcctctcaatacaccagaaaaaaaaacagaaacaaaagaaaacatcgagagtaatctagaactaataataataagctaattaattaagatacctagagatatttatatatctcggaccatgacgcctcaattccccacacgctcacaccggccgtttgcccccatcatgctccaaatgtagctagagcagaaggagagatcgtggtgagagctcgaatacaagatgctcgccagctcttctcctatctgtgaggctcatttccctccaacgtttcctctcttggattctcagatgctagccaggaggtcgtagcagcagcagcagtggctgcaccggcgccgagctccattggggcaggaagaaaagcagcaagatgaggcatttccatgagacgaaaggaggtctcactttgcaaagtttagtgtaagggggtgatgagaagtagaagaagaagacaatagagaaaagctagggcgatgtgtttatatactcacatggctacaagggagagagaaagaaaggggcttaaagagagaaggggtaaaattgctacagctacagaagagcctgacaaagtgtgtacacctttccgagcaaccgcaaagaattcattgtattgtaccattgcacagtacatatatgcctacatggtcatgttatgtgcattatggtcttgtcttagcttggtccatacgcggagacatattcattttatagcactcattatgtgggactggtagtattttttgtagaattgaattcacagcaattaattttggtgtctttctttgtgagctttggcattgcttgagcaattatataccgtgcatatagagtactaagattcacccggcctaatataaatgtggggacaggatgggacaagtttagtgttttaccagtaaatggaatgtttgttgtgtgagtgtgtgtgcagatatgcagattgataggcctaacattaaacaaagtatgatgggaggcatgtttgtggggaacgcgaaacgcacctacacggactccaaggcaccttggggtgagcaaggaaaataaacagctcattgttcgtatgatatactcttactatgatgcaagactggcatggggtggaccatttatcagtgagacgaaattatctaaggtacagtttattttcacctgttaattaacaacccacttgatcatctaggagaataacaaaattggtagcgttgttagtggatcattcaaccctaaaccagtctggaaactctcttactgatgtatcggtagaataaactgcctagatggatggagttaacaataagtaattaatcataagctttgtctagccagaaaaggaacttaaagagcaagtacaatatatagtatcttataaatcggctgtaaacacatgtaaaaaaagataattaaaagagaaaagaaaacagagatggactacaactttatagtcggttgcagtactgattataaaacgttttgtgtgttaaaggtatgactaggtattgtggtattgatgagtgtagtatatatttataggcaactattatataaattgagtattaaaatatgtatagataatttaattaggtcctttttgttggcccatattttttaataagccaaatcaacttattaaggaataaaaattagttagtaggtaaaatatacatgtgttcgtagcaacttaacaatcaatataaaaaagaaatcatgttgaaaatatcttaaattaactttaaaaacaagtttgcaattttgaattttgactttttcttttgtttattaaagcaaccaatggagcttttggagctggtagctaactgaactactccctccgtctcacaatataagggattttgagtttttgattgcaacgtttgaccactcgtcttattaaaaaaaatttataaatataaaaaatgaaaagttgtgcttaaagtactatagataataaagtaagtcacaaataaattaaataataattttaaaaaaaatttgaataagatgggtggtcaaacgttgtaagtaaaaactcaaaatcccttatattatatgacggagggagtatgtatatattaaacttgctgtaattaagatattaccatgcactgttttgtgtagtgggagctatagccatgaggtttgtcagttagtgtgattaggactagtttaattaagaacggtgttacggctagacaatcctttgcgtgtgcatgccactcactcacttaggaagtgatggaagcttcacccgttccttttatttgtctacatctctctctcctctttctgctttcagactgcacatagagggggggggggggtaatagtaatactctatcatatagctagatgccgatcagaggaacggtgtctcttgctttcctaaaggcgaacaatgtttcggtgtgtgtagaaaaagattcaccccatgatagaagagaaagctgcggtggtttgtttatcaccggtgattcaaatcatgtttgttatcattggaggtagcacccgtcatgtaattctactagtctactagtgttagaatagctaggttcgaatatactagttcaattataagttaaactcgttgaagttagaatatgtataggatagaattagagttgaactttatcattggctctctcttaaacagagagcatcataatataaccataacgactacaattaaacgtaaacacataggaagatgatgacggcgagaccataagactcgtaaagactagatgctatgttattggggagaagcgctcataatcagagcttcagagatgtaggcttcggttcaatttcattaacaaatatcgtgggctcccgtattgtcttctgatgtgtcttgggtgatcgatgattgaaacgatcggaaaagttagtcattatttcgctatatctactaaattttataacaaccaacgtgtactacagctctgcattttgcagtgttcaactgttcatcccatacatggtttaaagaaaagaagctagatagaaacgaacgcattgggcattgtgaatgaatccagtttacatttccttcccctatgaagcacgtgcattacattgcttgcagagcataattccatgcatactacatgatgctgcacaaacattcagctagcatatgggtaattcacaggacaaatgaacaatagacagcaacgcgatcgaacagcgaaaggagaagaatttttctggcaatgcacacacaagacgcacgtacggcgcgcggcccagtagtgtcgactactagcgaatattctcggagacaaacgttacagaaggcaaagcaaagcgaaggcacacacacgagctagtggagattcaggtgcagggccatgtcacttcgcagcaatcggccgggcaacaggaggggccgatgcatccatgcatgcaaccacaaacaaagcacacgcgcacgcacgcgcacacatgctctcgcaggcggcagctagctagctagcgcatcgatgctcctatacttgcagctcgctgccgccggtcgcgccgtacgtgctgcacgcacgcagcacaattgcacatatatatggagctttgctttgctcagggattcccttgcacagttgcatctcgaactctcgacgcgacgaacatatatgcccaggcacgcacaatctcagcagtcagcaacgtgcatgcatgcatggatatatacagcacggcatgccatgcattgtgccaaaacgtacaggatcagtctgcgtctagcgtgcatgcctatgcacggatgcatctactctcgcgcaaaagcggtcaaaacgggcagattctctcgcgggggctccctctttgggaggcctctcttgctcgggcgcgcgcttggctggttggttggcgcatgcggatgccggccggctgcgcctgcgcgcgcgggcgcgtacgtgctcgcgaccgcgcgcgcagtgtgcccagtggtttgtgcgtgttttgggcagcgccgcgcgtgtgctgggctaagagcggtacaatagtaagctataagcgagctataactatatatcgagaaaaaaagagaagagagagaagaaaacgggctacagatttatagctgactgcaatacgaactccaagacgttatgtgtatatgagaggtgggaccggatattaatagtgtagtatatttttatagttaactattgtataaatggactgttagattagctataggtgttttatagccaacaattgactatactattaaacttgctctaatgcaaggacggtaggcgggcgagcgggcatcccggccggtctgttggatcatgagaatgatggccgctttaggacgaaggggaggagtcaaaaataaacgcagggcgcttttgcagcacaaaggccccatttcggaatatatgcgtacgtacttcctgtgtgtccagcttacctagccggagctcccttttctccttaccttttctgttgtaatttcttgttttgtgtggccaagcaatgcaatgcatgcatgcgacgccctccctctttaatcgtagactggaaacgagcaaacgatcgggtacgttcgcgacaaactcgcaagaaaataatgctgaagcgatgcatttcgtaagctctctcgttgaatcgtccggccgtgaatttcacgacaatatatatctatatctatatctataatattataaaaattgaagatgttttgccgatactttggtatactatccgtgtatgagtcggtttttaaattcgttcgcttttgaaaatacatatctatatttaagtcggtttttaaattcgttcgtttttaaaaatacagaaggagtcatataaaaaaatctcttttaaaaaaagaactcgcatgctaatttgagacgatcagactcctaaccacagctcatgacttaaaaaaaaaacatccaagcgaattgccacattgaatttcatcttagctaaaccatataataataataatattaaaataacctttacccattacaatgcacggatattttttctagtatgtatataaaagcaaaaataagccaagatcctacgattcgcgcgtcacgggagaaaaggtgaaaggcgcgcacggccggccggccattaacaccaaaagatcgcgcaagttgcttctaatccaagtactaaatgattgagcactcaaaccccctcatcgccaacggctcgtcgacacgacggctcagcgtgcggaatcacctggacccgcgcgagcggcgtgggggcaagctagcggagtagtaggcgctcctcccgcccttctttccccggccggcccattctccccttccctgttttggtaggcgtgcgcgccatgcgtcggcgtccacacgcccatgcgtggcccggctgcgctcgaccgcgcgcctcgttctcctcgcctctctcctcgtggtggccggtgggggcgttgccgttgccgtgcacaagggcggccgcgcgcccggtcgcgcgatcgattgccaacaaccgccgcgcgatgtgctgcgctagcaaactttacaacccagagacatcacgcacgcacatcgtaccggcgcgagcacgctgtaattatctcccccagcaacttattcatataagcaaagacaaggcatgcagttagtcagctagcgcgagacagggtccaaacaagcgccacagacggctcacagtagcgagttacatcagtcacaggagcagcagctagccgcgtgcgtgtaggccctgtgagctactacggcataaacagcagggatctatcgatacaatgagtcaaatccaagcgcatatgatctttccgcctgcgctgcgctgccctgccgcgcgtgactggtgtgacaaagcccccctccttgccttgccggctcagctcgcctttcctcgttggccgcaaagatgcagcaaaagcctcgaccgctgtcgatttacacgatgagacgaaactggctcgtgtcgtgtcgtgctcgtatcgtgctcgtggcccatgggaggcttggaaggggaatttaactatttgccacttgtccaaataagtgtcttaaattcacgcttaataatttatcaatgaagggaggggtcatttcttaactatttgtcacttttgcttacgtgacgagccatcatagcgtgcccacgtgaaaaacgacgtggacccacccgtcagcccctccactttccttcttctccacctcgccggagcttgaattgagcgtagccattacacggacacatctaaagcggagattttcgccctgagttggcctagctcggccacgagcgccgccgccaccatggtctcctcaagcgccacgtccccaagccccgcgtcctacgccaccaccgccccgacgacgagcgtgaacaacagcagcagcgccgccacggtagcgcgtctcgtgatctgcatcccgagatccgtgcgaacctgtctccctcgatccgtgcatcgccggagccactcccactcccccttcttcatctatcgttgaagccgctcccactccccgttccgcacatggctatcaccattctcatcgtctgttccggtgcacgcaagcctctgggcccgaggaagccgtagcggccctgtcaacatcgcggtcgtcgttgttctccgcttcctcattgtcgtcaagaaactcgcgcaagtggaggttctcgaaggatctcctccatcggagcaactccgaaagcggcaagaacccgtggccgcctttgcccaccccgcagcctcggtcgccagcgcctgtaagtggcgaggcgagccgaggtggaggagatacagcagccgtaggtggagaaaaaaagagaggggagggcctgacggggagggggtccatgtcgctttccacgcgagcacaccacaatggctcgccacgtagaaaaaatgataaataattaagcacgaatctagaagaggcatttgaataagagcaagataataatagagctcacttcctactattagccaatcttaaagccaacacatataacagattagctataaggttggctacaattttcttctcatctctcaatctctcacttatacattaagagcaagttcaatagtatagtcaaatactagctccaattcatctatagccaatctaatagctcattcatacaatagttacatactacattattaatacctagtcccacctgtcatagacacactgcgtcttggagtccgtgctacagctggctacaaatctgtagctcgctgctcttctctctcctgatttatctccttaaaatatgtttgcagttaacttatagcctgctattgtacctgctctaattgtatttgtcttagagtttgtgttaagctagttcttgcatgagagccaacaccttaactttttattacatctcttctccacataagtttatagtaggcttacagcttactattatacttgctctaagtgatgtacttaacagtggtaaatagttaaattccccaggctggacccctccacccagagtccaatctccaaagcggtggaacaccagcccagccgctcagcctcgcagagtcgccccgcgcggctcggccgctcacccacccgtaacgccgtcacgagacggcgctagcccggtggggaggtggcgcgaatccgaggcgccgcctcctaatttttcccgcgccccaccccgcgctgtggcggctgttcctcctcctccttcccccgatccccaactccttccaactcacatggcggcggcggcggcggctgcgtccgtggcgagtcaagcgcaggccgtgctccgcggcaggctctgcgaccaggccgtcgtccactccgccctcaggtcctcgccggacaccaactacaggtcagccagagtcgctccccctcccgcgaaatcagcccgggagtcctcgcgactgacgcgctttgttctgggttgggcacagtaagctgaagtacctcgtcgccagctccgtctccgaagcctgcaacaactccgtcctactcctcggcccccgcggctgcggaaaagccgcggtgaggttttccttcctagtatactcttctgccccactttcagcggttttctcggatgcgggggtggtgttcgacgaaatgtgccagtgggcgatctacgactttacgctatgggttgtttcggcatggactgaggtggtgtttggatcagggacttaactttagtccatgtatttagatactaatttagagtattaaatatagactacttataaaactaattacataaatgaaagctaattcgcgagacaaattttttaagcctaattaatccataattagagaatgtttactgtagcatcacataggctaatcatggattaattaggctcaatagattcgtctcacgaattagtccaagattatagatgggttttattaatagtctacatttaatatttataattagtgtccaaacatccgatgtgatagggacttaaaagttttagtcccatctaaacagggtctgagatttcaattcttcgcaggtggtcgacatggttctagatgatctgaagaaggatcatcctgatgcaatatcagtggtatgtataaacgttatattttacttgttgctagaaatgtatccatgtatttgcgtaatacacgatcgatgatttacctacgttggccgtgaaataaacatacatgttacgagaaaatagtttgtttcagggcgctttagggcggaaggggacaaggataaatgtagaaactccttgcatatttttatgttctcaaatgcatggcctagccaaaaggacaatatatcataatgcacaattagttagactttgttaacttgtagttcagttggattattgtgcaaacttttttcagatcaggctgaatgggatgctacatagtgatgacaactgtgccacgaaggttagagctttctgatgccagcttttttggttcaatttccgtattccacatgccctccgaaccaaatctccctctctcttaactcctgtccaccaattcagttaacttcatagttgtttctatgctttatcaactccaatgcagccatgctaatgcttttgttactttgcttttaaggaaattgcgaggcaactttgtttggaacatcagttatcattttccaaaatggtgtgtggtgtctactctagccttcacctcactcaattattgttctctctaccattttaaaagatcttatctcttttaggcttcttcagatgacaacacggaattcatgattgacatgttacggtaagtgaagtgttaagatgatgagcatctgtacatcatagagacatactccttgattcttgaaatttatgtccagtcatctgtatcctctcttctgcagggagtgtggactagctcacaagacaataatttttgtcctagaagagtttgacctctttgctcaggttgaaacaaatacatgcattctggtttaactatacttaattcatgctgaatgttagatgcatagaattgtagcacgtcatggtttatgggacatttgtcttacaggaatagcttgctttctacaattgctgctggcaattattagataacaggataacagatgattctatttatggtttcctattacaggggaagcagaggttactctatagcttacttgatgcaatgcaatctctcacctcacaagctgttgttattggtgtgagttgccgattggtatgaaatatatcctctcccatgtttctgcatcttagccgtttgtaatttgtgtgctagtacactgtcataagatcaccatctcccatgtttcagatgaccctcttaatcgtgtggtagttgatacacaatatgcattagtgcagtagcatgtcacatgcattgtggtaattaatgataccaacgctgtacttgggattgaagtggctaataactttagacattgatagttctacgaaaaatctactgtttcctttgtgagctgttttgtaatatcaattcatttttaggatgcagaccaactcctagagaaaagggttagatcccggttctctcataggaagcttctgtttgttccttcttcagtggatagtttacagaggttagccttgtgcatttttttttttcaggctaaaacattcactgtttctcaagatctctattcaatccatcttttgacatttgaatgattgcaggttaatggagcacttgctagcacttcctgaagattctcccttaccaacaaagtatgtcagggagtacaatgcacggattactgtatcctttgctcaatgtgacatgtcactttatgtgcttacaaaacctgcaggtcactgttcttgctttataatcctcacggcaatcatatttgaataggctgacaaatacccacagagtgttttgttaatgggcagtttttctgtttcttattccaagaatggatgctgaatgtgttcttttctatgctaaaaagaagccatggtggcaaactggcaatggcactgtttcttaggctaaatggaactgtatgtgatcatcccatcaagttctataatattgtttgtgttattgtgcaaaacaaaattgtaatccatataatcaactaggtaaggtagtgcagaaaattgcattaaaagcttgggatttccttgtatgctgctgaaagttcacattctcatgccactcattgtctcagtgacatgggcttggatccacctttgtcataacgacaatgagggattttagagttcaatgcaatataaggaactaatcccccccaaggtttatgttatcctatacacttcagagcattttcaatgacaaaaagttcaaaggaattctcagctccctcactgatgctgacgcaacaacaagccacatccttagatttctgtaagtatttcagcagcttcttttttttatcctcccttttcttcacatttccacactttttagtactcagttaaatataggagaacgaaaccttcagtttcagagtggtgtcatacatggacatagattctggacttctgtcaatgcaaagcttcatgaatgcgctatcttcgatgcagaggcagcctaagatggacagtttgcaaggtctattttgtttgttgtccctcatttacttatgtaggatggaattgttcgctgtattgatttatatgctaaaacaaagctaccttcattactccacaccataaaacagtggacatgaatggcaccatatttctgacactgaaatttcgatagcagatctctccattttggaactatacattcttgtatgcatgaacaggctagaagataaggagaaaagttcatacaactttatcactattatgaaaggtagaatctgttcctctccatttgtgttcagtcataggaaagactaagtaagttgatgaactggttgtctgtcagagtacaaatctgtgcaggatgcctacaaaacgtcggacaaatattcacacactgtttgttttagagtaagtattagcacaatcaagaattcatgaaccttccattatattgaaatttcaatataaaaaaattacaacttttttttccccttcgatataggcttttgagcatcttttggatcgcgagttgattagctttgcagacaacaaagggagaaatcaggcgcttgaatatcgtcctgtcaaacttctgatatcttcacgtgagcttgctgagtccctcaagttgaacacgacctgccctgtgagttaaacgtccacctgttttccaatttaacgatcatctgatccttaccccttttgtggcttgccgttctatctcaatacgctaacaggttgtcatgctttgtgaatgatggtgctctggtttactattgcaggctgttttgcagaagcttcttgaccgtgaaagatacatgtaaaagtttctatatgtttgctaagttgatactggttcaagtgctggcatacttctttcttctttgttactccctaacaccgtgttggaacatcctatctactgcaaagagatttaccttgaagatgaaaaaggtatatcggtctctggcaaggtaacaaactaacaacacaccatttcactcgatgccctccctcttgtgtgcatggatgatacttgagaagttcaacgcaaggtaaacgcactagtgcactactgtgctagtaaaactttaactggattaccatggaaaattgacaccatcagttttgtgctcatgacaagcgtcctaggacgaacatttgttgtcctcagttctgtagatcatacacattcaaccaatcctgtcatcctatgcatgcgttgataccgagaatctagctcaggtttcataagtagctcaaacacatgttgcatagcaatgctattgtttttctcaaataaaattgttccaaatattataattatcttgaaactctcgcaatctcaggcctgtaatggcggaactattgtcaagtaaaatttgcctaccttaaggtctagttaaagagactagctatgtatagttatcttgaaaacaaacaaatacaaggtaatagaaggtttggagcagaaacactgcgatgaagctattacagctgctttattgagcgtaagtgatcccttcgtgaccattccagcaagaaaagcgcaagagaaatccccacacaaatccaaagagtaatcaaccaagtaggcattggatcttgaaacaaacctggttatgttgattcatgttagcacaaagactgaccaagcatgtatcgacataaactgtatgcccttgttaatttgccaagaatatgctacatactataaaataactcaccgtgtccaaacttcatgcatataagcagctctaccatgcatatagctaacgaaagccaacaaaaagctcccaccttcttcactggttttctgagataattgatatattgaaaaaaatatttagttatccatcaatagaaagattgcacgcccataaacaaaagccgggatgggaactcatgattctagaaaaggtgtaggaggatattataatctatatgtcaagaagacctgtcttgcaagtaggtgttgtactcacgaattgccgggatagcaattaaccaccaaaggatcagccgatacacaaccaaggggttcctgggaggaatccagagacaaaatttcaggaagaaggtgttaagttccactgtcatgaaaccgacgcagagacagaacacttggatgaatctccttggctccatgaaaggatgccattgatccttatcccatttagcgggtgtgaactgacataatgacctttttacctgccacaatggaagtggttaaccaatgaacttaaagtgaacttgactagcttgcgcaggataaaccagctgataccaaaatcataattttgaggtcatgataaacatgcatatgctctggtttacgaatttgtctgtccaattcataaaatatcctaccaaatcagttccagactcctattcttatcctaatgtttctattctactccttccgtcccaaaatatagcaacttctggctagtatccctgtgcgtatggttggaggtattttgattagccaataccttccatgcagcccatagttcaattgctcaactctcaccctttaggcaggtagctttagcttggagccttagaagtgatcaattgtttttcataatctacgaggctttcttttttcttgaaaaaaaaacttatgagactatatatgaatatgacccacatgtagtcagagtatttaagtgatgtatattgtatagagaatggtataaagtggaataattacttgcttagaaattcagggattaaggataccaaactgcagacaagacagcctgacttctgcggcaacagaaattcattgtacagtcccactgggaaaatcccagattctgcctgggatctcccatgtatggagttaagatctttacacttgcatagtacatgcagttataggatgacttatcttttgttaatactctgccaagtccactagaggttgtctaacttgaacagtcttttgttgacaatgggaaaaaaacaacaacctctatatcaagatatacacagccttctaactcaacactcgaacagtctgcataacgtcaatcttatggcagcagcataatcaaacaaaaaatcttatggcagcagcattggcgcacataatcaagcattggtgaaagtatttgtgtcaggatgataaaatagcaggacaaaacagcaaaaacttggaccactggtcattttttttaggtatgcaataaccaaattaagagattaaaactgaaaaaaaaaaggaatatgccttctattaatgtgttttcgttgagcaattgagcataccttacccataatgcttggctgacggctcagtccaacccattcgtatgttttgccatcaaagtaacggactgtgtgcatccccgcccaaatacctgtatcaagattcaaaatactagttgaatggaaacatttcgatggaacaacagtaaaacttctgatgttcatacactgaattacgaccgtacatattcgttatttaaaaaagaaaatgataataacaaaacacagtgaaccttttcaaaggttctacatactcaggccaagacaaaacagtatcaaggcaatgacatcctagttagtgcattctgctacacatatcaaaagggaagttccgattgagaattgaaaatcacgaaaaatttatcttgcagacaagctgtcctaatcaaccaagcaagtctacatatgaaataacatgagaaacatcgacataacaaagcccatattcactgctaatctgtaccagtacctctaatgttttgcactgacaactcgatatccttaaatctagcactctatcagcatccagaaaagaaacagctatgtgagaacttttgatacttttaacttgtatgactataataacatttttttattcagaaatataacaaccagatggatgaattgtaaatttagatactgccttgaaagacagagatctcaccaaaccaattacatatcatgatatccaatataatactgtcccaccaacactcgttaaaatttggcagcatgtgcctaaatgtaagctgcagaagatatcaagtgtgcattgttacaatagttcatgaaaatttactaaatgaacatatgctaaaataaaaggaaataatatttcactagtcaaggcagcttttctaacctccatgagctcaaaaccaactgacaagacccataggagaagttggttccgtatcattactgccttaccccaccaacccaagacatgggcaataacaaattcatcaaacaatgtctcctataggtgcatcgtattaccaattttgatgaaatagcattaaaaataaatgagtgttgtgaatagtgatgctcatatggaaaatcatacttgaatattaataaatctgttggtagggttttctggaacatacatacggcagtcagaaccatatgatctctctggtagttctgcattttgatataaacaaatgatcagaatatatatatctatagatgatattgtgatttttcccttgtgaatgtattgcataaatattctaccaactccgagaccagggtgaaggtgcttcataaactgcctggcatcatcacgtttctaaaagaaaacggtatatagattagacagcagactaaatttgaacacataattacaatatctaccttgagcatcaagtttaaatggtccaagtgaaaggctaatgagtaaattttaagaatagcatgttagtgaatacaataaactgtagacatagccaacctggaaaagaagaaaagttagagcaacaaggtacacaacagccatgccatgcaccaaacgccacacagcaggatgaggcctaataagtatcctgtacaaaagattattagcctgatcaattagcatcctcataagtatttatagttctttacagagcaaaattagataagactctcacaaaggtatatctactcataatggccaaacatcaggtgcttctccttgcatcagaaaatcagcataatctaagtagtaaatggtccaatcaattatgtactatgagaatctggttttgtgagatcaagaacatagatgccttttgtggtgctggtaaaatgaaaaacatgtaatatcgccagagcgagttttctttgctaaatcataaacatatcatatatgaaaagaatagcgtatttcatttgatatctgaccaatggatgcctgctgacaagatgatgtgatttaactcatttactagaaagcatatatgcggggcttttggtaggatagaacatttcaccttcaatgtcaatcttttaatactttaccagaaaaaaattacctaaataatgcacccagtgccaataataaaatgtatgactgtaacaatctccctagccaataggggaccataatgcagaagaattggtcatgaaagatccacaaggacacaataatgcaaaaaacatttatttaactaccattggaatacagcaaagatttggagacagacaaaaaacaattattacactgataattgttaacatatggtttacctaacaagggataattcacttacgttgaaggtgcttggagagtgcagtatgctaggaaaactgcgatcatagcccagacacccctgagaaaatgtcagtgagtgaatcagtttcctggcattgttgcttactagtacataccatcaacagaagtccagtaaaacaataatattggaaatcatcctacaaattcttatcatttagagtaaatgtgtttcacagtgtaataccttttaataggtatgaccttatcatgagagcttgtaatctctggatgaaggaccccacttgcccagctgtgagaacaataaaagtgaaccaactgccagactgatgagaaagtaaagaaaggtgttcagatctagctacaacattttttactaataatacaactgttaaattgtcaattcttgtatacgaatagaataggttggcacccaagttagatgactggtaacaggcagcagcagccaatacgagctcgtgtttatatatgattgtttatgaatttttcaagcataaactagtacttttcatgccatgatgcaactgtccttaaataaatcgtagccattcatttcgtgtcattactctgaaaccagttcaaagaatgggctggattcttcatacttccaattaccatgaattgttccctattccaagcgcttgagggttataacttataggtaactagtatgagagtggtccaagtccagcaagactaaaacacatggtttgtttcagagtttgagtatcccagccacatctcacacagaaaagctaaaaaccagaatctgcgcagaatctcagtggatgttatggatttatagttgtttgcctgtattgcgaatactgaatttccaactgaaccatgaaatgtttggtgaagtggcattgaacatcagaaagtatcccatacaagacacaataccttgtactatttacttttgaagacaaatggcacacaaactatgcatatatggatcactgagaagtccaaaagccacaccagttaaaaataccagaggctgcagtaacagttctctgccatttttcagcatagcgtaccaaaaaacgttagggatcaaatatggtttccatattaagttcccaattggagcagcaagtacagtcttaatatcttttactaccatctagcaaacttaattagtatatcaatttaatctgcacattgagaaataattttactggttataaactctattaagctccaaagaactaacagaaactaacccattttctacatccctaagagccttacgctcagacaattcttgcaaaagcagatactagcaatccttgcacatgtatttgagaatttagactacttacatcaggaggcatgcgccggcaaggagaaccgagaccgtgtgtggcttgtaaagccaagccgtccacgggtcgtattcctccacgccgccgccgtccgacggccatatttccatgtcctgcatcctctgatcgttactagatccatattccatcacctcaccgctggcatcaatggagttgattactcgtctacctgcatggccagttagagaattcggatggagagatcaatatatataaaaaaaaaaccaggatcgcaatcagtaatcagaacgaacgctcgcttgtaatgagggtaagaattagaaccaggatcaatcaaattatcagagacatgatagagagtagcaaatgcattggggttcacagggttgatcaattcgacggagaatcgcagaaggatcgcaagaagcagatagaagcttacggtgatggatgggagccgaatgctgtggaagcgacggcggtctctgctgtcgagaagatgggcaggcgtcggcgtcatctgtgtttacatcgcctccatctgggctgggctgggctgcggtggagctcggggggtaccacctccgacgcactggcatctggcagtggcagatcaggtagtcaggtccccggcgggcctcccgagctggcactcaatgtgcatgcatttatctgtcaagtgtcaagtgtgtttataacatggtaaggattttcactttgagatgtttgcaaagaaattctggacaaaatacccacatgaatactatgaaattctttatcatatgcgggtaactcagcgtagaaaacgtcaggtacacctacaaaatgctctttaggctggtggagacttctcaatgcgcacgtaaaattgaacgataaaatagtacatagttaattaaatattaactaaaattaaaaaaatatattaatatggtttttttaaaggaaacttttctatagatttatttaaaaaatatatcgtttagtagtttaaataacatgcacgtagaaaaagagaaagtaaaagttaaagcgtgcacgtgaaaaataagagtagaagttaggaaaatgttcaaaagagggagtagaagttaggaaatttactcttgggtccatttttctctagcatattctttcgtataaattgacatcagacaatcatatctacttgaaggccactacaagtagagtagcaggcaagtaataaaaaagtataagggtaatattcatatataattagtaaaaataaataaaaatagatttttcacagttttttttaagatatatcaattataaaatattgataagattagaccattgtcatagtaagagaccatgattccttatcgaactcatgtgaagaggacatgaaagcattattcattgtcgtcgcatctacccttgcgatgccactccttcccttgtgtgcacctgacgtgactatgtgtgcgtctctgattgctctcaacttgctcacaccacccaagagttcgcaccgaggacgctcgtgaactcgcacaacattatgagtttgcacggtgaactcaaaaactcccacaatctcaaccgccgatgacatcacgaatttgtgtgttttggtggtatgaactcgtgcgcttctattgccatgtcaatgattgcgtatctttgcggatgcgatgaccgtataatgttactgttggttttgaaacgagtatatttctgtcacgccgataaaaaaaatatattttcactttttttcttttctataattgtcccgttttctttaagaaaaaaaaaggtaatgaaaggctaggtctcgtgttagtagaaaacgaaacatactggagggtatatatgcaaaatccacaatactggtttgtagcctgggagtctgggacgacttcgatttctgtcgcacatccgtctcccacctgactcgttctaatcggcgaagagaaacccacacaagaggaagatggcggcgccggcgaccggcggcgggatctccgccgacgtccccatcctccactcggagaacctcaccagcaacgtcaaatccatctactacaggttccgctcgttctcttccccccccccccccccaaccaaagtttagaattcgatctgatctgataagtagggtcatgcttatgtctgttcgattggatctgggatttatgcgacgacatggtttgatctgctcagattagccctaattctttcgattcaatccggaaccgtgcgacctggtagtttcactgtaggcatgcttccgctcttcttgcggcaatttcgaaatctcggggtgcagtttaggatcaaaatctaagtactatgaataataagaaaaggatcaagtaattctgtgggccagttcatactgccagaaactgtgggtcaaattgcacacttacactaggatctactaaaattagagtaatcaggcttcatgaatcaactgaaagttttcaatgtttacatgcttttctacttcatgctcagatagatgctagatacctcccattaactattaactcttttcgtaaccctttcagcaattctagtcattgatgattatttttgactgcttcacttttataccaagatggcaaggtgatatgtcttaaccgtgaggattgattttgcgttgcagtcggacattcttgtcaattatcagtggagttgttgccggaatctggggattcacaggcttgatgggattcgtgttctaccttcttgtaatgatggtggcatcccttgggcttttgctgaaggccaaattttcaattcatacatactttgacagctggaacaggattttgattgaaggagtttttggtggccttatggtaagccatactggagctgtaacattgtgatgcacacctttatttccataaaacttgaatgtccagatcattcaacatgatttacatgaacttgtatctttcatgtttaatctatattctatgttattatgaagcatgggatgatgggaagattgatcattttagaaagttgatgaatgtggaacatcccttaacaatctgttcgggtttggcattttaaccaaattgttagaaacctcctagttaggaatagtgtgacattatcatggatcttcctagctgttaaaaggtggcctggtttggtggtagaatacagatttttgatggaaggagtataaaacattgggagcttcataccctaactaatgattcacatctcaattgttactgttgactgttggtaaatgttctcaagttatacaaccacattttcttaactatatgtttggtgttgctagtattctaatatcaatataggattctattgcctcaatgtatagttcatcactagattatttcctcaaatttcttcatgataatgagctttatcctgttttggatggtggcctaacattatttccttgctttttttgcagtcttttgtgctgttttggacgtatccttgatgctgtaaatattattgctattttcaattttccatatatacacaaaccatctagtatttcttattcagtataggtgtcaggcaaggtctgattcgattactagtataatggctcaccaccatagaaccatactaaagccacataactgagagtatgtaaatcattattatgtgaggccatagcatgaatttgaggtagaccattgtggttatacatttgaagatgccatataaattatataatgcatgccaatttttatgtttgagtttgtccttaacaatgaacagatttgcgtatgatattgtgcacatcttctgatgcacggcataaagaactcaactccgaagacttgaagggagctgtggggtttctccttgaactgaattaacgtgtaaccgcaccaaccctggaggactacattcgttggactgctgtcctgttttgttccttttttttccactccacatgtatcagttatagctctgtactttagaaagatgcaagcttattaagtttaatttacaaattgatgtagaagtgaatccaattgctggcaagtatggtgcttgatcttttgaacatcagaacttgctaggtaggggacaactggtcattgatacatctattgctgcccagcgtgctgatactatactccactagtagtatgttatattgttatcgttggagctctgaacttgcatattgttgatctgatatggcaaagtaaccactacgtggtgtttgctgaggaagttttcaactagcacttcgctatcaagacgtggatctttccagccccggcaaattccggtagctgcaagtcagagggcaacctcccattccggcatccagcaaaacgttgcccgtgggggccgcaggatacaccgcgcgccaagtcgttagcgttggtgtcaatttctttcttgcttgcttccaacatagtgttcccagttcaaagagattgcttttacggcttgcttggcaagaataattgggaagaggaatgaatacaagccattttttgttgggaggagcttccaacatagtgcttcccagttcaaagagatagcttttacggcttgtttgccaagaataattgggaagaggaatgaatacaagccatttttttgttgggaggaggaatgaaatgtttcttgggagttgggaggaggaatgactgtgagttaaggagatttgggtgttctgaattcacactctgctgcagacacgattaggagatcgtgcattgccaccatcgacgtctcactcgtaagagcatccgtgtcttatagcaccaggctagttagttgtgcggtggcgctgcggtgcacagaggctttgggggaagcagagccatggtccgggaagagaagcttgactttgtgctggtgccgctgggcctggccgtgctggccgtctaccacctgtggctcctctacgccgtcctccgccaccccacccgcaccgtcgtcggcctcaacgccatcgcccgcaagcgctgggtcaccgtcatgatggccgtcggtaccaattgattctcttcttcttgtcatctctctctagagattctagaattgtcagcctgtctgtcgtacgttcttgtgggcgcagaacacggagaagaacggcgtgctggccgtgcagacgctgcggaacaacatcatggcgtcgacggtgcttgccacgacggccatcacgctcgtctccgtcatcagcgtcttcctcggcgccacggcgggaaggtccccggcgtccccctcgtcgtcgtcgtcgggggcgccgctgctggtgtacgggagcaagaccggggaggtgttcgcggtcaagtacctggccatctcgctctgcttcatgctcgccttcgtctgcaacgtgcaggccatccgcctgtacgcgcacgccagcttcctcctcggcctgccgcccgtcgccggcgagggggagggggaggcggcggcggcggcggcggtagcgcgggaggagttcgcggcgtacgtggcgcggacggtgaacagggggagccactcctggtcgctgggactccgcgccttctacgcgtcgctggcgctcttcatgtggacgttcgggcccatcccgatgctggcgtgcagcgtgctcatgtgcggactgctctacttcctcgacaccaccagggagcgcgccgccgccgtggccgggatccaccacggtcacaaggatagcaccgtgtagcagcactagtagtaagtagtaaccagtttctcgatggcatggatgtacatctattgatctatagacccatcaattgttttgcttgagtaatgaactcagtcacaggagagagttagctcatctttcgaatttcactatcttttttaaacaaataattttgatagtgtgaagtttcattaaatatagcagaaaataattacagtactataatcctgagaaaacaccaccaaaccaccatcacgcacagacgtggtctacccgcacacctaaggaaagatcaacatcaaaccggctgccgctagatcaataaggagctaatgatcaaatacagacccaaagacgcccaaaaatatcgtgggaacatgaggttgtagagggagaggacgagagagaagaaagatccctctccctagcacacacccgccctcaggcctccattgccatacaagggctccatccaaacatattgagaacgttttttggtgataaagaggagaaaagcgacgaagagcattgtcatcgtccgacaaggtatcaaggagatccaagacaaggttttcacccaacggccccatcaggaagggagagggccgtctcgacaacgccccctagagggaaaacaacgctcaaagtgtcgccgttgtcggcccagcaagaccggggtaggctttcacctactgtccacccaaagttttgcagaagccactccattgctccacccccggtcatccaccatcggcatgtggacacgactaaattgatgccccccaccgaccagccttcgcgtgcctcaaggttcaccaccgctggctaccccaagcatcctccaccgtgctgccacccggtgaagggtacgacagctccctgccgcaccaagccgaccacatcgcctctgcgggtgcgtgctaccatgcctccatggttgcactccccgctgctcgctccacggtcgcaccccacctccacggtctcttcactccgcacctccacgtgacgtcgtccgctccctcttgccgctgcctagatgcctcacgtgccgaggttttgccgccgtcattggctacgctatcacggtctcggcgggcactgcacacacaccgcggccatgagcacggcatctctagattcgcggcgccggaacttctcctctacgtctccaggcctcgttgtcgtcatcaccaagaaccgttgcaagggatccaacctcccttgtcagagaggctagctccacacggcgaggtgtcggatctggccaaaaagggcggcgctgcgtgtggcatgatccgtcaccacgctgcactgcgcgtcgcctcagcgcctgctaccccgccgccatcacctcctcctctgcctctccatctgccactctcgtcaccactaggcgccgccgcctccatttccgtctcccgaactgcttcagtgttaacattaacatgcaaaatgcaaaagaaaaattccagatttgcattcgattgtgctcctcagtaccgtcaacaacactgacatgcaaaatgcaagagaaaaggaaatgaattattgtttgcgagatatgcattattaatgtttaaatgattttttatagaggaaaaaagatttagtaatttggaaaagttattctagaggagtatttctctccaggctccccgtcatagacaaagaggagcccatgaggcgaaggctcatgttagaccgagtttacggagagggccagacctaaattggtgggctcggatcatggttcatggcccaaacaagtgtggcccagtaggaagtgactaggtccacgtagaccaggtgtatgcgagtgtggatggagtagtcggtggacgggccccgcgtgtcacgaaccgagtgcacgatcacgaatctacgaatggttggctgctcccacactttttcttctttcgtctctgttctctctctgctgctttgctttcttcgtcttcctcccccttcctcctcatctcctctctccttactctccatggagatccccatccccgctggatcaccatggagatcgagagaggggagaagaagaagaggggggggagaaagaagagtagggggttggaggaagaagattcgcctctatgaccatggagaccgctggacggagaaatagtggttgccatcggagctcactgtctcagtcactacccctctacggattcgtcgacgtcgacgacaacgaggagttaaattggtttactactctgcctcctccagtcgaccgcgccgccggtactcctcctcacgcctcttgccgccgcgctgccctaaaccctcacccgctcggcctcctcccctccccatctccctcatccaccacctcactcgatccttctttattgcaacatcccgatcccctcgcatcgccctcgaaattctcccatcttcgccgagatagccggcgctgctcccgtcttctcggcaagccagcagccgccaccgcctttcctcgcctcctctcccaggcggcttcataggtacggagaccagcactgaatcttgcaatttttaaatagtaccatatatgcgcaattattcaggattatcataggatgctgtacctgttagtcatggttttgctgaatgctgtatctgctctgttggcttatgatgccattttcgtcgttaatctatggattcatttgaaatgagtccctttttttttctgtcatagttactctgatagactgccatatcaatatttttgtaaaatatagttggcttatgcactgagacatgtagcattcgtactgaagaccagagatcatatcatgaaatagtgtggtaccaaaaaaccctagtaccatgacattttttttttttgctctatatttatactattatgcttgacaatttttcagatgcaagtgcactcttttgactgcttttttgtctaatcagtgcgtttacttcacttcaccatagatccacaaagaacgtttgatattcttgtagtgcaaatgatagtgcattttttttatatttattactgtaagtttatttgcaggtgtgatatctgttaattcttatcttggatttatcatttttgttatcacgttatctgttttcttttaagtgatgtctattaacttagggtgttgtaattagccaaaacaaacggttaattagttatcttatcataatagtttgtacgtttgatcaattattcaaatattgatgtttatttctataggttctccccctccactttagctcacatggagatcaagagggtgaagattgccgttcacgtagcgaggatcatctcgatgatcctcgccatcggggtaatgtgtgtcatttatataccgacatcttatgtcaagcctctgtcctacaggttagtgtagagtttgttctcacttttccccggttgttttgttccaagttaatttagagagtttgttcaatgttgttgtttactaaaataattagctaccatgactaatatgctaatcgactttgtgtgcagatatgtcttagtggctatgtggtttgaggtgatttggggtttgctggagttgctcctccaagcaacacacccgttcctttgtggcgtgggacatatatccactacactgctcaccatgatggtcatgatcaacatgatatgttcactggctcaaataatcatattattatttatactggaaatggagggaattaattaatactttgtttatatgggcggtcttaaaaagatgtattatgtcggaaataaaatattaagtgacaaatttgctttccttttaactcataactcattcgccccctctcaaacgtcttcctaatttgattaagttatatttatggtcatgcaggtgcttatgtgttgcacgtggggtatggctattgcagccttgagcactgccctatttgctagacagcacagattttgcatcagcgtgtttaagtgcacacggttcctagttggatttgtgctagcggtgtctgttggatttcttagcgccgtcaaggcattaggtatgctatggatcctcggatcccaatttcctcgtgccgagtaggagattagggtggtatatgtatacacacaatctctgtactctcgtatgttaagtacatgtgtagatctgattgtgttagaaccatgtaaacatctatgtctcatgctgaggactagaaaggtctgtctacacatctacgtctcacggcaatatgattggagaagatgtgatagaatgacttaatatgatatgattggagatgtgttaaaatcgctagtgtgcttgttctttatcttgcttttaattaagttataactagaagtggccaagatagggcatttatcaagagtagggctggaacatataatttcaataaaatatagtatttgaaattccagctaaattctagtgttttttgaaagaaaattgcgacgtgttatatataatgggccaagactggcaatatggcattcaatcagttgaacaaaatattaatacacaatgtctgctacaggaaagagttgcttcagcagtcgtgaaaattatagtttttttttcttcatcagttcatcaagattcaagaacaaggttctccagccttgcccttttattccttctcatttctcaagatatcaaatataacagacatactcctattagcgtctacctttactccctccgaagaatcagcaagctgcatattttttagggggaactacggcgggtgtttataccagcctgaactttattaattggctaaaaacagatttttacaatgaaagatattacagggtcggcaagctgcatataacgtagcatcatatcaatccactgttcagagtaagccattaaacagtatacaagtccagtgattacatacatatcccttctttctataaagttagacttaaagctgaaacctcagtgttccacgtcatcgctaattcttagtcgttcgatcggtggatgagatcgcatatgaaccgttcgatcgaatgcttctgtcgttgatttgattcactcgccccgcacggcctatcatggcgccgcatcatacatcggagaaaataacgtgtgcttggatgccggttccctgtcctcattttctcaatcgagtaatagcatttatgcgccttaaaaccggctggcactatcgattggtctgccatggctgatttccatataatgcagacctttaatcctctgtggcactagagttcatctttggctttttagctcacgagctctccaaatcattctacatattattcttctttcgagaatcattctacatattatttagatttaattcatatcaacttatgtaacttatgtttatgtaagcttacattgtttaagctatcttacacattatttttatttattgttataatagtaaacttccgtagcaacgcgcggggtttcacctagtataaacaagatacattgccatgaaaaagaagataaagtctgtgctagacgcccagacaagaaacttgatagtggacaaggaatataaatggtactgtcccagatgttcctttaataaagaaaaaaaaaggaaaggttctatggttcagaacatgtaagcaacacagttacaaaatggaatctagtaaggtatatgttgagtttccagtcaatggcattgaataatagcaccggacctgctatctacctcacagactcatggtagattaatttggagggagaaatgaataccacgatgaaagaaatgcacaggtggctattatggtttcattgctgtctattatatcctctattacaaaagcatatggttacttgcctagttggctacctgttcaggacgaatattttcggttggcctcgcggttcattttgtattgacaaccgcagtcttccgctgctttacttctgtattcatgggtccaaatctggaaagattaagatttgagtggtttaagtcattggccaagcagacggaaagcaagaaaatgatgtgcttatataaagatggaggagcttcattacatagtgcagcatccaggtgaagccctgaagacatggggcacagaaagcccaacatcgccccagcgcaatgaagcagcctcagattcaaggccccctgattgccccaaatttcttcagcgttgctgttacgaaatcagagggagtgattccttcacttgactgagacctcacagatgttaccaaagttttttgcaatgtccaacagggcttccgcatcagctatttgctccgtaggcctctgcactgcattgtaaaccagcaaaatatagcataagcagttatttgctttctagtaagtatgcattctggcatgccacagtgagtcctaaccttttaatattaacatggcagtaaatccaagttttgacaagaaatgcaatattgcaaacaaacgacaaggcgtcagtcttgcaaaagaaaagaacggagtaattacatcgaaattaacatggaagaaccaacgcgattaaaattccatagtcccactatctacataattacatattgcaatatccagctccaatgcaatacataatgttttagaggaagtctctatatattaatgaacagaagaatcttgatgtagttggcaagaaaataaacttgtccacatgctacacataattcccctaattcctaaggggcatcaaaagtccaaaaaaaaaataatcaacacaaatgtatctattttgctccataatttgctgatgtattctgatgttggcaacttggcatagcaatttgaagtaaaatatcaatagtaagaatgaaatgggaacatgaattttgatccttaaccccttccctaggcatatttagttcttggacaaagttgtgtctcaagaatggggaatatgctccatgaagttttcaagtgaaagcttttagttggcgaaaatgttatctcaataatctgaactaaccaaccaatgttcgaaatcctgctggaatttattgcacatactatgcagatcaacaactttttggtacccattttttctaaatctgcaaaaagtgcttcagtagccacttcagcaactaatagtctaagcatgcagttcaaatatcacaatgtctttctaatttatcaactcaaatggcacacaaatttgaaacagcaactccaaggcaaggatgatgacgtcacaccacttcaaagttgaaactgtaacctcaaacagattgaaacatgacttccagaaactactcagtttgctaaactgcaacaaattccaaactgggcaaatcatcggattggaaaaaaaaaaacgcgaactgtggtgattaggtaccatctcaaaatcctgacagtaagctttagtcctgaattttatacaaactatatcatggaatgagttctaaacatattagataaaagaaagaatcaaacaccctgcaacaaagtttagtttagaaattttctatagattatagcatggattgacctcagcctcatgattctgaacagtttagaatacaaccttggttgaaactggacatagaccaaattgaggtaaccaataatatggtagcttttccatggtgagcagctgcacaactggacgactccaaattttactagccttggaagaaaaaaaaaaccattcaccataacctgcatctctctaaacattatgcttaagagctaataaggaaaagagacaacaaaatcaggacctcacacaaaatataccaaaacacaccaacagtccaactaattcaggggacaaaacactaaacctcatcattcattcattacgtgaatcaaacaaggatgcgcggcatgctttgcgtgccctaccagtcgccttataattaacatgttgatttgagcgtgtatatcgctggttgacatagaggctaaaagctaatcattagatatatgcagattgtggacaggatttatctagcaaaatttgacacatgcatggtggcagaatagacagtacatagtaatagcggtagcattacagcagttatgctagatgagcattacctgcagtacagatggctaaatgctaaggtggttatttagatgcctttgcagcaattaccctttccccccttgaattcagaggattgcatcacttcaagggcctttttgttgatgtagaaatgcaaggcacatatttgtctaacttgtaccatcttgtttctatgatgaattgcttccacttatacatagctgtttgaaaagtgctccataaagacaagtgtcaatactgggagtcaataaccttatggcattgaactactcaacaatatttagatcataagcatcctcccctcataatgttcttttgctgaatgtgaataaaataagttcacggcgttatttttgtggtatatgtttagattgtaaggattaatacaggcatacagcagtagttgatgtcaagtaatctgtaaaaaattaactgaaagaccaagaacaggtacaatatccaaatttaaaccaatttcaggaaataaattgaacacatatatattatggttatggaaatacaaaaaggtaccggccaataaaaaaatgatttatccgtactaaaaaacataagaggcagacaaacaatctaatctattgtcttagcaattttctcataatcaggaaatgtaaactgagcaatttccccaacaacataaacatgtctgttcagcaaagaaagttgtaatggagaaaaccaggtcagagggggagagctcgagctgcatcgctacctatctctcttgttcgctctttccggccgagccaaagccgccatcatcgctgtccacctctgcatcgctcgccctcgacgaccccagccctccgccgcgagctgcgccactaggacaactgctcccatccgcaaggccaatgccgagccacctccgcgagcacgggtggaagaaaggcatctatgtcctgcggcagaggagctggtggcgccgaggtggcggcgcaggggagctgggggcggggcgggccgtggtcgccggcggcggggcagctcctcactcctatgtgccaaccggccgcgttggcccctgtcccagcaggagaacaagggggggctcaaatgtaaaatagggagacgactccacgtcggacgtccaatattccaccaaatatcagatgcccgactgtttgtacgtcatcacaccacctgcatatgcagcatgtaaaaaaaaatcggtcggtcaaatgttccagttgactaatgagtgaaacatcaagttatataggctgaaataaaaaaaaatcagtaactgaaacattaactgaaacattatgaagatgcgcgttgaaacatatcgctgtcacatatgaaacaaccagtgttaatggattgaaacatatgtttttttcatcaaaatataatcatgcgatatcttgttgtaaagatctgcttcctccatttcacaatgtaagttattctagcatttctcatattcatattgatgttaatgaatctagacatatatattcatattgatggtaatgatgtctataatataagtcattctagcatttttcatattcatattgatgttaatgaatctagacatatatattgatattaatgttaatgaatctagatttgtgaaacggagggagtaattataaagaatacaacggtgtgatcggattgtagattggataattagtttaacagaaaaatcgttttgaaactagctaaaatgcatgcatgcatgcatgaggtggagagagaggacagagaatagtaacaattagttttgtgaattttgtgaaatacgctgaagacacatgttgaaacatgtcctattacgtatgaaacaaaaagtgttaatggattgaatcatatgattattttttattagaatataatcatgcgacatcttgttgtaaagatttaattacaacgaatataacggtgtgatcgaattgtagattagataagtaatttgagagaaaattcgttttaaatatcattaaagatgtatattatatggttggagatagagatacattttcttagataggtgcatgtgtatcagtttgtcagaggctgcccgtccaacttttctcattggttcgggggcaaaaatcacctaatctaaacccttctcacaaaactaccgctcaacgtcatcaacaaatatgtagcgtccgatttcctctccagatgattctaaccgttcgatcatctgattgactcctcaagaaagttcatttgcaatcagatcctttcacatccctggcgtagaaaaaaaaggtttactccgcccccaaaccgcgacgagattgcgggggcacgccgcacgggcaccacctcgccgcccgccaccaccgcttcctcacccgccgcagccaccgcctccacctcctcctcctccaccaccttcctagccctgctgccgcttctcgtactctccatccccgtagtcggcatccgtgcggcctcagcacacctcctccatctcccagatggccacatgactacacagtggcgctcagccacgtctcccctcccctacggcaagttcagagaagacggagctgggggtaggccggcaacgagtcgccatctcctccccacgagcccacgcctccccgcctcagccgccgcggcccaccactccggcttccacctcagattgcgaatcgcaaggtaatgagtactaaaacacaactaaatgcaaattcttgaaggtctgtaagttgggttcagaaaaggccatgcaaatgtggtcagcgggtgctgatatagaggaaatagttcaagccagcacatgcaaacaatttaacttagaagaagcaaattaggcatgcagtgaatgagatctcccatttgcttgactggttttcttataagcttgatttttctctcagatacgttgctcatatcatgatgattgccatggcaaagttatctgtctatagttccataatcaaatttcatgctgtaatatcttggaagtgcttaaatgatgaattgatgttgaggaattatatatcttggaggtgcttaaatctcatcctggaattatatatatccttaaagtcaaatacccatgtcaaagttagtaaatgtaaactttcttttctgaaaacactagaaagtgctgaaggcaaattaggaattagatatcttgatggagagcacatattggtatttccctttgttttttcaataaaattttcattgttacccagcaatcatgtaaatttgagttttactttcagacgaaacatcaaaatttataacaagttgagatattgaacatctcaacaagccatatgtgataggtcaaggcgtcaagcattatacctttccctacaatttctaaaaaaaagacttaacacaaactttaatttttagaaatataatactataattaattaaggatgtcctaagcattcaaaaagggataagattaaagctaatttccatgtcacctcaatctatttggtacaagaaaaaaatgagctctacttgatccatcttaatctggtctcctcaaaaatattaaatctaacatcctgatcgacaagaacatatattaaaattttgggcttggattgattcttctcaaagttgttgtgtgtggtatcatgtcaagggctttgtgcgatatggtagctggcaactgaaaactgtcaaattaatctatttagcttagttcagtgctgcaattgctcatcaaagagacatgtaaagtagtaattccatagaagaagaaaattataagggacatgtattttgcagaaattaagctccatttgctcatcaaagagacatgtaaaggagtaattccatagaagaagaaaattataagggacatgtattttgcagaaattaagctccatttcatgcttacacaccataaagaagtttatgttagtttttagtacatctggagtttacctgagaacagattgcaaaggttgtatatgtgatcagtgcactgtggtaaggaacagagttaggggtgggtgctgtggttcactgaccttattcaacaattactggtgaaccttgggaattttcgctaacatatataactgtcatgtcacttcatttatttttgaatatggtttgaggaatttcagaaaagttcaattgttattttaatttttcccattgttttagtgtttatggttattgtattttttcctgttgcaacgcacaaacactttgttaatcaaatattaagaggaatttgggcattctttgtttctttagcaaggtagatatggcgttgcttgtttgtatgccagctttgaacccaataaactcccatatgacaaagacaaaattattagtcttgtcaagtcttatcccagtgaattctcaagtatgtacattatgagacttcgtttcattttaataacttcgttgaggatatgcgaagtgacaagaggttcaaggcgtaaagattggtaaattcatttaataacttcactgagagagtctttttttaagattagtgattaccgattatgtgatcgagcgtttctgtgctatggaaaagcgccacagtgataaatgtgattaaatttcatcgtttgtgctatgtaaaacttgattctaactgtacttttcataaattaagacctttgttgtatttatgtgcatgaagactttgatttggcacttgaggcgtcagaacacaaagggtaaagatcctcggtttgccactggctggggtggatctggtgtgacgcagataccccaaagcactgagaagccattgaggaagctcactcttgaggacacgcgcccctttggctgcactagcacagatttcacaagaacagagaagagtgaggagagcaatggaacaagaagcagcaacagctttggcagccaagcaagaggaagtggcgcagctcggggagggtatcctccaccactttgagcaaatcctccatcaagattccctcatgtaatcacatttggtttctccattcaaatttctccctgcacgcattttcttgtcctcacttcttgcattctgcaacacaattttttttttgaaattcaatttcctgcgtaatttggctgtttttaactctctgatgagcattcatgcagagatgaagtggggttcttgcacccgacacagttccagtcactagaacacagccagactagtaattggacatttgaagtacctgaatgtcctcagagatacctgtggtgcaaagaccataagcttgccatatccacggaaatcttacctaagctctaccgtgctgcacagcatgcatactccaattcagcagcagccaaggatggttcattcatggaaactgatctgatgaggcacagcaaggcactgctcattctttgccctgacatgctcaccgcatggaactcaaggtaatgctgtcaacctatcacggtatcgctaaaagattgcatctttcatagctagaaggatgtgactttgattaagttggaaataaggttcatcactgcctggaagggattccacgtggttgttttatgcttcttttcttttggcaggaagatagtgctatcagtgaattatgatttcactaagctcaaggatgagctgcaattgtgtgctctgatcctttcatactcaccaaaaaacgaaagcacctggagccataggtacagcttgtcttttcacttgtcaagttgtcaaattatggaatttggggaaactctttcaggtcacctcttaaataatttagggattttttaggaaaaaaatggatgcctatgaccaacaggtatgataatcttgagatatatgccccatgattatttatgagttcctctacatttcaatacctcccattcttccgaggaccgctgtaaaaaactcgttggggctggattttatttgggcagcacagaaatattatgttgattttgcccatgcccacacagtttacagtttaaactttaaattgattgcctactacaggagatgggtgatcaagaaggtttcagagcacaaccaggatgtgtcggagcttatagagatggaatctgtactagtgaaacagatagcagaggtcatacttataaatatttacttctttgggatgttaatagaattattcccatctactttacggaaccttcatttcctagcagataattatccgaactcatcatattagcatttcacacagttccttatttaactggttattaaattacttttttttgccgggtggttattaaattactttgacatttcacacttgtagtgataaacagtgtacaacaagatagtttgatcctttatgcagaaatcaaagatgaactaccgtgcgtggaggcatcgctgctggcttattccctacatgacaagagaacaggtatgggtaaaggaaaatcaagctgctaaaaattctttgtccacttttcttaatcttatgtgcaaacttctgagcaccaccatggtagctaggttaggacttttgttatattgcaaaaaccctacaaaatttctgcctgtctgttatcagttcatgcttatcctcatcagcatctaatttctgttaaaggttctgaatgagttaaagaaatcaacaagatggaacgagttacatgtcgctgacaactgttgttttcactaccgacgggttagtccctgcccttatttgtgtagctagtactaattactacttccaaagcaaacttgtatcccactcaacatttgcatattgaacaacctgtggcatatcgtttgagctgtctcaaacatgtcattttattgattgtttgcagtccctactgcttgcattactagacagttgccatgtagaggacacagaagattcccttgataggaagtcagaagttcatttactgtggaaggtatgttgtatttcattaaaatctatacctgcttcactatggttccccttgtgccatctttccctctgtttttcattgtacatctgttacaaaggaaaaactcgcctgtgcatttcattttatttgagaaacacaaattactctggtgcttgagtaattgcatctgacaggaggaactgacgtggaatgagaaacttatcaggcgctaccaagggagagaggtttgaagtttgcccatcatgattgtgacatttttatgttagtgccataatttctagtgaatgttgttcccctatgttgattgtgctagtgtgttggtgtagtctttgtggatccatcgtaggttcctctcacaatggtggatgaagttcttgctcagcagtgaggaaacagagtgtgctgcaggcacatcgctggtggatctcttcctagtccaggagatatacctcctgtcagactgcctgaatgcccctgccgatgaatttggtgaggcatgtgtccaatctgaacttgcagccctctacattctctggatatcaaaggtaaccccatataaacgtttgaaactaaaaacaagtgatatatcctcctcttcacgaatgatcaacatttgaaaaaaaaaaaaactaagcatgggcatgttgttacttgcagcaagttccggctgtgaaactaaagctggaagaaaggctacattcgttggggagcctggaggatgtgttagcaagggcctgcccggagagaagtagattgtggacgcatttgatagcttgactattgaaagcagaacaaggacatgcattgtagcaatatgtggtactcatatccaacggaaaacgacgcttggaatacaaccatttctgaggcgactagacattttgcacgactcctaaaaaataactcatcttaggatcctatatgatagcagatgcctgcacactattcctgtgaatcctgtggcgtggctgtcgctagtgaaaaagctcacaaaccacatagagtgcatacttctaaatatatgaagttagttaaaaatacagagggagtagttgaatccgccaacaaagcgcaattcctgtctccattaacatgaaccacagaatggttatctgagcatcccagcagctcatctaaatttcatccttcgtactcccatttagatagtcatccaaaaagatttctactccatattacttttcacttaacagatcatccatattacatcctttatataccaacatcatatattttactaatattttacaactaccacttatttatcaccactctaaaaaaaaaaaatcttcccacctttatctcttctctaccgccggtgccgagaggacggggaggacgagggctgatcggaggggcgacgcagtcggaagagcggctgggcgaggggcggtgcgatcgaaggagtggtacgagtggcgcaaggggcggaggagcggcgcaagtggccgacggcgggaggcagccggcgggtgcggaagcggcagcggcggccgacgagcgcggaggaggcaggcggcggccgacggacacggatgcaagcggcgacgctatccttctggtatacctatctctctccaccctcctcccgacgagtccatctctctccttctcccaccgatggtccgctgccaccaccacccagtctttgcgaggagtcgattcggatggggcaaggccgacctgcgacgacggcggtggacggggaattgatccggatgggggcacaaatttggtctgggtgctggcagttgcaggatagcgtgaggagagaggaatgccaaatttagcatttttttctctcggatagatgatgcgttaaatttggagggtgggatagggtatctactggagggcgtttttcttctgctagccgctattttctcgatggatgttcggatggcatatttgctgggatgctcatctatctagaagcttagcttacactttgcctagcttattttgtactataggctagcaacctatggctggaggctggtcaaataactcctactgccttttgttggcacatattggaaacgactattcacctaccaatggaatatatatacacaagaataatatatgaaacatgttgacaatctgggtagcacgcgagcagcttagcttggtgatgtgtcccacatctacttcaatccacgaattccaaaacttggaccctagcaagagtgaaacgatgataagaactcatcttatatagccttcttttctattacagttttacctttatacttgtacaattacaaatgattttttcccctacaatattcaatgaaatttacacggtctagctccgattctttaaaatagaagtataagtagcaggataagtaaagtagacacgtagcattggaagaaagaggaaactgcatgtctatctcttaagaagcaaattcaccggaactatagaagaaagaatgtacaggaaggtacggtacagccacaacagcagtagatgcgaaaccactgtggttgccatcattgttgttattggtcaccatgccttggaacgttgttgttcgccatgggcattgggcaacgtggtcgttcccgtagatcagtgagcagtcgtggagtagtcgttcacgtagaacagcgagcagtcgagtatattgcgctccaaaaactcgattcgcactttctctcggtgcaagatcggggaggcaaatgtttcgaaggcttctctcctagtgttcgtgcgcgtagacaccgagaagggaagaccctagtccgtataagcaatagtacgtgtgttctcttgagatgagatctcaattgtgaaaaatccttcagtttttattgggttactcgtgaagatgaagagaatttgtcaggaagagcttggcaacgattacttgcaccgtgtctcagttgttctgtcgccacacacatttctttgttttctgtttgtgtggatttgcgggttaggttgtaaggtttttaagcccaatttcacttataaagtgggtcaattctctttcttaatatatccggcagaactcatatgaatagtggaaaaaaagttgctagaaaaagaattactagcaatcgagattagaataacaaccacctgttttacttccatagttccatttacttctatattggagcaacagacgaaggcaaaaggctttgcgtcaaaacaaatcgtgcagtgtaaacctcttttttttttagttcaacagcaagtgcaacataaatggaagattatgtcaacaacagtcatgcactgtactccctctatcccataaaaaataaatataagactgtatacgacatattctagatatattctagtacgatgaatttggatagattcgtactagggccttgtttagttgggaaaaaaatcttgggtttggttgtcacatcggatatacggatacacatttgaagtattaaacgtagtctaataacaaaacaaattacagattccactagaaaactgcgagttgaatttattaagcctaattaatctgccattagcaaatatttactgtagcaccacattgtcaaatcatggcgcgattagacttaaaagatctgtctcgcaatttacatgtaatctatgtaattgctttttttttcctacatttaatactctacgtatatgtccaaacattcgatgtgacagcgtgaaaatttttattttgagaactaaacatgacctatgttaatttttttttattttgagaactaaatatgacctatgttaatgttttttgggacggagggagtaaatggcaaaaccgaagataggctgaccatgctagcgagaaggatgtatgcgtgtggtaaatgtggtttctcttttgtctgtgcaattccacaattaagggcatgttaaatggtagagacgggtatggtctcttaaacaatataagattatttagagacaatgtctttacaatagttgagacgacgaaggctctaatcattaactcaaaaaatattctttttgttaatattctttctatttttttactctcatgcaaccatatttctatattatagtgattaagagtcattgttaagccgttgttatgcataacaacgatgtttgtctctccctttttctctttcttccatgtcaataagtattcctaattaacaatgctaaaaaaccactaatgataaccattgtacataccctaagtcggttcatctctctatgtggactaaacacacgtgacttaaattgggggaggacttaagtttcatgtgtatcctgatttaccaattgctctggtacctttttatgcatttcttttgttaataagattgttttatttttgtaagttttatgatgtataaaatttgttcgacagattatatttttccgatatagatagattctaaattttggttgtgattatgctcttaaaagatataatcatgttttacattaccaaaatattaccattgcattagtacgagcatattactactagtttatttaatttaatttagtgggccaaatgcccaattaaacctaacacttatgcggcttgctgtagcacacgagaattgctcccgttcgagcgccgggtacagataagaaaacaaacaggtgctctgttgcgtgagtagctaattctctctctagaaatgcacctttgcaggccctcgtaagataatattcataatctagtttatatcgaattatgaaaagagctacaaagattacagtagagaagaatagaaccgacgagtaccgattagactgttctcgagatcgacttgacgagatcaattggcgagctggcttatagtcgatttgatggtcccgtaccccctagggccttgtatttatacccctgaataccttggcttccaagtagaactcagagaatatcttacacatacgaatcataaatccgcatcccctccaaataggattctaacaccttttatttggggagttggtttctttatacatcagcctaattccttaagactaaggtaaccttcttgtatacttgggtataccatattcgtatgctgcctaaccccaaggatagaaggtatgcctcatccgtaaccctgacaacatgcatgcatgtatttgtttttagcaattttgaaatgttttttctccttaaactacttagccgatccaagattcaatcatgccattatattcatcgcaattaaatctttacaataagatcttacgtgattatatttatgataaaaagatatgtgtatcaactaggggtggataacgagccggctcggctcggcttggctcggtcaagctcgttaggataacgagctagctcggctcggtttgttatcgtaacgagctagaaacccagctcgactcggctcgtttgaaagctcgagctagctcgttaggctcgcgagccaacccatccaaaccatccagccggcaacagaagaggagggacctagcggctggcgagggaggagttgggccgggttgatgtggaggtccttggaggcgacgccgccgccgacgacgatgacgatggcgatggagatccacacgacgacgatggcacggcgcgggcagatgtg

SEQ ID NO: 43817 - DNA, 1353 bp, Oryza sativa
  unsure (1)..(1353): unsure at all n locations
tgcagccctgcggcggcgaagctaacggcggaggcggattggcacggcggcgactctagcggcggcggcacgcggccgaaggtggctgcaagcggcggcgctagcggcgagcggcgcgagcatgataggaggcacgtgagagggcggcgagagcggaaagggggaaaggaggctcgggggagcgatttctagggcacgggaggggcggaaacggccggggatggcccctatttggccggagacgtggaagagtggagagagaaaggggacgggattcaaatcgaatcccgccgatttgcgggcgcgcgcgtgagcatgaaaggcggaggagcggcgggcgacgatgtgggcacggcgcgtggacgcggagtgggcgcgggagacgcggacggcgacgtgggagcggcggttggagctccagcttcaacggctggaggtgggagacgaccgacaggtgggccccacctgtcggcgcccgaaggagagagggaaggagggaggacttctgggagggaaagggaggagcaggccggcccagcaaagagggcgcgcaggagggaggttgggccgacggcccaacaaagaaaaagaagggaaagaaaaagaaaaggaaaaaggaatttccctgggatttaatattgcagtttatgaattttaatgggttaaaattatttatagggctctgaaaattccactaaaatcccgttaatcaattgtgacatgtggaacccaagaaaaatcccacaatgccatttccaattattaattgcatttattaattagggattcaactctaggttaattagaacaatttctccggacgatttatttaacaaattttttttaaagcaacggaaaggggaaacttccgggcgtgacattaaagaagttgattggggaccaaaccaagaccttctccaggtccacttccatctcaccacttcacttttggtccatagaagacaagatataaagttctacacgttttggattcggattcgggcctcctgacagcatgaacttcaaacggacctagcagctgatctagaaggaatttggagcccatgagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43818 - DNA, 10071 bp, Oryza sativa
cgtcgtctgcgccttcgccggctgctgccgctggccggtcgccggtcgccggccgccgccgtgtgccatgcccgggctggccttagcgccgcctgtccccagccgcccgatcagccctcggccgattgtggccgtccatcccatggcccgcgtggccagccacgtggtgccacgtcggcgccacgtggtacaccaccacaccggccccgtggacccggtccacggtggaccaccccctttgagccgctgacccgtgggccccacctgtcggcgctgcccccccccctcgctaacatcagccctgggtattattgcgcaataaatcgaataaggatattcctttattagtaaaaacacagtttatcttctaaaattcataagtaattcatccgagctccgtttaagtccattcaagtctcagtaaattcataaaaatccctagaatctattaaaaatggttttgtttcctctttcagtagtcttatagcatgttttgctgtttgtcgcgtagatttcggctgtttcgtcgatccgcggtttcttgaagacgttgctgaggtctcatcagtgcgagagcaaggcaagtcatgcattacaattgatcatattgtacccaatttacaaatatcccgcatttctattaaatgttgcattcttttacaatgtcacgtgggatgggtcctattactcagccatatattgattaccttatgccattgataacttgggtatcaaaatgactagatgttggtttaggaaatgcttagtcatgcttagctcaactagtacacaaatggggatcacattattacagactttgactattagcatagttttggtttggtgccaccgtaatggtgttagttaattaaaatacactgattggtgggctgtgggtgcatggttttgctggtcgcactcatgacaattaaggaccggttcacgggaaaccctgggagacttaccgtgcttaccacaagcgggagtgggtaactgcttaatctgaagtatagctcgaccctttcctaggcaccggtggcgagggtgggcgtaatggagttgggtcagccggggtgtccggttatccagctgccggattcaccatggtgcaagaggggaccgcccactgccttttgaggggtagggatgaaaccttagcgtggtgtggatggttaggggagggttatgcggagggtcttgtcacgatttccccctttgcagtatcatggtgatacttcggggcatggcgacatgtgtggaatcgtgtcttgtgggtacagttgtacacctctggccagagtaaaactattcgaatagccgtgctcgcggttatgggcgatcaaccagattcaccgtgattagtcttaccctagtttagcttaatgaactggtgtagttcaggtggttggttgggcctgttgcaacgtggtgtagcgttggacagtaattggttaatattgattaattactacaactgttttactgctttcaacttctgattttaaatgcctgctttatgcaaaagaacctttagcctcctttggatatatcctgcatcatacctcctcttccggtatgacttgctgagtacagtgggtagtactcaatcttgatctcttttcccccacaccagagctaaagattttcctagtgggagctgttttgtcgaagttggtttcgtcgctgccgtcaaggattgcctgtggagtggagtcgccccgctgctgaagtcaagcttcccggtttagctcgcttttatcttttccgctgcatttgtaatcttttctatttttgtaagacgtggatctgtatgtcaacaattgtcgtttgtgtaccctggctggtcctggacaaggatttaatgcacattcagcttagaaattctggttcgtgaatttctgggcgtgacatttaatcatccatgcattccttacacacggtctcttttcttccacccaagcaagtacctctgcaaacgaaaacacacaacactcattgtgtagcgatgtttgttcaaatatataacaagtaaatctaatatagaacatatgcatctttggttgattaatgcataaggtagtcatggttatatccgagctagttgtgtcctcatcatattacccttccatctggaactagaagagtgtgcttttgataaggatagtgttttcaagtcctagctcgtattcattcacgcttgtaatcatagcttaaatagcatatatagcttcaatttaattatttcccggactgtctcaaagtcggcagatcgattcattcctttcataatatgtggataagagaatccatcaaactagtaccggcaccatataagtgacaccatcatcactagagtgtatgagaagttgagaactccagtgagcaaattgcaaccctcgagtatatagtgaaagaacagcttggacctaccccagctacctagcaagctgaaagtttttatttctcaaacagtgtatcaaaacatttcttttttcacaggattgagtggtggatctgtcagtagaaccttacacttcaatgaatcaaatttcagctcactagctactgtaaatgcatgatcccaccagatgtaggaatttctacctggccggatgagctgatgaacaaacacataggagcagatagatgtaggtgacgaacacatgggattcaatgttgatgaactacaaattccctaaaagttgatgaactatagctctcccaatgacacatgggaacgacagctctcctcattgatgaactaataataataaaattattttgtgtatttacttaattaccttaaatgttggatcgatccacgagctaggagagttgtcgccggggagagggtcactgcctcgccgggggtcgattggtgggagtcggaggggtgaggatcgaggactcaactcagcaccgacgagcaccggccgaagtcggagctagcggaggggcgaggaggaggaggaggacgtacaactgagagtctgatatggtttctcgtggaggagaaccccatggagctgcgacatggaaagatgatggaggcggtgcatccatggaacgacagtgaggagaggccaagttcccatgcagcaaatgaagtctgacttatggttgtttcgaggggattcagtgtttgggaagcttcacaagtatttttcattcaattattgtagatgatggcatgcacattacatagcttatgtaggtagtagggtggatccaacgtgtgtgtggggaggggggacttaagtccccctacctcgttggatcaccattaagagaagaggaaaagagtagggggctggaggaagaagaagggaataagctccccttccattcttttcctagatccgccctaggtagtgttgttgaatttagttgcagcatgtatagctgggagcatatcaacatgttctttgtaacaatactagctacagttttttattctttctccaacgcctaataatagttctttttatttatgggaaatacattcagtgctgctagcaaacaattttttccaacaaaaataaaagaataggcaatgaatgatttggtagacaatatcatggtcagagagccaataatagaatgtgagcaattagggttaaaaagtttggtgacaattgatgagttacatttctagccttacttctaaattcatttttttccgtgaagtaattcaagaagcattgacatgccatttaggccatctgcacttcttatcagtgcccaacggtgtttctaggcaaaaaaaaacatttatctatttggcactttttgttgttataggtagtgtttgtggaaattactttatattaaaactatttaaggtagattcataaagatgaagataatagagccaacattgagtgtgagttgcagaacgcataaaaaccagagtgccatgagcatggtcttgctgtattgatcatggcggtgatgcaactcttcattttatttttgtttatttaccttagtcctaatcaataaatcatgtttgattgcccccataatggaatgtactatgtttctgcattttggtgaattgctgaaatcctcccttatgggcattgattttgtcttcaaggtttatgcatgatcagtttgaacttatctctacatagaagaaaacaacaagctcaaaaaggattgtatgactgaggtgcatatggtgtgctcttgaacataaattaaaaatagaattatttccgatagaccaagctaataggaaatattgatggtttttatcttgttttatccggttgatcggattgatcatactttatctgaatgtaggaatgtttcagatgataacatcatactacatcatgttttaaggcaattgatttattgtgcataatactaaggaacctttcactttcagtgtaaaactgtaaatatgaatgcccatgtctcggttgccttttggcggatgtgttacccattatatattgagtttgatcccaccctgccattcaagttaacatgccatgtcttggtttattagactcatatactgtcatatgtgataatgtttctttttaaaaaaactaaaatttagttagaattacataaaaagtttataaactatatgtttcatccccacttttgataaattccagactctgcacctgctagttactcccttcatcccactaaggcacaatcaaacttagtgcggtctccaaaactaatatttgactttaaattgctcatatactataatgtttgtagcaacaaaatcataatcatatgaaagtaaggccctgttccagaacccaacagagggggagataaagttttggattttcgtggcacgctttttcaaaatgctaaacggtgcgtttcgtatgaaaattttctatatgaaagttgttctaaaatattagattaatccatttttcaagtttgtaataattaaaactcaattaatcataagctattaccacctcgttttacgtaaaacacttaatctccatcttcatcttcaggagattcaaacacagcctaaatgcaaaagttaatctaataatactattttcatcaaataaaatttagtataataaaataattattggtgaaacattaaagtgttgaatcttaaaatatgtgcacgccttattcagtgcgaacaagggaatacaacttaattagaagcgaggtaagctacagagcatattaagtttttttatcacatctctaatcatatatttaagtgattttaccacatcttctctaatcatatcgtagtgagacgtagatgtctgcatggtaacataaaccctccctagttgagtagacgtagccacgtaggtgagatacttaattaccactcaagtcctcaacacggatacatatatagatgtgtacttagagcattatagtcctcaacacaagaagatataaatgtgcatatataacactactagtccttagcacgaggtgacatagatatttttcagactctagtcctcaatacgagaaatctgagatgcaagaagccgtagtatgcctagcgccttgactgcactaagagcgccaacaaatatcgatagcaccacgtcaattatgtagcatttgcatacagccatgctaacatgagatgttctccagcaaacatgacagtggccaaggctagcaaaaatgacagtggccaatgctagcaaacatgacagtggccaagactgcattactcatgccctacgtgcaacacatgagcacctacatggaaacacttcttggggcatatacatcgtacataatcttttctatctagtacattttgagttacaactgagcaaattaaatagtgaacaaaaaatgattatttattatcttgaaggatgaagtctgagaaaagatgtttgcatatggtcgtctggtgcccataaacaccactaggtggtgaggattatcgagttgatcctcgctgcatgaacaacaatctttagatccattgttgcatgttaattgcttgttgtcaatattaataataatattggagcctaacattgagaaaaaaaaaagaaaacaatggagaaaaagatgatatgaagaaaacaaaaaggataaaaataaagaagaggaagatattagtaaaaaaaaagagagtgactccttgtcgagagataatgcattatcaacgaaacaaatatagtttgactttttttgtttttttccttacacagttatattatcagtaaaaatatgtgatgtattcatatgcatattgtgaacaaaaaaatgaaatatatttaatgcgggttgtgtccatagtggctgctaggctacaacatggcgccaacaagtatctaaaaaaaataggtaaacaaacaacaatatatactcatgtttcgacaagtaatgtttattgtgagggcgcggggtgctaggcccccttgtcaaggcagacgggcagacgggtggagctagaccgttgtctggtgctaattcgtcattcaggtgtcgtgcggttgttagctgccattaaacccaatttcgaccactaattaccccaaatagaaaaaataataatatcggtgaagaaaacaaaagggaaaaaaaataagaagaggcagatagtaaaaaaaaaagtggtgactgcttatagagagataatgcattatgaacaaaaacaaatatagtttgactcctttcaaaaaaaatatagtttcaccccttttttccttacataattatattattagtagaaatatgtgatgtgttcatatgcatattgccaacagaaaatgaaatatacatacctaatgtgggttgtgttgctaggctataagatgacaccaacaagtattctgaaaaaataaggacaacaaacaacattgtatactcatttttggataagtatgttcattgtgagtgcaggggagtgggggaggggggcataggcccccttggcaaagcagacgggtggagctacaccattgtctggtcgtagatataccacgaagagagggtgtggtggtgttctagtggaatactaatccgtcattcaggtgccgtgtgttgttagctgccaattaaaccccaatcactaattacccctccaatcctcaacataaggataaatatataaatgtgtactttgagaattatagtcctcaacataagtaaatatagatatgcatatatataacactactagtcctcaacatgaggtgacattgatatatatgtagactctagtcctttgcacgagaaatcggggatgcaaaaagccgcagcatgcctagcgcctttacggcactaagagcgctaacaaataatgcctagcgccttttcagcactaagagcgctaacaaatattgatagcaccaccatgtcaattacgtaccatttgcatccagccatgctaacacagagatggtgttctccagcaaatacgtgctactcatgccctacgtgcaacacatgagcacatacattaaaacaaatagcaattaacgaaattaaggagtcatttgaggaaaaaaatgagttaaaatgagagagaagcacttatcaattgaaatgcatattatagatgagaatataaagtgaaacaaatttatttgagttgtgatcataccatgttcaccatgaccatcgcagtgagcaatgcagtcgatatgggtcccacctcatacaagatcggatctgctgcttggaggagcaactctaacacacctcagattatctcaaaccacatgggcacaaacatcaaaccacgtcagatatggtcgtctagtgcccataaacaccactacaatggtgaggatcatcgagctgatcctcgctgcatgaacggcaattttttgatccatagttccttgttaattgcttgttgtcaatagtaaaaataattttggagcctaacattgaaaaaaaaggaaaacaaatagagaaaaaactgatactagtgaagaaaacaaaagagaaaaaataaagaagaggcagatatcaataaagaagagggttaattgaatccatgccattataaatttgctagttttgaaaaataccattactatttgcataattggaaccatgccactggaaaacattcaaaatcagatctatgccactttgtatgtttgaaacccattttgaatcgttttctatctaccgtattttcatatagaccaaaatacccctgcctcttacaactgaacagcaacacgatacttgctcttgtcaactctgcaatttgatgcctcggatacaatcaaaattttatatctaatatctaaaatcgctgctgctaaattgctgtcgtcggccactccaataaatggttaaatcaggtgtacaaaattacagaggaaaaaaaaggaaaagaagaaaagagggcggtggaggagtcgccgtggaggggtcactgtccacgatgacagctcgagccggccagctgcagcccatccgctacatcgtcgtcagcaccagcaggagcaggagcagcatggaggtcgccactggatctgctctcaccacacgcgagctcgccgccgccgcagggctgcacgtcgcttccaccagacacggccagccgatctcgtgcaatgccgcagacggcagaaccccggccggcagctaccgccctccgccctttctacgccgtcatcgtcatcaccgcagctcgctcaactgccatcgccattgctgctgggcacttgcatcgggcaggatgaggaatcgatttggggctagggctgttggatttgggggtattttggtccatataaaaatacagtagacaaaaaacgattcataccgggtatcaagtgtatagcatgtcatggatacaatttttgttgtgttggaatggcatggttccaattatacaaatagtaatggtatttttcaaaactagcaaatttataatggcatggatccaattaacccagaagaaaaagaaaaaaagatagtgactcattgtagagagagaatgtattatgtataaaaataaatatagtttgacctttttttgtttttccataacacaattatatgatcagtagaaatatgtgatgtgttcatatgcatattgccaacaaaaaattgaagcaaactgacctagggagggatcgatcgtccaacgacacgtggccagaccggtcgatgaaacattaatcactaactttgttaaatgttttagcttacttatgaaaatgattaaaaaagatgcaaaattaaaaagtattgattgcaataccaagcactacaaaaaaagttcgtctatcgactaaatacataaaaaatagtacatttcacaaaactatagattttttttcacaatttatcacaaaactacaaatttaagagcatgtctcacaaaactatagatttattgtatccgtttatcacaaaattacaggtactttgtacaatctatcacaaaactacagatttaagaacttgtttcacaaaactatagatttagtgtattcgtttatcacaaaactacacatttagcgtcgtcatttatcacaaaactacagatttagtgtatccattagcacaaaactacaggttttaacaatgctaaaacttgtagttttgtgataatgaagtcactaaacatgtagttttgtgatatattgtgcaaagtacatgtagttttgtgataaaagaagacactgaatcagtagttttgtgaaacaaattcttaaatatgtagttttgtgatagattgtgtaaagtatacgtagttttatgaaatttaatcgaaaaaattataaaaataaaatttaaaatgtgcaaaatgttcaaatttgagttgaaacattgtttttcataagttaaaacatgaaatttgaatggttgatactaggggtggacaggaagctcgtagctcgttagctcgctcggcttgtgacaagctcggctcggctcggctcgtttgattttcctaacgagccgagctggcattttagctcgttagaggtaacgagccagctcgagctggctcctgagccgctcgcgagccttaacgagccaaggcacatgagctgtgggcatttggaattggattttggcagagattggaggcccaacagcccaact

SEQ ID NO: 43819 - DNA, 2019 bp, Oryza sativa
ggctaaacttggatatgttccatctgttttgacttctgttgcttaatctttcaactcttcatgcaaatccgcctgttatgtttcttatgctgcaattattattatgccattcttatatttcccctatttttaattcaactgtataactgattgtggggttatgtatcttgcagttttctcgccatgaacctggtgttactcatgtcttagtaacaggaggagctggctatattgggtcacatgcttcattacgcctgttaaaggacaattatcgagttaccattgtggtaattaagttttccttgtactgaatttctgaactggtttgttcttcaaatgccacccttgatggttaattgtgatttttaggacaatctttctagaggaaacatgggagcagtaaaggttctccaagagttgttcccccagccaggaagacttcagtttatctatgctgatcttggagatcaaaaaactgtatcctcattttgtacttctaaattacctcctcgtaatttttaaaatgttcaaatgccagtttttcacttaactggctcccaggtcaacaagatctttgccgaaaatgcgtttgatgctgttatgcactttgctgctgttgcctatgtgggtgagagtacattggaaccccttaggtaagtcattaccttattgacagtttgtcagttccatgagcttgggggacctcttattctactaacccctacagacgttaccattgtacacacccttgtctaatggcctaattgtagtgctaggggaaaaggtccttatgataaaaaacagttttcactattaatccatggtacttggtatgctacaatgttaactccataatcaagtgctttctgatttttagttctcagatatttatattatctgctatcacagatatgatgaactgtataatatatctgaaacatgtctagtatatctctgataatcttaagtatttaacaggtactatcacaatattacatcgaacaccttattgattttggaggctatgcgtctcatggagtcaagacccttatttactctagtacatgtgccacctatggagaaccagagaagatgcctattgtagaaaccacacgtcaggtaattaatttatgatggcctcaaaactgcagtgtttggattgtgctgtgctatttcatcttgttgctggaaaggcaaactcaaggctgatgtgtaaatattatgtacctaattggttaataatttactctgttacagttaccaattaatccctatggaaaagctaagaaaatggcggaggacatcatactagatttcacgaaggggagaaaggacatggctgtgatgattttaaggtatgttgtttttccatggatataggcttgcaatttctgaacacaaaattggtatgtactaacatgtcaccttttgcattagatatttcaatgttattggatcagacccagagggaagactaggtgaagctcctagacctgaactacgagagcatggaaggatatccggggcatgctttgatgctgcgttaggaatcattccagggctgaaggtattttctcttatactttgactgtacagtacccctggtgtaaagcataatttagtgtattactaccatatatcagctttggatgttgataatagcaatatgatatacccatctagaagatacttgttttttgaagtattatacctgtatccagagactgaaactacagaagataatttagatttgaagctgatacttcatgaatcaattgcaggttaaaggaacagattatcctacaactgatggaacctgcataagagactacattgatgtcacagatcttgttgatgctcatgtgaaagcactcaacaaggcagagccaagtaaagttggcatttacaatgttggcactggaagaggtttgacaatatgagctttctttatttactttgattaaatgcagttcgctcatgctaggacagaatcagattttaattaaatgctgcatttgt

SEQ ID NO: 43820 - DNA, 1927 bp, Oryza sativa
  unsure (1)..(1927): unsure at all n locations
atttcttttggagagagagtgatggatttggatcatattggtgtatgcaagtgcccacaacatgtctctttttttagttgccacgccaagtctcccccattggtttacacaaaagaaattcctcccattttgttcggcatggtgaattttgaataaatataatttctcggtttatcagcagcatccacaattttagtgttgattttaccttttttattatagtctattttttagtattggtttttaaattgggaataatatagatataaaagttttattaataaattatgtttagcttttcgttcatatttctataagcttatcagtcgcatcttaaccaatgctattataaagacgcanatgttaggaaaggatctaatatcaaataattagaaggggcgaggtttcgaacccaggtcatctagcccaccaccttatggagctagccggaagacccccgggtatttctcaccaatgctattatacatctcgatgcagaggctggactgatttctattataaaaagaaaatagatatagttatcatgtagatggtgaatgtttatggtactaccacatagacggctaaaattgtcacatgataaggatgaaatgagagtgtgcttctggtaggatgaaccgggagcaaattaagctttgttggtcatcggttagctgacaacatttatgtgaatagtatccagagtactaaccaaagtatggtactccaaaaagtacagactatcataacttttagtagtacgtcactattattattatttgtctggaattttagtagtatgcgagacaaatacggagtactatgatacatgcatgattcaggctgtaaatctcagtgtaaatctcttccattatcttaaaacggcaatgcttccatttatctaaaaaaataactatcattagttataatataatattgtgctaacaatttgcatgatgaatttacccacagctttcttttcatcacagaaagatccttcttttcccacaactaatttggctttttgctaaaatttatacagcctatagtaagcctctgttcgctagttctggttgggaaccgatgccccatgcacggaaaacggagcggtcaattagcatgtgattaattaagtattagtatttttttcaaaaatagattaatttgattttttaaagcaattttcatatagaatatttttttttaaaaaaaacgcaccgtttagcagtttgaaaaacgtgcgcgcggaaaacgagagagaagagttggtaacctgggggaagaacttagcctaagctgtactctctccatatgcatagagagtttcagcagtgaattcaacatttcacattggaggcttggatagcaggtcatatttagatttaaattttatgttatcccttggttaattgttctaattttatttccaggtttactgatccaaattccacaacagagcctaaaattgctgtggtaatgtctaatacaactggcacatattaaaaaaaacatgactaataactctatacaaagtgcttatggtaataaaattttgaccaaattttattacaactttcttataatctaactaacttgaatttccatgcaaaccagaatcactccaaattttgacaggaaaaaaagggaagagtttatacttctcggggttttggcccaagttatcgcagcctaggcccaacaacacgggctgttctcactgggccaagacgggccgaagcggcccaagcccacgttcccgaagcctctccaccatcctagggtttgcttcccccgaagcacctatatataccaccacgcgccgcctctctcccacttcctccctttcccaccgccgccgccgccgccgaaaaagaagaagaagccgacgaggaggcgaccatgagggccaaggtaaccaacctccccg

SEQ ID NO: 43821 - DNA, 1467 bp, Oryza sativa
  unsure (1)..(1467): unsure at all n locations
gaaattataactattatatactaatagtagctgttaagttgatcagtaattatgtgatgctcactgtctatatgctattcctgctgtagtttcagtaggaaattatgaatgctttcaattccctgtgaacatgaaattcagttacataactgcattatcggtgattacctaagttaccatttcatagtagttatttttgtggtgcaaagcttatccagggaagtacatcttaatcattcattcatgatntgatagactttgtaatatgaaattgtcattctgtattttgtcaatctgtattgccattttgccatccatgatgcccctacttcagttggtttgttcaacaatgtctatgctggcattcttgaatcacccaacgaatgaatttaaatcaactaaatttgctgtgatgctatgttgcttcttgcttctgcgttccagtttctgttcacccttgtgttctncgaagaaggctactgtgttgtgatcttttgcagtttcttagctatgctaccatgcttatcggctaattttcatcagttaactttctgtgatctgatacttctgtttgtattgtattcagtggaagaagaagcgcatgaggaggctgaagaggaagcgccgaaagatgaggcagagatctaagtaggcgaaggagatgggcgatcatggtgatggcgtgtcgcagtgatccatgtcttcggctgccaagctcgttgatatgtcaagctgcttggcgtggtgccaccattcgactgttgaatggcttatttacctgtgctgttatcatcttatatccctagttttaccaagagttttgcaccaagacatgtcggttcagttatgtgaacttgttatggagccgtatttgctgctaatgtttacctaccgttgagtaattgctttgttggctctgtggtaacatctattgattgctgctttatctgttagcattggtgtgttgatctctgcgttattgcttgcttgatggtttcagtgtaggaatttccctggagacgctgatgctcagcctggacaggccttactttttctttagaagcttaacattgttttgcatgtctgcagttcttcggctggttcttgcttcctgtggtagcttgtttgttgttctacttagggcctgttttgcagggtttaacttccaaatttaactcaagagttggctttggagagcagcctgaaccctgctctctagtctatggctgtgtttagtttcatgctaaaattggaagcttgactaaaaattggaagtttgaagaaaaaagttggaagtttattagccctatcgtttggcctaaacagctaaagaataaaccaaaatttgattttgaaatgcttttaacataatttttttttaatgttggcttttaagttttgaaatgcttatgtgtgcatgtgatggaaaagtaaagttaggaactaaacaaagcatatgatttgaga

SEQ ID NO: 43822 - DNA, 1908 bp, Oryza sativa
tgtagcgtggaaagattagatggaacccgtctaaatcatgttcatgaacgtatatttttcgtttatttcgctgctttcacggtgtttcgacctctgtgttctggtagcttttcttggtacgctgcgttggaaggatcagttctagctactcattgcatactgttcaatgttaacgatgcatattattgtggttgattgatgaattttaaactcagcgataatttgagggatataaagtgaacttattcatagactgaattaggcccaaatataaccgcacagcccatttcacatccaaatgtgggcccattacatggaggcccatcaccgtctcgcactttctcgcttctagtccccaatctgaagcccccctcgatggcatcgccgctccaatggacggctccgatccacccgccgccgcctccccatccgccgcagctgccgccggcgacgacgacgacgagcgagccgccgcgcccgcggcccagccggagcggtgcgaggctctggccggggccatcgcgggggtgctgggcggcgcgctgcaggaacacgaggcgtgcgcggcggccaccgctcggagccagggcgagctcgccgccgccgtcgaccggctcaacggaggtgagtgcgtgcctgtctctccgagccttccccccgcgacttccgttgctttgcttcctactgctgctgtgtaggctcgtcgactcctagggttttgtgtgccttttatggtgtaggaatcgtcgttcgagttgcgttgacgattttctgctatgtgattgattcgtagaaatgttctgatgcactaaggcgttagcttgcggcatacgtgaaccaataattaacgaattatgcttatagttcacgcattttgtgaattgtgctagtatcgagtacaatcttctttacaagctatgcaatatggacaagtacgtctctaattgtctggatattttgatactgaattactgatatagtcttcttgtttccagcattaggtagatattttcgtgtccgttcccgctgaacttttatctgtttgctacatggatgattggatattcatgttagttcaagaggatttcttttttggtttagagttgtattcaagtggtttggatgagttgaaattagttctatatttatttcaaaatcgtaacattgctaaagatcgtctccatttttttccttattgcaaaacttgttatgattggcttattgaaatagctgttaaactgatgcagacatgcagtacgatttcttgtgtggagttgaactagttcacggaacatgccattcatcttttgttattaaaccttgtagtatactgtacaataaattagcgaaccaggagatttactgactgtacttgtatggttcttagttccaatcataaattgaatcctcatttggttgtttgatatgtttatgattgggacttagagaggttatttgtatttaatttcaccctaaacatgaatgtatgaacttgtaaatcctagtaagggaattgctattatgaagatcaacatagtcagaaacttttgggatatccatactgtccatgcatgacaaagtacgaattcaattttggttgacctgcctatttttttgatctgtctatattcctcgaggtagtttatctacattttctacatctgattcttcctccggtcctcccttaaaaaaatgttgatatttgctcagtttgcctcacatcaaatatgttatttcaaaatgcggtttctccatggccctttgtacatgcactaatgaattatatgaaattacctttattcttttgcagaactagacaagctattagagaatgcaccctccccggtcataatgcaacaagccacaaggatttgttctattcgcaagagagttttagctctgaacatg

SEQ ID NO: 43823 - DNA, 1947 bp, Oryza sativa; identical to SEQ ID NO: 39788

SEQ ID NO: 43824 - DNA, 785 bp, Oryza sativa; identical to SEQ ID NO: 39789

SEQ ID NO: 43825 - DNA, 760 bp, Oryza sativa
ttcctgcaccccgaatcttttctcccccatatactacatttcacagcagactagagcactgtggcttaccatatacaccacgtggttgtttggcactactgctttagatgatactgcatggttccttgttgaatgttttcatctgttggctggacatctgctgctccatgatgggctgcaagatctgagtgttgctcccccctctgggcaatttgcagaaatggcaatgcaaatgcatccagccactgggtaagcaatgtatgcatgcattatctgcatctgcatagtgctcacccctgtgtcattttgtaggttgtctacacactggagtcaggtggattccccaccactgaagctgagagagggtgctaacatggtggtgctggtgctgtcctcagggacagcaatggctggctggcagcagccttgagcttcacctcccttgcaggggccgaggtgatgctgccagctaagcaggggccgcgacgtgtagcgccttgtcaccgctcctcggcttccgcgacaaagctgcatgccggtgagccttgccggcgacaagggacaagtccctacaataattcttgctgcatgattggccacacatgtatacactggtgaatgctagctgctgatacattcatgatcaacctagctccaagatcagctgctaccaatggccttctccattgcaaatgtttgtgaagactgtatcatggcatacatggtgcgtcccttatctggtattccggttggatggata

SEQ ID NO: 43826 - DNA, 6102 bp, Oryza sativa; identical to SEQ ID NO: 39790

SEQ ID NO: 43827 - DNA, 890 bp, Oryza sativa
cagttagttcaaaagcctttgctcccccaggaatatccgataggtcaatgacacaactgttgtctccattctcaatcttctctcggatacaacgctccaaaaggccactctttgataatagaggaaactgcaaaatagaaaaagaacttgctttttacaaagtaattatcttcacaagattgtatctatttttccctccctaatacaaattatctactccccccgtcccaaatataagcatttttaggctctgacactgtcttcgagatgctactttgaccaacaatatctataaaagtaagatgttttaaataaaaatagttgcatattatgatggtttgtttaatgataaatctagtaatatgaatatcaattttacatgattgatcttttttgtttttttgctattaatagtcaaagttaaaaatgtttgacttctcactatactaaaaatgcttatattttgggacagagggagtagtatgttttggtacaaaggtttcccaggctgaaagcaaagcgtaagccagttgcataaatgctaaaagaaacatattgcaaaagaaaggaactcttgaatgaactagtgatgaaaatcttaccttgtgaagatgaaaagattgctccccaactgtgacggttatatcactaggaagaccggttgtgcaatacctatataatgaacatgctcgtcatcaatacttttcagtttggacaatatttttccagcaaaaaattcatatgtaaaaagctagaagtttagggactggaatagacacaagagccactctacaagtgtggggcacctaaccagatccttctaggtttctgccaccccacggtcaattgctatagatgatactccctccgtttcgaaatgtttgacgccg

SEQ ID NO: 43828 - DNA, 2903 bp, Oryza sativa
  unsure (1)..(2903): unsure at all n locations
ccgcctgcaaatgggcggcgagggggcatggaattttgcaggggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctctcatacatcttttgcatttgtactaatatgttatgtttgagtatatatgttgcgttttagttttagttctatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaataacatctaagggcatcgataggcctgcggagagaacatttcagtcaatttatagttggttgttgagaggatttagaatagaccaagaagtctacacaatgtcagtatcagttgtagtgagtcatgcaacagaaggttatttttgggaactaatgccgatggacagcactgctgcttggtgacggtatgtggaaatggcttttgaacggtcatggcccctcgttatatttgtgtcggtacaagagaaagatataaatgtttcaatgcaaaccgaagatgtagagggtcctatcaaggcaggggatgttgttggaccatcgatgcaaaatgaggaaaatcaaccaagggaggagcaggccatgggcatggcggatgagggggagagagtcggtataattgttgagaaatggagagggaagattcggataatgaggaagcggacgacgacgcatcatccgatgaggaaggtgatgtaatggccactgattgggcaaatgaggacttttctggacttgttacatcagagggtgatcatgtaccctgggagtataaggagaacgaggtaattgacggtgcaaggtatgcttcataaggatgagatgaaggccntgctgaagcattgggcagtttccttgtagagagagtttagggtggtcaagtcaacaaattatgtgtatgaagtgaggtgcatgaaggaagattgtccgtggcgtgtccatgcatataagggtaaatggaatgattattggaaagttaccattgtgaccgagcacaagtgctacttacaaggggtggagaagtatcaccgaaacatcacttcagctttcgtggcaagtgagatgtacaacagtgttgttggtaacattggctttgaaccaaaatcaattattaggcacatcgagaacaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgttgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttgtacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccgacaatgagaaggaggtcagggtcgtccatcagaaatttcactcagtggattgagaatgagcctaaggagaagtggtctctattgttcgacaccgatggatctcggtatggtataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatggg

SEQ ID NO: 43829 - DNA, 4282 bp, Oryza sativa
  unsure (1)..(4282): unsure at all n locations
cagttattgttgtaattagaaatattccgtatggtgacacttttgtttgtttgtactcttgtttaatatgtgttagtaattcgcttatgaacatttattacttatgttgaactaattatttatatgtttctgatcaatctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctgatgataactcggtccgacgctcccttgaggcgtacctgttgtggttgttcgggtgggtgatgttcactagcacccacgggtacgctgtggacttccggctggtccactacgcacggtccatcgcggatgctcagccacaggacgtgccgcagtggagctggggttatgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtgaccagaggacggtcccacgatggggacttactggtgtcgacgtggggttagtgcaacttcgctgcgttataagtttatcagtcgtcttctttttttatttcacataacatgtctaattccgatcatgtttattgcagcgtcgttacgctcacgtccaggtgagacgaggttacccagacttcgtgttcgagtttgaccgtctccagccgagcgacgtcatctgggagccgtacacagaagaggccgtcgctgcgagagcaccgctaggactttcgtcgttgtgcacacgcgaccaggcttactggctcaccatcctaccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggacctttctcgcactcgtgcgcgtgtgaccttcactccagacgccctagagccgcacgttgccgctgtgacggacgcgtatcccacgcaccgtgaccgagactacttcgtgggggtacgtcggatttgtattagttcttacaattatttcatttatcttgcataatataggacaactactgaatttttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcacacctaccgtcggagcaggacctcgacctacggtacctgtttcgcacggtactgctcagcccagaggtttcttaagttttgtttctgtttttgtacgaaaacatcaccccgtcataacttgatgttccatcctcgcaggacctcgtttgccttcgagcacccctggcttcggagcagtgcgacctacagcaccggtttcgcacagtacagttcagcccagagattagttcatttttgtttcagcttttgcacgaatatgtcaccatgttttaacggcacgtttcctcatcgcaggacctcgtctgccttcgagcgcgttcgcaggcacgaccggcgtttccgcgagctccgcaggggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggagcacactcaggagcagccagagatcacacctgtacaggcaggacgggttggccgtgccgtacccccggaccgactcacgtactcccaggggcacattagggcgcagggtaggagggataggggtaagaggcctcgtcagtagtgttctacctcttcattccttatgtgaccgtttcttttagcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgattgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaatgacggaacccgtgcttacccacgtagtgaaacaagatcggactacctaaggcggaaggatgagcatgaatgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaatcgaccatacagttcattcatgcttggatggagtacgaacgtcgggtggaaatnnnnnnnnnnnnnnnnnnnnnnnnnnnnnnnnnnnnnnnnnnnn

SEQ ID NO: 43830 - DNA, 1049 bp, Oryza sativa; identical to SEQ ID NO: 39796

SEQ ID NO: 43831 - DNA, 1285 bp, Oryza sativa
cccattccgtatataattgcacatatttattttccacaggtgcttgtatatgttttatgtccttcagaaacattatggttatttctgcattacgtttgtgctattttctgctgttaactcttgttatgacatattaagatgtgttatttaaaccttaatgtcagctgcatattctaaattgccgctcatttttgcagtttgctgggggattcgatccagagaccatggatgcatttgaagagctgaggaatcttgtgcatgtcagaaacagcacccagtaggaagttaaaaaaatgtggagaaggggataattctagcttactctctcagtaagcatagcagagagctttgttttggtttatgtgattgtgtgattgatgattagtgtgtgtatgactgtatctatgtgtttcagtgtgtgctaggctgaagaacaccagctggtgtttgcctatgatttttgtagctaccatgactgaaaaaagaggaaaaaagaaaaaaaatgcatggaacttttctgtatgcttgttgatgactcaaaaatgagccaagccactttataatcgaagcatttgaacttagatttcagagatactttggaactgtttctgtatgaaatcattaaccattattttttaaaaaatgtgtctccattgtttcacttatgtttataccataagtcaagttaattttaagacttaattatgaagttgattttgtggattttttcatcgtgatttattttacaacattggcctttatatcagtaaagacacacacatataaaaattttacgtacaaattattttttgtttgctactagtaagctggacaataagcacaagataagcgaaataatggggccaacggtttgtgtagatgaaaaatttacttaaaaaaagggcacacttccgtcacctccgtcgccggcgaaaatcctcttcttccgccgtcgccgttggggttgaattcggtggcgccggcggcggcggcggctgcgaagtgagaaggcgtcgatacggacgaactcgccggcgtcatcgccttggtagaatagacttggtcaattgggcccagcccaattacaccaccgggcccaccttgtcagcccacatcaaaccgttcgtctcgggaagccaccgcacgattggattggattcgactcgactcaagaaaagaaaagcaggagagacacaaaagaaaaaaaaaagaagaaaccctagctcgccggagcaccgccgccgtcgaggcctccggttccccggaatcccaaccgctggtcctg

SEQ ID NO: 43832 - DNA, 7069 bp, Oryza sativa; identical to SEQ ID NO: 39797
  unsure (1)..(7069): unsure at all n locations

SEQ ID NO: 43833 - DNA, 22429 bp, Oryza sativa; identical to SEQ ID NO: 39798
  unsure (1)..(22429): unsure at all n locations

SEQ ID NO: 43834 - DNA, 1540 bp, Oryza sativa
atttatgaaaaaataatttaaggacattttgattcgtagttttttctcatagaaaaaatgcaggaataagtcttttgtagcagtaaacacttttaagaaatatcataatgttttttttaaaaaataaggactaaaagaaatacacaaagcaaattttctggaccttgtaaattaagaaatccccaaccagcttggtcaaaaacagtacgagatgctagcaaaggttggagtataagatggcacttgtttgaccttacatgtccatatcaatattttttttcattgacagattaagtagtattgtccacatcagtttaaattttcgttgatatattaggcaccattttccgtaccagttttatttttcggtcataaattaagtgccatagtccatatcattttatttttcattgacaaattaagcactataggtgacatcatatcgccttcatgcgaagcttccatactgaaacaacaagattagaaccttcatatacccatgtctgatgtgattggcttcatgtatcatcagtcctcgttccaaggattgaccaaaactaaaactacttaacgtgcgtaaaacaaatgtaagaatgagtcatgaatacgtgtaaaattcaaggacttatcttaattcaggaggggaaaaagaacatagctcagaagacgcacacatacacgcacaagcagaagaatatacttcataaatcctcatcctatgctccaagagacgaaagcgtaaatcccttaattcatctgtcccaaaatatagctacctaatataggatgtgacattacctagtactacgaatctggacagcctacacatacatgcacaagaagaagagtataccctataaatcctcatcctacgctccaagagacgaaagcgtaaatctcttaattcctctgtcctaaaatgtagctaatgtgacattaccaagtactacgaatctggacctagtacaggaggctgtccagattcgtagtactaggtaatgtctcatcatgtactagttagctatattttgggacggggaagtatcttataacgtaatcgagtgtgctaatatttatgtgtaccaacaaattgtaaaagtaggatgtgtatgtgtggtgtgctttggtgtatgcatgtgcgcatattctattcaattaaatgaaaatacacatatatggagcaccgatcgaaggcaaaacccatgttcatatataggaatttaaaataaaaatacagcaaaacaaatcctcgatcttagccccaataaaaaataaaaaatcagctcgtgatctattatagctcaaactacaaggtaataaaaaaacctattaaaccgacaaattttaatcaaacctgatgaacaaatcaaggcaaaacgaattaaactaacattatataacacctacacatcgtgagatccatgcatcatcagagagagattcccaaattagtcaaccccaatgccaagattaccaccctcattatcctccgcattataatcacctgaccaaccttaattaattaagctaaatttcacgc

SEQ ID NO: 43835 - DNA, 1130 bp, Oryza sativa
ctcgagatggagctcgacagcatcgagctgcatctcgacaagggtaggtggaggttgctttcttgactagtaatcgcatataaacataaatcaaattattagggttctaagaacatctccattcgttagacaaagttggtgccctttttttcccttttctggtgatgttgttaggtaggacgaactagcttcttcgttacgtctgttgttcatgattatgcacgagagaaatttattgtgctttgctttgttctatgggctcattggattacactaaactggaagtctaaaaattgggaatttgtcgaaaattatcgattctgttgtgattgtccatccgcattggggcggcaacttgatgaaaaactcctatgattggaaggaggttgctgatgctattgaattgattcttgattgttactgttccatggagaagttccaattccatattcgtgcttaaattgattctgaagcggtgtatttccttttagaggtgatttcgggtgtgtttagttcccaccaaaattggaagtttggttgaaattggaacgatgtgacggaaaagttggaagtttgtatgtgtaggaaagttttgatgtgatggaaaagatggaagtttgaagaaaaactttggaactaaacccagccaataaattataaatttggggtgaagtaaggtcagagaagaaggaaaggtcatcaatttatagtttgttatgtatggtggaatgaaatttctgaatgtcatgttggcagcaaccgtatttcctgaaatgccatgattatattgctagctgtgattccagatgggattcatttcacatgatcagtatgtgcaacagaatattttctgagatggatttctcacgtagtctatggatattgttctacttctacataggttaatgtcaatggaagtcaatgtgaagtctagtttatttactactagccaaacttatgctcaaatttgttatagcattctgcagatgttattctttctcttaatgggctttgaaggtatttatgatatttctgtgaatcttgcttgcaggtggtcactttatgaggcaacttttgttggatggaagcagattccccaaaatgcatcttgatctacagcgctgcttcag

SEQ ID NO: 43836 - DNA, 7809 bp, Oryza sativa; identical to SEQ ID NO: 39799
  unsure (1)..(7809): unsure at all n locations

SEQ ID NO: 43837 - DNA, 4590 bp, Oryza sativa
ataaggaaataaagcatcaattcaggagtactagactaaatgaattctttattgcaatgctacccagaaccatatcaaaccacatctttaactacttccatggagtccatttgtgtactactctgaagagagcaacatttaagcagcattacaactgcctttatctctctctttagaagcatttgtatgaagcaaataaataacatcaaggtctgagcaaatcaagcttaatacttttttgagattatcgtttccaaaggctaaaaagaagcactgcctttcaatttttttgtggccgtacagtacacatttgtagcatcgaccatcaatgcatcgtcgacgaagatgaaatctcccgaaacctaatcaccaaaaagcagaaaactgctaactgcaaacaagcatcctcttgaactaactaaaacacgaaggagaaggagcaaaatgccccaagatccaactccctagaaccaaaatcgaatgagaacagcaaatgggaccaaccgattttggcgaagatgataaacacaatgccaatcaaaacccaaaagcttccacaaaaatcaagcatttgaacacagcgagtagactgaacccacattgggctcatcatcaagaaggacacaacaagtaaagcgcgactcttacctcccaccacccaccatcgatttgtacagatcgaggtgaaagcaaactcccccgtccacaaaagaacccagccgttctgcacaccgagcgagctcaagacgatcgccaatcctgaaatcccccactaatcaaagccttctccctccttttgacctcctcctgaccgcaagtccgcaacctatcatcccccgctccagcaagaacccccccaaatcagctcgatttcaacttaagaagacgaaaaagaaaaaaaaatcaaaaaccccgcagtgccgtgccactcccgacgacactaccaccactactcctactagtagtagagccaacatcagccagtggcagtaaacaaagaagaataggaggatgaagacaagtgcggtggagcttcggatgctttcaccttcggcctcgctcgccttcgatcgccgcgccccgcgcccacgcgcggatttttctacgagctcgtcgcggcgagttcgaggattcggttgctctctctctctcctctcctctctcttgcgctctgcttcttctcgggagaggagaagagtggagtggagagtggaggggggtgggtgtgtggtttgaattttgaaatggggataggggttttggacgagacgagtagccgtagcgcctagggggggacaagacattggcagagcaggtactgacaggtgggtcccactgagcagtttctcgcctttttctttttctctctccctggtttcttgtcgcttttgtgagaccgagcgtactgggccgccagcaggctactgggccgggtacttctctctaaaagtctgagtgttaggtgtgggctgtcttgttatgctggaaataaaaaatggaataagttcaattgaggtccctagatttgttgactgagtctgaaatttatccctaaactgaaatactagatataatggataccccaatttgcaaaactagatcactcgaggttctaggcagtttatgcccggttttggttgatgtggcaagctgggtcaacgtgggacccacgtgggcccccgtatgtcagtagctagcactttcttccttctcttctcctctcttcccaatcccctctagggcgacgaccaacgggaaggacggcgcgatgggtgagattttgttggcgctgtctcctctccccatcccctgatgctgaggagacgtcaccaacagagcgactgagggggtgattgatggtgacgagcagtttacacagctctcggatcaaccgcgagtagtgctctctgttgtcgttgttgtcgtcgctgctggccccaccatggcaatggaaactcgagcaacgaagtgaatcaaaggtcggaggtggaagatggtggtcgtcgacgtagaagatgatggtggccgttgacgtagaagatgacggtgccgtccacgtagaagatgacggtggcaggggtccaggtgatggcataggagtgggcggcgactatggggtcatcgaaggagaggaggtagcgctcctcattggcacgggtggtgctatcgttgctccatcttcgccccttccccagccaacgatggggcatggaggaaatagatgggagatggggaatagatggagagagaggggaggctagaggtggagagaggccttacatgtgagccccactcgccacgtcagctaaaaccgtgtgtatactgcttgagacctctggcataccacttttccaagttgaggaacttgttatatttggtattatggtttgatgacgaaattcaaactcggccacaagttgagtgaacttattccataaaaatttaggaccatctgagtatatatcattggacggatttttttcccacgaaaatcagatgaatgtaactacagtacaattatgctcgtaactagcatgtaaagtgtcatatagatacacaaaaatgctcgtagcttagtgggataggcgtgtgttggggattgcgggatcgagtcctttgccttgtgattttaaatttgtgtgattttaactaatttcaactagtaaatttgatgaccggtgtatatattatgccttgaagaggactcgaacctccacactctttagcaggccgaatcgggccaccacttgggatgggaatggctctttcggataatgcaaatcgaagctattttgatgtgtgagcctatatgacatagaaaaaggttaaaaaaaaacgtttgatttttcttttccctattcaattacacggaagacataactgtaagtgtatctcataacattagcttataagctgtagataaattcatattttggagcctaattttaagctgggttgagccaattaagagcatctattaaagcatggctaaattatgttcccaaaatgcccatacgtctagctagccaaaagattatattttttaaatttttatatttgaaacggactctccaattccaactctacatatggtacagcaaagagcaatacttcttccgtttcacaatgtaagtcattctattatttcccatattcatattgatattaatgaatctaaatagatatatatatctagattcattaacatcaatataaatatgagaaatgctagaatgacttacattgtaaaacggagggagtacatccttgatcgagaggcgaacttggaaaaaccaaacacaaaatccaaaaatcatgggtcagatttggggggcttttaactatttgcccctcttacgagtggtgcttaacgatttaccactagacctacatgtcatagacacatgagggcccatatgttatagacacggtgtggcaaatcgttaattgccatgtcacaagagtggcaaatagttaaatttccccagatttggcgtattcaattttctattctacaatgttttggagtgacaaacgatcacccaaaaaatcacaatcacaaatctctgaagagcaatcactgaaacaaccatagatgtgtgtatttgtgtttgtggttgaggagtggagcttcaggaggccaacaattgcgtcgccttcaggcttcttctccatgccacacatgacacacccatgccctcgttgcaatccagcgtcgctgcgccaggagacgaggcgaccacctgtgaagagacgcacttcagaaacgggaacatgttcaggaaacggatcaggtattcaggcctagacattcagcacatttttttatatatactccaacaggtttagaacagtttcaattcacaaaagcaaggagcagcaacaacaggagcatcaagtcatgtactccctctgttccataataggttcatttttagctcttatttgtcccaaaaatagtttattttattaagtaattattgcatcagaatttataaaagtagaagtatagtataaatgtattggaagtagataaagagaagaatcattgtattatgatttgataaagtggggatattatagtattttaggttttgtattgatatgtgttggatgagtgaaaaatgaacttattttaggacagagtgagtacttcttaatagatccactcttggatgaagattgatctgattatattagagtggagaggtaaaatgagccaaaataatttaggggcttaaagtgatccaataaaattgttcaggagagtaaaatattttgtattaataaaagcttttctgtgtaaaaacgtaagcatggattaaaaacattagaaatggccaaaataacatgttaaatgatctagatctatgaaaaagatattaaattggactaaatctctctgtccaaactccaaactaaacctagaaattgacatacatctaatactacccttaaggcatccataatgttcggcataagatagaccttaaactctaaaagcaactagggactatttagatcccaccctaaaattttacagcatgtcacattgaacgtttgaacacctgcatgaagtattaaatatag

SEQ ID NO: 43838 - DNA, 2298 bp, Oryza sativa
ttagaaccatatgtttttcttatttctttgttttttttcattcctacgattccaggagcccttatactactccgtatttaaggaagaatagtagagtaagggcaagtgctataatgctagatgtattgcccctaaacatgccacataagattgaatgatgaggtggaagaaataagtgatcaaagagaaggtgagccacccctcatgcgaggggcaacctccacacaaacccgaaggaaaaggagatgaaaggaagagtagattagacaaacaaataaaataaaattatttgggttagtatgctagaggtagttgtagatgtgatgtattgtactccctctgtcccataatataagggattttggatggatgtgacacattatagtacaatgattatagagagacagtttgtccagattccctacaatctcttatattatgggacgaagagagtatatatcatctcttattttaaatagataaaatagatatggcagccaccccttctataagatttgccctaactctttggttaagttaaaaaggacatctactcataaacaactgttaatcaccatttgattgggatcatcaattacatctgtcaggagggtgtctcctcgtcagaaaatgcagattggattcgacgccgacctgccttccgctgctgcttttcgagattgtcgacatgaccacatgtaaacaaaggctgtggccttgtttagattcttcgggttattaaatagcccttcgaaatcttgctatttaagattattaaacgtagattatcgataaaactgattccataatcccttggctattttgtgagacgaatctaattatgtatattaattcatgattagcagctgattactgtagcaaatcatggattaatatatctcgttagattcgtctcgcaaaatagcctagtggttatggaataggttttgtcagtaatctacgtttaatactcttaaataacgagattccagagggctatttaataaccctccggatccaaatagggcctgtgtttagttggatccaaagtttagattttggttgaaattggagatggtgtgactaaaaaattgtgtgtgtatgacatgttgatgtgatggaaaaggactgaagtttggatccaaactttgaatctaaacacagctaaaatcgatgcttgtgcattatacaagctcataaatgcaagaaaaagaaagatgagagatgcaatgcaagatgctgcggacagcagcaagaaaaaaacaggttttccggtgacgacagattcccaacaaactccgataatcaattcagaaaacatcggcccgtgtgggagaagctcaagtgagtaggtagagggtgaggacctaaaaaaaactggattttctacttattaatttatttttaaatgtagaaatctatagttgaagatttttttaaaaaaactgcagcagccagagttcaccaaatatggccgtcctttcaacggaaggagataaatttaaattttaaaactaaatttgacatttattttagggtattgttattatactttattttacttattgtctttaaaagctaaggacatatttataaaagttttactaacataaccaatatatctatatcttctatatatagttacagcttctaaacatctaaaactcaacatacaaatatagtaattattagtatcttaaaacttaacatgcaagaataccacgccaacccaccaaatatctaaagtttaatgtataaatatagcaattataaccataatttattatattataaaactcaacatacttacatgctaaatcatcattttgatgcttgataaaaaccgtctcatgtttgcttggtctctaaatttcttccaaatggaattattctaagttgaattcatattagttgtacttcacagcagtaagatatgcgttaatattgatcatgcggttaagtagattttacatttatatgctcccacatatacattgatagaattcgtatgtacgagttctagaatcaaatccatcgattcatggtataccacaacaaaccgcagagtataactactgccaaacgatgtgatcagaaagcactgacggaggccgccaccgagcaggtaggggtagggcgaccatccaggctccgccgctgccaccgctaccctttttactaataaatattattaatatatagtataaaacttgatcgatcaccgtgaaacaccgtgctggctccaccaggaccatcactgccaagaagaagaggagagtgatagaaagagaaagcgag

SEQ ID NO: 43839 - DNA, 4245 bp, Oryza sativa
aatgggtctttaagaaaaagacagatgtagatggaaatgttcacatctacaaggcacgattggtggcaaaaggtttcagacaaattcaaggtgttaattatgatgaaactttctcgccagtcgccatgctaaaatctattcggattgttttagcgattgctgcctatttcgattatgagatatggcaaatggatgtcaaaacagctttcctcagcggaaatcttgatgaggatgtgtacatgacacaacccaagggatttgttgatccacaatcagctaaaaagatatgcaaattgcagaaatccatttatgggttgaagcaagcatctcggagttggaatattcgttttgacgaagtaatcaaggcattgggctttgtcaaaaacgaagaagagccttgtgtatacaagaagattaatgggagcgcactgatgtttctaatcctatatgtagatgacatattattgattgggaatgatattcctatgcttgaatccgttaaaacatcgttgaaaaatagtttttcaatgaaggacttaggggaagcagcatatattctgggcataaggatctatagagatagatcaaagaggctaattggattaagccagagtacatacattaacaaggtagtagcttacttagggactgctaaacgatactccataattgggtagttataaaagtagttttcgggtatgctatgaaacatgtaatgggatatgaataatcaagatgggatttgcccctcctatggagagatatctctgggcccctcgatgttgtagattatggaagtgtatggccatgccaaaggtgattgaggagtcaatcacaagttatataatctatcaacaggttcgagtgaatgattgagctattagaggatggcacatatctagccttgagtttaatcgatatcctgaggcaaaggggttcatacaaatatacactagaggttcagccgatatgatctttatgtatgccctgtggcttaatatattctgctaggggccgctgttgatgcgtggaccgaaaaggagttttcgggttacagccgagtatatatgaacctctagggtcgcacgcttaatgggccggaataagaggattggatagagatccaatatgagcttaattcggatagggatccgaataggagtcctatgggcctaggaggcccgagtgatggatcctatatattcgtaaggggtgtgaccggcggagatattgcatcacgtgagaaaccctagccgtcatttccctccccgagcaaaaccctagccgtgcacaggtgctagcacatctgcgcgtggtgttccgtccctgtacgtgtggataccggtagaggcgccactagtttgtggtgctggtcggcgtgggagtacggcgaggagaacgcatgaggaggagaaggtcgatccggtgcgatcgactacttcctctacatcgacgcgcgctacttcacgagagttccttcgacttctcagcgtcttcttccactacgcagcgcgtcgagtggtaacgatctatgatctaatacttgcatggttcctggtttatgcaatagaaaattttgatttatgctatcgtagcctacgcgtatcccagcagtttctaagttggatgtttttttctctacatcacgttaactcataaaagctcgtgataacttcaacactattattatacaaaccattctcgataaacaacttggtaatcaagaagatcgaagtattcttcttacgaagagattcgctcttatggatatttgaacccaggactttagggtgctattcagagtactgcaaccactaggctatatgccctttcacatttgatcaattacttgaaccaagatatcacaaaacttaaatttagcacaacggatcttgctatgggcttatttggcacagctccagctccagctccacctctcctggaactggagctcagccaaacagttttagggcctgtttggcacagctccagctccagctccagccctcttggagcgggagctcagccaaacaatttcagctccactaaaactgggagtggagctgggtggagctctctcacaaaatgtactagagttgtggagctgggtttaggcagctccacaactccactccaaacttaactcctggagttatatttaggagttggagttataccaaactggcccagagagagagagagttttgcatttgcaactctctcctgtacttctctctctatacaacaactactcctcgactggactcggtccaagagaccacatacccccaacgaccctcctcccctcccccctcctctccccctcgccgagatatattttcccctcggcggcgactcctcctccacctcgtgagctcgccttcggccgccgcctctgcgcctcgcagatccccacccgcgaccgagcgagctggtgccgcatcggtatcgcatcccggtgagcagcgtccacctgacacgattttcctccagttttgctcgcgttaatttctcttctagaccttggatgggagccctttttctcttaatttgtgacagccttgttccacccccaaaaggcgcttggcatgttagatccgtcgtccctggctgactatatgattctttctgtgattcttgattggaactgtgattagtgtaaaatatgccattcttggcttgtttgaattgcctgttctttgcattgaatgatgattctaatcattgtgattgattgatgcatgatggttcattgattctgctgcagttcatcttctggctggacgaattcaattcacggacggtggtggtggtggtgttgactagggatttatttttttaccattggcggctcggctgcatccccaagtgaagaagagaattcgtacatgattccgctaaacaggagggcgagtcagactaggggtggtagatctcgatgccctttctttctctttggttatttactgttgctttagatatatgtatatgcgtctaaataatgttgttgcctttttgatcccctttggcccttgagcatgtgtaccaaccaatagtggcattttttttaatgtttagtttgtccatctaatctatgtgccccatgaaggaaactgttttttttttaagaattgctccacctgaaaaagctgtccttttttctttgccatgggattcacttggtgtacaagcacatgaacacctttcagaggtcatttcacatgcatatgtatgggctagatatttcatatggcaagcagtagtgtgtcttttgatggtatgcactattgccagcagtgaagaatttcttagcaaaaattccttttcagtagatgatcccagcccatttcttctgccttaagtaatgcttgttatgtgcacattaagatttcagtcactacacagataggcaagttgaactaaagctattaggtgcaatatttcaactgaagtcaactaagacatgcaaccatatcgatcttgtttttggtagataaatctttaagcaagcagttgccactttgctgatatcgcatttcaagtcaaagccagagtttgcttgctgtgtagtttcattatcaatgaggactggttcatttgtttgtgcggaacaggggatccatatatctgacattaattaggttgctcttttgtttgaccatgggtatgctttaatttattcaactgttgtaatggttaaatgtttggtcattccctttatgttgtaagttcatcatgttgatagggatggagtacttcgatgctaggcggaagcctcataatgttgggaaagttattgcagctctggtcctcacaacactatgtatatttattttgaagcaatctcctggttttggtggcagtagtgtggtaagatgtctatatttctttttttctcttcttcttctttcatccttattcctttaaatctgcttttaagatcagcctttcctcacgtttcatgttttgatttgtaagtcactttctgctacctataggtttaacttttggacttttctcaacttactttctcttatgtttttcttgttacacaaaaagcaattttaattttgagtatcacctgtattatagaatatgtccttgtataactagcataaaacaaaatgatgactgctattgtagttgtttcaatacacatatcttcatttctgctctcagtgctaacaagcaggtgaggaaagtgacatctctccatccaattgcctttgttattgcaggggtgca

SEQ ID NO: 43840 - DNA, 2692 bp, Oryza sativa
ccaatgatgcgtgtcgggttcaatgtccaagaaacaattgaatcactaaataaaactcattacaccattctttcctgagatttgcattgattcgctgaagaatgtgttgttattgttatgcctttaacattaatggtcatccacgaggacaaaagaaatggctaccaaccattggaacgtttctgctttttttttgtttgatatattcatattttgacaataactattctgcacaagtggacacatagttgtatgattcacagctgatggttataaaataaattacaacgaaactaggatatatgtgattatttctgctgcgacaaaagttcggcctgcgtgataaaacgaccatgaaagccatagggaacacgggcaggcagctgcaccgctgcaacaatttccagttctggagacatggcatccatcaccacgaactggctctctccggtatcctctttgtgtgtatagcacaccacatatccattgtcctcattaccatccccattatcattgcttggcacgaaaaatggctccccaacaaagcacccggggccaaagtcacggcgtgcaaccgtgcagtcgtcagcaccaaccatggcaaagtcgagctttctgattccagagaacctgggtaacggtgcgcttacaccaaagtatccatagcggttgtatcgaccgacgtagccctgatgaattacaccaaactcaaggctctccagtgagagtgcagtgcgcaaaacggtaccagtgcggagattgatatgtatcatgtcaacctgaacttgcatgagttccatgttgccaagcatgtgtgacagataagttgttggttgacaccaatataatctcctctccattagcttcctcccaggcattagctgtatgtagcatattgaatcctgggaccttgaaccacctcatctctgactcgtcctcggcataccttggtagcacaccaatccgttgtaccattgcactatccaatcctatcagcgagccaccacgtagagccatgttcatcggacacatgacaagttgcgactcagggaagatggcataatgctccgtgattgcaaagtcatgtagcattgatggttgctgcaaggagaagatgggcacatcatcagccttgttgccagccttgtcaaaccaaatatacgtgagaaatggctagaacaagctataacggaacgcgaataactctccagtgactgggtccttcttgggatgcgctgtcattcctatcatgcggcgaccatcaaagtcacaacggtgctgcggtagggataatagtggctgggtagggacaagccatggcgacaatggctctgtccagcctgcaaacttttgtaacggatgggagcatggtattggtgcactcagctatatatatatggatcgccagtgaggtgtcgtacagtaagtttgttacgctatctctatagaatggtgtagattgaagccaatcatagcaaactatcagcaaggtttgcacttcagtaaacaccgaaatttcgagagtttcaattggttttttttccacgaaattatttaaatgtttaacaaattttgactgaatttgaataaattttcaccaacttcattaaaaaaatgagagtattcgaaaatttcggatgagatgtttgcttgtcaggggattcgaaatttccaaaatttcgaaccaagattttaaaacctgactatcaatatgttgacgaagagaaatttcattttaataatacaaatgagatataatatggtcttcatcattcactattgtagtgtcgcctttgcatttttggcaactagcaagagtcctatttggacaagctagttttctggctcacaatcaaagaccacgttacggcgtggctcaagcattcattcgagcccaagaactgctcaagccattcatatcggggaaaagtacacccaaggtccctcaacttgtcatcaagatacaaaatcgtccttaaaccgcagacccagatatcagaggtccctcaactaacaaaacagttcgcttgaggtccctcggcggttttaacaccggttttagcctacgtggcggctgagtcagcgtgtccacgtcagcctcctctctctctttcccctcttctctctcttcctcatctctctctctctcttactcttctctccggggctctctgggcaggggagcaactgagaaaggcggcagcggtggtgggagcaggggagcaaggtggtggcacgcagcgggggaagcaagtcggcggttgcggcctccggtctcccccgccctcttcgctctgggctgaggccgccgtgctcgccccgtcgtctacgctctgcccaaagcggcggtggggggagcaaagacgtcgtcagtggcgggggaagcaaggtggcggcgagcggggctaagtggcagccggtggagcagagcggcggcaggcgagtgcggggcagccggcgaagcggagcggaggcgggcgagtgcgtggcggccagcggatggggagaggcaaccagtaggccccctagtggtcatcactcggctgccgcgtcctcgccactgacgtccccgaccgcgtcactcggcgacgagcgtgttggagtccaggttcccgccccacggaggcgcagccgccgttgccgcggtgccggcgccgagcaccctcgaaatatacgggcggtggcaagcggg

SEQ ID NO: 43841 - DNA, 5177 bp, Oryza sativa
tgtatggcgatctttttttctggttggtattatcaaccgggactacaaatagatctttagtcccggttggtaacaccagccaatactaaagattggaaaagtacccctggagcttttaaaccgggactatagatgtttttagtcccggtttttaatacaaccgggactattgtgaaatctggtcgaccgaccaaagatagtttctccaccagtgatttgagttataatcatctaagttttttgattgaattgactataagttttatgatacatctccttaaatctatagttttgtgataatttgacaaaactatctttttgtgaaatttactctaaaatttatttgtgctggacaagaatatataaaaaaatcaatggtaaaccttaggaggcagttcccgcccattccgcgtcccttaggaagcttaagttaaaaatcagcatggataagtctttatatgggccggtttagagatggcaacggggaattccccgtcggaggttactccaccatacccgcctccgcggtggggaattttccccatcaccatcaccgtgaaatgcaacggggcaacatctttccccatcaccgcctccgtgcgggtaatttatccccgtggagcctccatccccgctatcaacttactcaacagtcaacatgtatgcatttctcatatcaaacaataaaagattaacactcaaaatagcaattccagccatcaatttcagcacatgaacaacaactacaagaacacaagttcacagattcagatcacaaattcgcaaatgcacatcatcagttcacaaatgcacatcatcaattcatcacttacaacagcagtgcagcaacaagcagtgcaacaaaagtgtgcccaagaatacaatatccatcatattcccagattaagcaacaacacaataatacatgatcattcatcattcatcagtcatcactcattagttatcaccacattgcagcaacaacacatgttgtccaggcatacgtaaaaccatagttcggagtaggtcttttgtgccaaatatccaaaagcattgccatggtttacaagtttatcatgacacataacaggggttacaaacatccaaaatcattgcaagaacagtgcatgtccatacattcatgtcttcaaacaagagcaagtccctaaattaaagaagtagcaaaagatattcaattagtcaagtattttataaggatataacaaataatggcaataggagtttgattgctaatttcaagttgttgaaagaacacctcaatccgatcttggatatcttgaaggcaactccaaaagcttgctgcttcttcattatcagctacaagataacaattataacaattattttgcatccattgcattgtaaatctatgctaagcatgatgtatgaataaaacatcatatgtacctcgatacttgtttcgcagccaatcttgtgagcacattaaggcctccaagagttctggagtaagccggctacgatgctcactaagaacccttccacttgtgctaaatgcagattcagatgcaacagtgctaacaggaatagcaaatatatctcgtgctaccttcctcaatgtaggaaagcttgtcccagccactttccaccaatcaagaatcttaaagttttctgtattaattgaaaccaactcatcctctaagtacctgtctagctctgatttaacacgtattgctgctggtctcctactagtaacacgtgctgtgattgaagacaataaatcagaattgacaagtggaggagctgaagattccgtgttatcctcatcatcttccacttcatactccttcatcaaatcatatagagtgtctttcacctcagcaactttcgttgcacactcttcacttgactgaccagtgatggtttcaatgaacccaaggaggtagtcaatcttaaacctaggatcaagaatggtggccaaccccattggcccttgaatatctttccagtacttatcaaacttttgaatcatttcaactgacatttcctctatagtagaatcaccacaaacagcccacttcctaatttgctctttagcctcacagattttaagtagttgaatattggaagtcacataatttgtgccagaaaatactgcagtgatgtcattaaacaacttgagcctatcaactacctcactagcaaaagcccattcttcttcactaggagcacaatcaaatagcttctcaacccgtattgcacggtcaaaagcacgtgcacaaggtaaagcaatactgagcatcctataggtagaattccacctagttttgcaatcaaggcctaacttgttttccatcttaactttcacatgctttgcaatttcctcaaacttttctactcttttaggtgtggctgtccaaaaggcaacactttcacgaacctttgcaattgaatcttttatcacatctaaaccatccctcacaatcaagttaagaatatgggcagcacaacgcatatgcaaaagtttcccctctagcataagcttacgcttgccgatctttttgatgagttcagaaatcaccttatcatttgtggtgcagttatcaagagtcaaagttgatatcttctcatcaagattccattcaaccaacgcttcataaagatgttcacaaataacttctgctgtgtgtggagcgggcacatatatgaatctacaaatggaatattgcagcaagattaaaatgttgaatttaagatggtgacaagaggataatcatttgtgaatcatgtacctcatgataatgcttctaagtgtccatgaatcatcgatgaaatgggctgtgatagccatgtagcctcttttttgattatcagaggtccacaagtcagtagtaatacccactctagacttagctccagccatatatgctaatgcccttttcttttcttcctcatatgtatccataatgtccttcctatattcaaacattaatcaataaactcactaactaatcaaatttcagaaatgcaaaaccagcaaataaataatagatgaactgaaattacctaatagtgttccgagtcaccatcttgaataatggctgaagtgcactaacaaatcttcgaaagccaatatggtcaacaatagataaaggatactcatgtaatattatcatggcagcaagctctctcctagccactgctggatcaaatgtgtatgtgtccacagaaactttccctccctctatggaattgaacctcaatgaagattgtgcaagtgtctttggccccatcttgatctttctcaatgtgcaaattttcaaatggtcatgtagatgtgaagtcccattgctgctcttccctccaagccgcttgtggcaatgaaggcattcagccttgacatcaccacagactttgactttcttgaaatccttccaaacaacagaagtaagcttcctctttgtgccaaaattctcagaatcatcttctggctcatcatcttcaacttgtattggctcagaatcattaacagactctgcttgtggtggaagtgactgcgattcttgctggctgctactcccacaaccagtaccagcagttgaattcgtggtaaatctgacaaatgacaaataaatatagatcaatatatctttcagcctatagaataatcttggcaaacttgaaatgaagaatctctacacataaatcatactgaaatctgctacagcctatagaataataaatttcttatgatctacactacacagaatcggattcctttaatttcaaaaacttaagttcataacatatttataacttaacaacattcaatgtacaaccatacaatatacatgtaaagatatctaattttctacagatactctaaatacaacattcaatatctaagaaaatcaagcaagctgcaaattaataaattgcacatgctaaattgttaggaacttaggattacgaaagtgaagctacaatgtataaagggttagcgtgaaatcgaaccccatggatttgaataagcgcaggccgttggcggaagatgaagcttctggagttcttggagcagaaggagctcctgccttagtcgaagcagaaggtgctcctgcaatcgcaagacggctttttgacctagtggtggtcctttttataggtggttgcggcggccgacagcaggcctttgcaccggagttggaggaaccagatctgcccacatgaacaatggcagatccagcaacaggcacgacagcgggtgtggctgcagctgcagcgcttatagcatgcgatggctggtccaactccgcattggcgtcccttattgtggaccgccgaacgtgagttagtgactcaacgagacaatgatgcagccatggaagaggaatttagtggagggggagggggatatggtactataggtaggcgtctagggaggggtactgagttgggagtaggacagctagatgtgctcaccttgcatcgtcgtcggagcttagcggtggtgaaggcgaagccatggcggactcgagcggctggtcgtcgtgtggactcgtcgttttcccctttcttgccaccgaagccttcacctgcatccaccatgagcaaaacaaataagcctacatgacggatcagatattgacggagggtggacgaggaggccgacgtccggtggccggtgccgagtccacggcgtcctcggacctgggaggctgggagtgaagggaacgggacggcgctggggcggacgccggcacggcgggcgcggcggcccggcactggcgcggacgccggcacggcgggcgcggcggccctgagcgcacggacgcctgcacgcgcgggcgcgggcgcgagatcgggagccggcgccgctcagtcgctgtggccgacggacggcggcgtggactggggaatggggacggaggggataagggctggcgggcgcggcggcccggcgcgggcgcggacgccggcacggcgggcgcggcggccctgagcgcacggacgcctgcacgcgcgggcgcgggcgcgagatcgggagccggcgccgctcagtcgctgtggccgacggacggcggcgtggactggggaatggggacggaggggataagggccggcgggcgcagcggcccggcgcgggcgcgggtgcggacgccggcacggcgggcgcggcggccctgagcgcacggacgcct

SEQ ID NO: 43842 - DNA, 26963 bp, Oryza sativa
cgtggactggggaatggggacggaggggataaggattggaatggttagggttacacaattgctttatatactctatgctttgggcctggtttttatgggccatatgggccaaatacacaggatattactacacacatacttttatatcgggcctccacggagggcggggacgggggacggggaaccaaacccgcccccgccagacccgacggagaatactttctctccatttgattccccatggagacacaattaataccatcaccatcacctaatgggagaattctccacgggggaccggggaccgggtacccattgccatctctaggccggttgttatatgccgatgtattaaaaaacgacgttgatgatattttatgtgttagtagttttttttaaaaaaaaactcgcacatgtattacaaatacatacattgtatccaaaaagagctggattcatctttaaagccagtcccctctaatcctctctctcttccctggaattcctcacctcctctccttgcttctctccccactacaattcttttaggcaaaatttgttacaagacactgaaagattacggtctttgctgtgagacacccgaagatcgtgtatttgctcgtggacactataaaaaagtggtaattagctgctggacactcatcccattattttattatttccggtcaaaatggagagagaagagttgcgtaagtaccaaaatacccctgtacagtgttcttcctctcacttcttttcttttccccatcttcttcttcgcagtggagcagagggcgacggcaaccggcccgagccgggacggctcggccacggcggggcggcagcggcggcgcatcgcccacgcgctgccggcgacgccctccgcgtcggcgcgatgcgcggcggcggcggcgggctcaacttcttcggtcgcgctcccatgccgcccgcctagtcgacctcatcacctcgccgtggcccacccgcgtcgtcacgtccaagcacaccgccccctcgtcgcatgctccgcggtgagctcccgaggaagccgcgcagccgtgtctgtgaggcactggcaacgtcgtcgaggccgtccgccacgagtgctccatcatgggtgaaatccgcgcgctccacaacatggacgacgacgaggtcttcgcctacgccaaccgcatcgccgcgccctacgacctcgtcatgcagaccaagcagctgggccgcctccccgtcgtgcagttcgcgaccggcaacgtcgccacccccgccgacgccgccctcatgatgcagcccggctgcgacggcgtcttcgtcagctcgggcatcttcaagagcggcgaccccgcacgccgcgcccacgccatcgtgcaggccgtcacccactgcaggtcatcgcgtccaagcacgccgccgcctcgtcgtcctcgctggcacaccttcgccgtggagctctgcccggtgtgccgcgacagagaaagagaggaagagatgaacggagagaaagagaggaagaagaacagagaaagagagattgacaagtgggcccatagacaaatttgcctttaaccaaagtttctctctccattttgaccggaaataataaaataatggaaggagtgttcagcagctaattaccacttttttacagtatccacgagcaaataaacgatctttgggtgtctcacagcaaagatcacaatctttcggtgttctgtagcaaattttgccattgaatgtgaggaccgatgactatgagtgctaatctgtctgtctatcagtaaagagtacggggcatgacgctctttcccacctcctgttcatcaattgggattcatttatcgatcagatgcatttcggggaataaacttttccagactagtactatgccaaattggagagagagtatgccgatatacatagttaataaaaacccgtagcgccccattactttctgtttttatatctttttatatttttttcttctcggagaatttaatgtgtattggactactttggaaaagtttctcgtgtatatgcagaattttaaacagaagctcccacaagctgacagcttgtgtttgtttcgaagaacccctcaaccttgaagaaaagtataaaaagacgcggaaaaatttttgcttctaagaatatataacgctctaaacatattagtagaagggtgttttcacataagagctatccctcaacccaacacacaccaaaccatccacttcttggatagttcgcctactttcagttcatggaaaaattatttatttattcagcttaacctttggtttgccctacgtctcagctctgcccttaatatgattgtgatgttcatatggagctctcgatggtctgagttgattgaggttaacaaactaaagttacttaatcgtggatcagttctaatttatatagatattcctttatattagagcatcatttttttcaaatgatacactacttaaaaagaacctcataggaagcactatcataggtattggtacataaaaaacgacacatatgagattttcccttttttcataggtctataaataaaaactggtataatgacttacatatgttggtttataaaaaaaggcaccaataatccctcaactcatatgtatcggttcttataggtagccgttcttgtaataaaccggtagctatgagtgcatcgtaacaggtgtcgatttttattggaaatcggcacatatggtcatcatttatctgccgaccgttgaaaattaaaagcggcacctacgttggcgctgctaatatatgtgtgttttgcacataacttttttatataaaatcggatgaagataaattttatatcaaatttctagagcacggtaagttctgcatctttgtagttgatgatatttttatttgagatcatttggaagtctgaaatatgtgaatttattttggataagtgaatttctaaaagttcctagatctatttggataagtgaatttctaaattttctaaacgatctccgatggaggcagaatctatatgaaagttatatatctaaatgagatctataattttgtagttgaaaatattttcatttcagctcatttatagtattaaatagtagtaaaaagactttgagtggagattgaggttgtgggctcgaaccgttctaactccatgcgcttgaaaataatgaaaaaatattgtgagttgtccaaaccaaagtgtgaccatgtataaatgactagtaaaatacaaaatattttttgggttttttttcgagcatgtaaaaataaaatagaggtgcaccttatagggaaatattcatttggtttattttgagccaataaaaataaaaaaaatcatctttataagtgtcgattctaaattatatccggtaaatcttgtgagtaggaaccaaagtatgaccatggatatgtagtaaaatacaaaatattttttttgtttttttagccctaaaaataaaaaaacgggtatacccctatatttgtcgattccaattagaacgggtaccaaactaccaataaggatatcattggtgcccctcgttagtaccatctgacgggtgttggttggggagtcaacactatgtagggtttatgtaataatgacatgctacccataatttgttttttctttacacctagtacctcatgtcgcaccactagctgtgtgacgtggcactgcgatccctctatcaggaacatcagtttatatatattatcatgtgttgttcaagctcgggtctcgcattaggcacatagcctgtcttatgttggtgactgtttttggtcgcagtcatttgtagtttcttaagcatggtacatatttgtttacatccactcgaacacgtatggatcattagttcgacacttcaagtattcaagtcattctgtatgaactcaaagtgacaacggaggagtttcaagcacttttttacgtccattacaacttgtgtgaatcatttcgtaacgaatggagtgcacatagagttcacatcaaattgagttaaatcatgccttgtacactcaaaatgacaatcgaggacttcaagcgcttttctacatcccctacaacgcgtgtgaatcaattcattcacaataaattaatggagtgaatattgagttcagaacaaatagagaccaatcattctatatggattaaaagtgttattatattagaggagattcaagtatttttcctgcatccactgcaacgcgtgtgactcgtcggtccgcaactgaagtaatgaaaattgagtttatacctgcatggatcaaaagttacattataggagtttcaagtgctttcttatatacattcccatgcgaatcattggttcgcaacaaatgggaagaatcattctgtatgtacttaacttgacattagaggagtttcaagtatttcttttaacatccattataactcgtttgaatcattcatttgcaatgaacggagtgaaaattgagtttggatgggagggttttttcctccgtaatttttgtatcttcttaatgaaatgactcacaatactaattatcttgcatgttcgagaaaatatgtggttcaagctatagggttacaggtggtactttttgttgccctgtgcaatctttgggtgattcggaatgatgtacatcatatcgatgttccagagtctcctaacgttgtcatggagaggatcgctttttggttggaagaatgggcaaatctgaatagtggtaaatcaccagctgttcactacccggcgaaatggtggcaaacgccttctagcggctggttcaaggtgaacatagatggagcattcatggcgtctgaacttaaggggtctgggagctgctagctagagtagttctgaggaataacaagggtaagattttgggggcagcatatattagcatgccaaggggctctgagtctggctataaaaatgggagttgcagagttgattctgaaaacggatatgttacatgtggtgaatatgctatctgaagaagagttcaatcattcaaagtataggacagttatccaagagttgaaatgtaagctcaggtacttccacatgttttaatgcaagattgttaatttgttattctcgccacaagaataagggcatttagcgaccctttcccatgacccacggatgaaagagtcaccagaatgtatgcctctattattttgcgactcttcttggttgtgagattatgatagctggtgacacattggatgacttttgcagaagactcaaggttcacaaatctagtgataagagcaaccgcaatgtatactaccaaagtggataataatgtgggcccagggttcaggtggtaacagttattacaaatctcacaatgtgctatgcctattctgcaaattaaggtggggtccaccttaaaaagaatcattgtaaaactatctcctatagccatgctagtacaaaaagattcccatatctacagaaaatattgtttattctcttgttaccggcagtagcacagtggcccggtagtagttattgtctctacccacaatgcttcttacctggttataagtctatattaattacttgttacctgctttttgttcaacattgtggttgcccttaccagctggtgacacattggatggctgtctgtagaagagtcaaagtttttaagtcttggtgaccccttacaagtgccatgtgttgtttgtttaattgtagaaacacttatgtttaattttctagggaacggtttacgaactggtcctcggttcccctatgttccttatgtcttactcccttcgtcctaaaatataaagaattttaggtaaatatgacacatacatcctagtacaatcattctaaatagactccatgtctagaattattgtactaaaatatatcacatccaccaaaatacttgagacggagggagtatcttgatgatggctatgaagagcccagtatgtttgaataaagtgtctttaggctgtgctgtttagggcactcacagtgcgtagccaacactgccacctagactaagaactttgtatgcaacaacctccacagtgcacgtggtcttctttttccttcacagtggtcccacccttctctctcctcactttttacctcctctcctatctctccctgccttccccaaccaggccacaaaactgctccctcctctagtgcgccgccggcgcctcccacacaccgccgtcgcccctctccccctccgccggcgtccctctccccctccggatctggcggcccgccggcggcgacacggcgcgggagccgaaggcggacgaccctgaggcgatctcggcgaagggcgctagcggcggatgaccccgaggcgggctcagcggagcgcgccggcggcaacggggcggagacggcggcgcggtcggcgacggtgccgaggcggccaccctctcctcccctgaagcggcggcggcgccaccgcgctgcttcggcttcgccttgggcttcttcgacgaggaggaggacgccgcggcgccgcccttcggcctccccatggcgcgggcgcgtctctctctctccttccgggcagcgcttgctgacgagacggcggcggcaggcggctagatccagctcgggcggagaggcggcgccgggagttggtttggtttgcttcttctctacttcaacggttggtcgacttcaatgcaagaaagcatcggcagcaattgctcctcccgtttagttaatgtcgtccatggcctccaacgaaggtattcttctcttctttctcaaatattctgtttctcgcatatatgtttgctccttttttttttccttctgctcgcttctctcttcttctgttcgtcttggtgatgacgaaactgaaggagtatttggtgattgaatctgcagaggccggattcccttctctcctgtgggatgaactcaacgacgacgcggggcaggatgaactcgacgacgacgcgagcgcgggagaacgacgaaacgaggtcacgacctccacaatgcgcgcaagtgcctgttcctcacgccgctcgccctggatttggccgaggaacgcgtgaccaaagttggacgcgcggacttgagaaaagtgtgccagaagctaacgtggcaaggaatctatgcgctggcgcagtgaggctgaacgccatctcaccgcattgtaaatggccttagtgtgagttctagctagcttctaaaaatacaataaccagatttgtggcacacggatgttggacagttggagtgctgttttaggagtctctgaaaagtgaccaagaatctggcccttgggttaatgacaaatttgattcaacgataatacatgaatttaattgaatatacacatgattttacaccactgactgtagtgacaaaaaaaatatttcagctctatagatgcaatcaaatcgtaaatgcgttaattttaaaactacctgtctatctgaagaaacaaaatagcaaggtcagctgtaatagatagatgccagaacaactaacaagtcggtcagaagaagcccgatagcatcaaatacgtattttggggcaaataaaccccagacctgcaaagtttgacattgcatagtgtcacataaagtccaccataattaattagcaaaagcaggaatactcgtggtattcttatgtggcgctggggtaaaaattaccatcaagtgacgccgttgaatggtaacacaaatgattgtaagcgttgttgtgattgatgtaattaaaccatacatcaaaagcacctaagtgaaacaaaacagacaaggggccccatcgatcagtaagcaaacaaacagaaaacataatttggtctccaaatggagttccataatgcatgcaagatcagtactccctccggttccatgattcttaacattttggatagggttgaggtcaaacttttgtaactttgaacatcaataactttaaatatatttagtttaaaggaagtagaacaacataaaaaataaatatatttagtttaaaggaagtagaacaacataaaaaagtaaacacgcatttatttattgtatatatatattataatagaaaaacaaagtcaaagatgtattttgaaggccgtgtcattgtccaaaacgtcaagaattatgaaacgagagggagtactacgctttgtcctattgtttatattctgggagctccaaattattttttgtatccaatattttagtgcctaactacttgcagtatatttgaatttggcatagataccttgaagttagtattttaggctgctgctttgtaacgttaaactggtccagaaaaaaataaaactactccatatttctaactaattacctgtattaatctggtgacagtggcatcattcaccttgctgttcttggatgcagaattgtaccagcatatggcaataaacggaagactaagaacaggcagtatgtgagaaacgccaaaagtatcaatggaaagaagaaggccttgtcggataatatggaaatgatcaaacctgtaaaattaattgttgtgataagtaaaccgtgtgcatcatgagagatgcctttcagcatttatatttggaacatgattacactcacccaatgaatgcagcaccataacggaggccatcaaaggtacacctgaaacataatttttgatcaacaatgtattttcaacaactccatctaaaaatatgaattaaatcacatcagatacagaaaatacaaattgtacatgcattttattccagactaggaaacaaattgcatactaaaaatgcattattaacagaaagataaattctaactaaaagataaaggtcagtaacatccacacagcaaagaaattaccaatgacccgtcagataaaatagacaaactgccagaaagctccattgtgttactgaaacagagtcagcagcatgtattcctttgtcaagtttcagctctctctgatttttctgctgtaactttattatacaccatgctgcaaaatgaaaaagaaaatcacatgccatgctcttaattaggacataacaggaaaagaatctcaaatagtgcccaaagtagtaattgccatgttctgagaagcaaccatatgtctaggaatagagctcacagtacctatagtcatacaaattagagccacaaagggaccttgtcttcccaacaagatcaagatagtaggactccaggagcacagcatgacagctgacaaactagttatcctttcattcatcttcaaatgatcagttgacccaaacaaccgataaaatgcagatattgctaatgataaacctccaatagtgtatacaaggcgaggagctaaacttattccagtctctctagtagctttagtatgagagagcaaagtactttcagaagcccaatgaattgctataaatatataactcaagatgcttccagacataacagagtacttcaagaatctatgactgatcgcataggatatgcacttcaaaattatataggccactaaggtaagagatatgatggggaatatttccatgagatcactgcaaaaacttgaaccaaacaggccacaaataatgctgactgggtggtcatttgaaattattgacccagaaatttgttttgacatcccaaactcaatcccaaatcgtatgaaaatattaaggaggagaaaaacaaactcctgcgaataaatagagtaaaagtagatcagaagttgactatacataataatagaataaaactgaggtcaacacagggaaattgggagcattaattgtgataagaatattaacttctatgatgaattttccttttgtggctgagtgccacacactggcaatgcaactcgtggccaaaagaaagtttgcaactctaccttctgccactgcatcacaagaaatagatgcatgaataagcaggtgcaccaaataaatttataatatttgatgaggttggtatatctgacaaactcacatatatagctattggataggaaacttgctgcccgaattgcaaccaatgcaaaagcaaagaaatttttcggaatgaaacttgaacttgctctttccttttctgaaatttgatcaatattcaacttcacaagcatacatgcctgagtactaactgacagtatcataactgaaagaccaatgcccatcagccataaatcaaactcagtccatgcagagcgagcaagctttgcaaagctctccaagaagtcagagtatgcatcaatttgcaaccgcagagctgaacttgtgcattccttatttgcgcactcctttaattcatcctgactgcttgtttccactggacatgtagacctcaggacagaggaccaatttgcctgagcttttgaatacagatctgcaacatggttcaggtcttctgctcgaaatccaataacagaagtggcagaatatcgatcaatgtacctctttacctatgagggttaactgaaaatcagcgtagagcttcagcaatccacccaaccaaacaaatacaaatgaactttcatattacctgccaacaatttatacagagagcttcagcatatctccgcatccatgcttctagatcattctgctgtgtacaatcattggcaccgatctgttgattatcccatgttccagcactcagagcatacaattctgggtttacacgtccaatgctagatatggcacaatagaacacatttcgtaaatatactgaattaagtactacaactatggaaggatgtagggacaatagcaattgaaaaataaaatcaagtcgaatcagtatatataatgaaaaaaaaaagcaactagatagtgtctctagtcaaaccagatagtagcacacactgcaaacaacagaaacaagcaagtaccaagtaaagcgtacacaccttccaaaaggaaaaggtataccaagtagcgctgctatagttactgcaaaatcaagctaagaacaaggagaaaaattaagcaatattgatcatataagccatcaacataaaagaatgcagttagcactgacctgctgcatagtgctgacgcacacctctttaccatgctagaaaagaaataaacgtgtgattagtaggcacattactacagtcacaaataaaagcaagcaaaatctggctaaacaaaatgtactacgattaacatgtatcttggccaaaaactgtattacatcaatcactgcttatttcaaatttacattcctaaaatctacaggccctcattcccactcttttcattaaaaaacgctgcatgcagtacttcatagccatgcataacacagtcagagtagagtttaaaatagtcaatcactttgccctacggttttagatgtcaaaccaaatatacaacagtaaggcattcaatatggaagcaagggattagaaaaatatcttctgtacgcaattctagtttaagtgttctagacaaaaaaaatgtaactcaggttataatatggccaatgaatattaattataattgtttgaaaacttagtcctgatcataacattatcgccatacatggcaagatagctcaaatcataattagttagcagaacatataggataagaaaatgtaccagatcagcgttgcataaatttttaccaagaacagacaagacagcatttggtggggtcttcggactccatgcaaagagcgatgtttcaacctataatagtaacagcattagttatgtagacatgattaccatttagtgttcctcttcagcatttagcaacaaaacataagatagatcacctcttcagcagttcctccaccatgatcaccatttagtgtttggccatgatcccccattacaagaagtaaagtattctcatggggaccacccgatgttgatagacttttcaatgtgtcaattacatcctgtatgagttaaatatagcagcatttgattatcatagttaatatggccatcatatgggaataaagaacataatgaggtcaaatttaaaagaatgataagcaggtaagcataaagccacattatatatttgtgcatgaggtgactgacctctaggatccgattgtattgctccaacttctggatcattggggtagagtcaacaccgaatatatgccctgcatggtcctaaaggaagttgatctcacatgttctttattcaaaacggacaggataaaaggattaaatttttaagctaaggcataagagaatgcacaataacttaccacgccaaggaaatgtgcaataagaacgtcccaatcatttttgtgtaatgatggaagcaagtgctcaataacaccattgtctacctgatatatacgataaatacaattactggtaatttcatggaaaatttatgggaggaaaaaaactcgcactgcagaacaaggaaaagaatggtacaaaagatatgacatactgtgtcaagatctttaacgttaaaagaagggtaaggatatgacttgttgaaatgttcagggtataactggatccaagtatcgtctcccatcatgacgaccctctttccatttttggcaaactgattgagtacaaagaaacaataggcaacacatacttccacggttagttatccagaataaactgagtaagtttactgacaccatatttgtaatgttagatgcaagatgagattgtgacaagaacctgatgcattatgttgttcttttactattgctggagctccaaagctattccccacatcaataaatgtaggcagaccacctgtcgtcagagcctgagtatagaattttacagcaaggatgttaaagcctgggggtgaagaacacacaaagttacaaccatttgattgcactgaatcgtgcagagcatatcaggtcaactcaattcatgaatgcatataatgcgataatcttatactgcactgaattgaggaaaggacaacaatttttcagggtaactctgttgatgaatgaatgaatatctggattaacaacaacagaaacagagttgatcaccttaagacgttgaaggctagtcgtcggtggatcagcaagcgctttgaatatcctagcagaggtcttctcatcagcagccaatctttgcagaacctgcagtttgtccatccatggttgcctctctgcagcgaatcatggcctcatctcagagttacaaatcacattctcacatgttacacgttgagcattatagtaatacataaaaggagtaaatcaccttgaaagaatgtacttggtgccacaaaatcgaacctgcaggacagtgcattgcacaactgtgtcagctccaaacttatcctactttctcggtaacccaacactgagtataatcgcagtagccaacaagagatttaatttctctcttggggaatctaagattcgaggggtggtgattttacctgagggcgtcgaggacgacgatgacgaggcggtcgacggcgggcgggggccaggaggagcagcccggggagatgccgatgcggtcgtcgcggtggctgtggacgtcgagctcggtgcgggtgaggaggaagccgcgggtgaagaggtagatggcgagcgagtggaacatgaggacggcgaggaacagcagcggccacgcgcggcggcgggtgtggctccccggcgccgccatggatcccgtcagcgaaccgcggcgagatctggcggggggcgggtggggatggtggaggcgtgcgccgtagcgcggcgagcggcgtggcttgtggcggcgtcggacggcgtgttggatgggcctaattagtgggcctacggctttttgggcttactggcccatcaacgctcatgtcttctactgggctggatgcaacatgctgtagttgggctatttaggcatagtaaaatggaataagtgcacttaccatccctcatctttccgtctggtttaattagcatacttattaaacctcgatatcattaaatggttttgcggttttaaaaagatttaggtgaagatgtctgatattgaggtttaaacataatggacagaaagatgagggatgacaaatggacttattcctagtaaaatgcgtgaccatagcccgtcaaaatgttccactgctgatcagacggttaaactgctaatggtggacagttctaatcgagaggctgccctacagtaggaatgcaggatatgctttgacgatatttcttcagtggttcagtggatcaagtgtgtagcgctgcgtcccaaaatataagctactccctccattaaaaaaaaatcaatttagaaagagatgtgtccggagagagtaaaacgaatgtgacattttttttaaggacggagagagtaaaacgaatgtgacatttttcttaaggacggagagagtaaaacggatgtgacattttctagcccttttgtccagattcgtattctctatagattcgtaagaatgtttgaaatgagcgagacaagcagtagagagtatttcatgatcaaataccctcctgtaacaatcaccggattcgacggaatcccacgacagaaggggccgaacaaacaaaaattgaatccaataccaaatttcatgtggttgaagcaaaactggcgagttacacacctcttacatgagaaagatccatagcatccgcgcacatataaaagacccagatacactaaaccagttggatgtccgttacacgcatggcaatcggaaccgagattctaagcagcagagaaacaagacaggtaggtctaaggtagtgctagtttggcagcattacacatcagcgatcgtcacctcgacctcgacaccaggctcgatggtgatggaggtgatctgcttcacaacatctgggagctgatgagatcgatcacccgcttgtggatgcggaactcgaaacgatcccatgtgtttgttcctggtcagaaaagaacgcaaaatagtcctgaattagcacaagaaaacccaaccaatgtgaagttaagccaacaagatgtcagcaaatttccctagcttaagcaactagcatccaaagtggtttcatctaacaaagagcgtccagtttaactgttgcaagcataaactgacctgaagatatattgatgaaagataagcatgaaagtaaaaaaactgtcaatcatcagaacaatatgctacaactacatgagcataggtaaacaggggtacaggatgattggcacacaaaaaggatatacattacaagttaaacatatcatgtactttgtccaattaacaaatcaatgaattcacataataataaatcccatgaaacaaactcacatgtccacttaaatgggcgtaaagtttgatcctttagtttagtgatgtctttttgcaaccaagtctcttgcgcaatgcaggcttcgagcctatggttgctataatagtgggaagagcactaatcttgtttatcaatggattccttctctaatactacctccatttataaatatatgacaccgttgacttttaaatctacgtttgaccactcgtcttactcaaaaaagttatacaggtatcattaattttgccatgacttgttttatcatcaaatataccttaagcctcacttatatttttatatttgctcgattttttgaataagacgaattgtcaacatatatctaaaagtcaacagcgtcatacatttaaaaacagagggagtacaatactacatccatcccaaggtgtaactatatctagctatgaatctagacaagttcatatccagattcaaagccaaagagagctacattttgggcaggaggttttactacactgcgacctttgtaggttaggagccaaaaagataaatagtaaccagaggagtaacaaactatgatactccctccgtcccaaaataaacaaacctagtacaggactaggaagtgccacatccccgtactagctttgtttattttgggacagagggagtacctagcaagctacgagactagccagtagtttcttgtgccactggtactcgatcccataacagttatcactagtccataacaaaccttaaatttaaaagtagcattgctattattaccaatcatactaaactatcaggatacaagagggccagcccacaaacccacttataggccatttaagtgcaccaacctatggtttacccacttgaatagcccataaatgggttcaaaagccagcccacttgcattccaatagaataccaacatatgtgccttccaaatccctgctaaacaaaatcttactaaaccttcttgacttcagaacttggcttggctatctttaaaattatgacatgtggagaataataacactaaaattgaagaaacgtctgtatattctgcccccttaatatgagactgtgggggtaacggcaagttttctgagcttgcctctagatcattcccttatctagaagtgaataacataggaatatcctagtttgttgtagcttgacagtgtccatcgcttgctatcccgctgcccatccatctccatgcatgaaatggttgggtgatgaaatggttgggtcgacaaagaacaggtaaaccaaacttattcaccacaaacctccaatagtaacccttctactcaacttgctataccatgtgctttcactcgaaaacttaaacattcatccttcattacattttggtggcaacttgttgctggtagtctttattgcagattttagatagccgaaagtcactataagaacatggccatacaacaataacacttagtgaagtactctaactaaggcaaatttcaacaaagagattgcctgaaaaatcaaatagttttgactaaatgattccaatggtcacacaatccacactagtcaccaaccaagagcactaatttagaccaggatctagcttaaccaagcatctatacactggcatctatacagtggcatctgtctccaccaatccatttcctaaccacctaaaccaaagctatacccatgagtcgaaacataccacaaaaacaaatggattcaaacccaatcaagcattgcaattagaggtggctgcaactggtcaataccttcaccgcacggcgacttgcgggtggtgatgtggagcaccttggtggggatcctgacggggcccttgacgcgcagctgcttgtccttggcgcccttcaccagatcagcgcaaactgcaaccataaacacacgaatcagcttcgcgctctcagcaaaaaaaaatccgatctaatctaatcctctctgaacgacaacgaactgaaactatagaagaaaaagagaaagaatggattacccttctcgaggttcttgacgttcttggaggagagggtgatgcggatgcggttgagctgcagctcccgcgcctcctccatgccgagcttcccgcccttcatcgcgccgccggcgccgtacaccgcagccgccgccatgtttgcttcgcctcgcctcgcgttctccgctccgctcgctcggggggtggggttggtggtgctcggggatggcggcgcgggtggcgttagggtttcggagggggcggaggttcgctcggaagggccatttatataggagatgatatgggctcggcccaactctaactaacctctgaatgggctgtctctcagactctcactctctcttcttttggctgtctgaaattggaaaagtgtatggtttttttagggtaatatatgatatatatttttttgaggtgcaacataatcaaagattcaaagtggccatcttttatgcttttgtaggattttattagtttattgtcaggttattctctaggaatatttgtttataaaggatatagaacaagaatagattaataaaagggattttagattagtagtacgcaatgctagaaagtcttataacctgaaacaaaggtagtacttgtcgatgacatggggccgagggtatcatgactagaggtttgggtagccgcggtcacccttgggtcgggcctgagggtgacgagacctccccgccttttatctccccgaggggtcgggccgctcccgtttcggccccgagggcaggggcgccccgaccccctgtggttttgacgccacgtgtatggtttaggtgagcacagcagggctcacctaaccgcatttattgcggtttggacgagcgcgccacgccgcatttaatgcagcgcagcgctcatccggtccgtgaccggtcgcagtgtgtgaccggtcacagaccggtcagatcgcgggttaggtggcaacaggcggcctgacacacgcctcgccccgtcccgtcggattgatgagagcctccaggcactcgtccctagccggagccggcgtgctacctcctggagttggcacgtcagtcccgcccagatatattccaggcttcatcgcaaccattgcaaggaagtcgttgtatgaagaagggcagacatgcagcttgctaaactgacacgtggtggacaacaatgaccggtctgtgactggtctgacgctggtcatgtcataggcagacaaccgcgcacccattttgcacctccttccagcggagtggaggtaggtatgacccatcccatcggagggtcattcggatagcagccattgcaaatctccgcccattaatgaaggaatgacagggtgatcccctatgtcagacgagtgaggacgctgggccacactcaaagacaagctatattttagcttccaagagaaggcgaacggggttttggtcaagagagggtgggtccccacccaaaagaagagtaggtagaagtggagcatgtggtatccccttgagttataaaaggaggaccttgcccaccaaagagagggacggagaagaaaaaaggggaaaggaggagcaaacgagttctagagtctaaacttgttctagctctcgaactctttgtagtttcttcatacacagatccaccagaacacaggagtagggtattacgcttctcagcggcccgaacctgtctacatcgcccatgtctcgtgcattgcctctctcgcgaatattccacagaccgagggcttagaacctcacttagcgccccccgccgaaccggcaaaggggggcctgcgcggtctctcggtgaggagccccacgctccgtcatctggcgcgccatgtagggggcgcgtgtgtttttctaagctctcatcctctttcgtgtgcgccaagcttctcccgttcaacccaatggccgaacgagcaaaagcgcacaacctctctctgagtgctagcggtgacgacggggagcagaacccgcgccgtcgagctcgtactccaccgcccccctctcgccgaagtcttaggcgggaggaggcgctcgagggggtcgaaagatccgcaactttgccgcccacgagcgatggagaaggacggcgagacggagagcgtcgcctcctcgtctacggcgatggcagcacgccccagggcgtgctccaagctgcgggcgcgctcttgcgtcacccgcccgtcgtccccgatccagagactctagcccgacgttggttggatgacgtggccgacttggtcatgacggcgcagcagcgcctaggtgccggtgggcggtcttccgccaccaaggcctctggcgctgctaccgccggctccgtgtcgtcgaggtggagggcgcggcgagcggcggctgttacccgccgttcgtctgccattctctcgtcaacgcctccgacccaggaagatgtgcgtggggggccggatgcccgcctcggtttcgagcgtcggcgcaatggtcgtcgtgctgcccacgcaacggagggcgcctcctcgtccggagcgccacttcagtacgggcgcgggggccagccctccgtgcccccggttggtggtgttggctgtagagcctttgtggcgagccttcgaaacgtccgttggcccccaaggttccggcccaccatcgccgaaaaatatgacggaagcgtcaaccccgccgagtttctccaggtctacacgaccgggatcgaggacgccgggggtgacgacagggtcatggcgaatttctttcccatggccctgaagggacaggcgcggggttggctaatgaacttgccacccgcgtcggtccactcttgggaggatttgtgccagcagttcaccatgaacttccaaggcacatatcagcgcccaggtgaagaagcggacttgcacgcggtacagcgaagggatgatgagtcacttcgctcgtacattcagcggttctgtcaagtccgcaacaccataccatgcatccctgcacacgtggtgatctacgcgttcaggggggcgtgcggcacaaccgcatgctcgaaaagatcgcctccaaggagccccagactaccgcggagctttttcagctcgcggaccgagtggctcgcaaggaggaggcctggacctggaactcctccggttccggtgtggcagcttcggccgcccccgggtccgctgctcggtcagggcggcgggacaggaggaggaagaagaggtcggcccattccgacgacgagggtcatgtcctcgccgtcgagggtgcttcgcgggccacccgaaaggggaggcctgcgagcgacaaaaagaaggaggccggcgctcccagcagggagcgcccgactggcaagtggtgcaccgtgcacaacacctccctccacgacctcgcggactgccgcgcggtcaaaagtttggctgagcggacgaggaagtgggaagaggagaggaggcaggagcgccgtgagggcaaggccccggcggctccctccggcaaccggcgaagtgaggccaagcaaaagggacccaccgaggacatcgacgatggcgacctggggccaccatcgccaccgtcgatgggggagcgtgcactcacgcttctcgccggagcctcaaggccatgaagcgagagcttttggccgctgcccctacccatgaggcgacgcggcgggcacgatggtcggaggttaccctcaccttcgaccagaccgaccacccgccgtgcgttgcccggggagggcagatcgcgatggtggtttcccccaccatttgcaatgtgaagttggggcgagtcctcatagatgggggcgcagccctcaatatcctttcccccgcggccttcgacgccatcaaggtcccggggatggtgctccgaccgtcccagccgatcatcggtgtgacgccggggcacacttggccgctaggtcatatcgacctcccggtcactttcggtggttccgccaacttccgcacggagcgggtgagcttcgatgtggcggacctcagtctgccctacaacgcggtcctggggaggcccgcgttggtgaagttcatggtggcggtccactatgcctacctccagatgaagatgccgggccccggtggccccatcaccgtccatggcgacctcaaagtcgcgcttgcttgtatggagcagcgcgcggaccacctcgccgcggcgtccaagcccgcgggcagcgacgagaggcttagaccctccgtcccagccgccccgaggcagcggatgatcacgtacgacaaggtcccggtcaaggaggttgccctgggcgacggcccgtccaagaccactcgaatcggtgatcttctggacgacaaataggaagacgcgctcgtctccttcctgcgggcaaacgccgacgtcttcgcatggagaccggcggacatgcccggggtccccagggaggtgattgagcaccgtctcgccgtgcggccggacgcaaggccggttcggcagaaagtgcggcggcaggccccggaacgtcaagccttcatctgcgaggaggtggcgcgacttctggaggccggatttatccgagaggtcatccatccggagtggctggcgaacccggtcgtcgttcccaagtcgaacggcaagcttcggatgtgcatcgactacactgaccttaacaagacatgtcctaaggacccttacccccttccacgcatagatcagattgtcgactccactgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaagacgcacaaccaagagaccttactcttggatttagcggaaactttcgaaagtctccgctccgctcgcataaagctgaaccccgacaaatgcgtgttcggcgtgcctgcgggtaagcttctcgggttcttggtctctgcccgaggcatcgaggccaacctcgagaagatacgagctatagagcggatgcgccccccagccagcttagggatgtgcaatgcatcaccggctgcatggccgccctaagtcggttcatatcgaggctgggagagaaggcgctactcctatttaagctcctcaaacgctccaggccgtttacctggacagaggaggctgagcgggccttcactcagttgaaggattacctcagttctcccccgatcctggtcgccccggagccagatgagccgctgctactctacctcgcggcaaccccgcaggtggtcagcgcagcgttggtcgtggagcgcgacgaggacaaccctcacttcgcgcgtccccaccctgtgtcgactcgacccgggagagagcagggaggagaggcccccgagtcgaacggcggcccgaggcccccgacggccggagctggccctccgcccgcttgtccgacggtgccaggcgcccccgacccccaggatggcctcggggccactgcgggaaggccgcgcctgtcgccctctgaccccgaggtcatcggcgcagaagccaagtgcgccccgtgcggcctctcggacgaagagcgccctggagatgcggcccttagcgaagaggatcggccccgccgaaaggtgcagcggcccgtctacttcgttagcgaggccctccgggacgccaagacccgataccctcaggcccagaagatgctttacgctattctaatgacttcgaggaagttgcgccattattttcaggcgcatcgggtctcggtggttacgtcttaccccctcggccaaatcttgcataaccgagagggtactggacgggtggtgaaatgggcaatcgaactctctgaatttgatttgcactttgaaccatgccacgcgatcaagagccaggccctcaccgactttgtggcagagtggaccccagctctcgagcccgtctccgccctcgaggccagcttgggcccctcacagctgcctcacaccgcctgctgggtgatgtagttcgacggctccctgtctcttcagggcgccggtgcgggggtcacgttgacctcgccgagtggagacgtcctcagatacctggttcgcctcgactttagggcaaccaacaatatggcggactacgagggactccttgcaggactcagggtggcagctggactggggatccgccgcctccttgtgttaggcgactcccagctggtcgtaaaccaggtctgtaaggagtaccggtgctctgacccggagatggacgcttacgtacgccaggtgcggcgtatggagcgccatttcgacgggatagagcttcggcacgtgcccagacgggataacgcggtcgccgacgaactctcaaggcttgcttcctcgcgagcccagaccccaccgggcagctttgaagaaaggcttgcccagccgtcggcgcgacccgaccccctaggggagacggacgcgcctgaacggcccccgaggcccgtcggagtccaagcctcgggacccgaggggagcgctcccagctcccttagattgattgcttggaatcgctcagatccaggcgtacctcgcagataagactctacccgaggaccgcgaagggagtgaacgcgtccagcgcatctccaagcgctacgtgctggtggaagagaccctctatcggcgcgcggctaacggagtcctcctgaagtgcattcctcgggaataaggcgtcgagcttcttgccgatatccatgaaggcgagtgcggagcccactccgcctcacgcaccttggttggcaaggcctttcgccagggtttctattggccgacggctctcaacgatgcggtcgacctggtccggcagtgcaaggcgtgccaattccacgccaagcagactcatcagctggcccaggccctgcagaccatacctctttcatggccatttgctgtctgggggctcgatatcctaggtccgttcaggcgggccccgggcgggttcgagtatctgtatgtcgctgtcgacaagttcactaagtggcccgaggcttatccggtcgtcaagatcgataagcactccgcgcttaaattcatcaagggcatcactgctcggtttggggtgcctaaccgtatcattacggataacagcacccagttcactagtgaactcttcggtgactattgtgaagacatgggcatcaagctctgcttcgcctcccccgcccaccccagaagcaatagccaagtggagcgcgccaacgcggaaatcctcaagggccttaaaaccaagaccttcaacatcctcaagaagcacggcgactcgtggatcgaggagttgccagcggtgctctgggcgaaccgaaccacgccaagccgagcaaccggggaaacgcctttcttccttgtctacggcgcggaggcggttctcccatccgagctcaccctgaggtcccctcgggccaccatgtactgcgaggctgatcaagatcagcttcgcagagatgacctcgactacttggaagaacgaaggcggcgcgcggccctccgagccgcgcgctaccagcagagcctgcagcgctaccatcagcgccacgtccgggcccgatcactctgcgtcgacgacctcgtcctacgccgcgtccaaacgcgtgctggattgagcaagctctcaccaatgtgggagggtccgtatcgagtgattggcgtcccccggccgggctccgttcggctggccacaggcgacggcacggagctgcctaacccgtggaacatcgaacaccttcgtcgcttctacccctaatgggagttggatgtcaggtctcgggctcgggccaaccccgcacccccctcgggcgtgcagggttggccgggggctaccacacatgcatattcttatcttttttcttccgtatttcaataaaagcattttcgatttcccaaggactgcgtctgtgcctttgtttccttttgaaaaatcttggcttgaattagcacgctcgtgctcgatcctgcccttggtggcccgggccggctaaaatcgccaaaaggggcccagaaccgagccgtgccccggggcgtggtgaactcccggggggggaatcggcaaaggcccacaatcgggtcatccataaccctcggtcaccacgttcccggcctggccagtctcgacacgtgaatctccccaggcactagccccgacccgcgccatttgaggctgggacctgggcacgagcccttgttcaagctaagacacagaaggaccgtggcacagaccatcctcgtctcatacacacaacaaaagaaattgacacagaaatttcctctttatttaattgcagattaagttagtctatacaagaagggggcccgaaggcctcggaaaaagaaggaaaaaactatttaaagattggcggaggcctgggggctcactccgacgcacccgggtcgccggcctcgtcaccgccgtcaccgccctcctcgtcggagtcgagggcgaacgcgagccgaggggccgtaccctcgaagttgtggacgatgtggtcggcggcgtcccggacctgcgcgcgcgcaccgtcctcggtcccgggagggaactcgtccagcgctgcccatggggagaagtcagggtccctggcctggtagctcgccagtacgagctccaccgctcctcgggcgaggtccctcgaggatgacttaattgtctcctcgagctcctcggggagccgctggagggtcccggccatctcggagaggcgctgggcgaggcccccctggttggcggcgtacttcacagtccgcccgccccagagacccacctaccgcccggcgcggtctagacgggagacgccgtcgcgaagcatgctgggccctatctcgcctgccaagcggagggcctcgacctcccccgtggacgagttcagcgcgccctgcagatccgcgatggtgtgttcagcagctgcgaggcgggctgctaagtccccgtcgcccgcggccgccccgccgctgcgtgccctcgcatccagctcccttgcccgcgcctcgagctcagcggtccgctgatccagtgcggccctctcggcgcgggcaccttccagattgcggcgcgcttgttcctcccgcgccgcctcgcggagggacaggctgtccgccagcctttgcgccgcggcctcggcctcctcgagagctctctcccgctcggtgagcgcatcctcgcggaggcggagtgtggactcctcttcggcacagccggcctcgtgcgccgccagtgttgtctcccggatggcgacggcggcctcgcggtccgccaggtccctctccttcgcgcgggcgcgctcttccagcaccatggcgcgggcctcaagggcttcttcgcgccgccgggacgccgcctcggtcttcgccgcccgccgttcccgggcagcggcggcgtcaaggaccccccgggcggcgtcgagcttctttcctagctccgccgcctagctcccgtattggaggcggagatcgtcccgcgcctcgttcagcacggcggtggcaatgagggcagcctctcgcttctcctccacctccctggcaatctccgccagctccttccgacgggcctcgagctctcaggtgtgccggcttctttcctagctccgccgcctagctcccgtattggaggcggagatcgtcccgcgcctcgttca

SEQ ID NO: 43843 - DNA, 8642 bp, Oryza sativa
gtcgttgtatgaagaagggcagacatgcagcttgtaaactgacacgtggtggacaacaatgaccggtctgtgactggtctgacgctggtcatgtcataggcagacaaccgcgcacccattttgcacctccttccagcggagtggaggtaggtatgacccatcccatcggagggtcattcggatagcagccattgcaaatctccgcccattaatgaaggaatgacagggtgatcccctatgtcagacgagtgaggacgctgggccacactcaaagacaagctatattttagcttccaagagaaggcgaacggggttttggtcaagagagggtgggtccccacccaaaagaagagtaggtagaagtggagcatgtggtatccccttgagttataaaaggaggaccttgcccaccaaagagagggacggagaagaaaaaaggggaaaggaggagcaaacgagttctagagtctaaacttgttctagctctcgaactctttgtagtttcttcatacacagatccaccagaacacaggagtagggtattacgcttctcagcggcccgaacctgtctacatcgcccgtgtctcgtgcattgcctctctcgcgaatattccacagaccgagggcttagaacctcacttagcgcccccggccgaaccggcaaaggggggcctgcgcggtctcccggtgaggagccccacgctccgtcagtactaataataatttgattgatataatagacaaaagaatccaacttcttcgcaatgtacactccctgcttcctttagtgtttagggaaaaaaagcatgcagaaaacatcaatttttctaagctttttaccattttaacgtaagttccttttcccctaagaactcatgtaaaaaatattttttgtctatactagaaaaagacgttttccagcggtacaacgactattaggagctataatgacattataattttacactaatttataatctacattggtcaaaaaataaatcacctaatagaaacatctaataaaaaatataaaatattttagagttggaccagggtttcacttatcgtgtgataatcgcatcacttatcacgcttatcgcgggggtacggtaggggaaaccggcgatatgatttggatgaattttgaccaaattcaaaattccggaaaaaatcgaaaaaaactgaaaaaattcatggatgtagcgcgataacatgccacctcatcgtccactagtaataattacaaggaaaaattggaaccatgccattataattttgcaaaatttaagatataccatcctgaaccacatgtcattgactcatatgagttctacatgtcattgagataccgatgacatatcttaaactttgcaaaattataatagcatgatttcaatttaccctaattacaaacaagcttatgcaagcatgcaacatatctataattcattgaattctacatatcaacatccaatcatttttcttcacattattttttcacaatatttttaacatatatatatatatatatatatatatatatccatcatttctatattacttaacatatattcatctatacaattaaagtgtagaatatcatatttcatctacaatctcatactaaatgtatttctctctaaacatactttgacaaaccaattttatttgttgttaataactaatataatttatacttttatacttttagctcgatcattaaaaaaatttagaagttacttggcaatttccgtagaaagcgtgggaaatcacctaatgtgtcccttcggtagacgtgcggacgcgttgtgtgcagtggaagaagggatagaaggacgactgcgctacaaaattccatgcatagaaaccttgagggttcatagcatgggtttgaacaacgtgtaaattgaattcctgccttttcttactccagtgttttcaaattcctacattcgaaagaaatcatgctttaacagagtactcccttcaacacagagctccctgcccattgcctcaaatcgtgtaaaaaaaataacttaaccttcagattaccatactcaaccgagcaaaagttcatcatgaacaaatgtctacaagaacaatactgacagcaataaaacgagctaacggattctgctgcaagtccttggacattgagcacaggaccattcatcagtagcaaatgctacagaaaaggaaatgtttgttgctcagctatcagcatacatctttggtcgatcaaggatgtaaataaaaaaaaatctgacaattaagcttgaacacttacaaagtatggatgttttccatgagcacattgtcaaaatatctctgaatatgaagttgcatgatcatacatgtattttacagaagacaacgcatacaaagacctccagcatgctttcagcttacatttttcttgaccagtagcaagaccttttttctcccatacgttgccattgatgcaagtttacaaggtggcccaaaggagttaatctgtgacatctcaaaagggaaggaaaagaaacaaacaaaaaataagtctttagtcaacaatgtgcatcattggcgatgtacaacaaaccagttttttttttcttcagagaagaaaataacaaggcacctgcattagtgtccatttccatgcgtctcatgttctgcttcctctgcatcctcaaaacgttggtcattgatctgaagctgcataaggacattatgaggtttttgttcgagttagctcatgagattggcaggggaaggaacaaaagagttttatcttagtatacagatcaaactgttcagaaagtaactgtttgatgtttataataattttgaaaggataatcaactgccaccctgaatcacacggtatatctgtatatgaattaactataccttaacatattatgtgacaaaaacagtaagaaatatacatatggtcgtagtttctaaataaaatgacgtgagaggatgccattaccaattcctataccatatgttgtagtaaatacagattatattcacaggagcccgaagaaaagaaaaaacctttacaaccaagcttataacacaagagttttatttcacttgcaatcgtttcacagaatcatataaagcataaaacataatggtagaacaaaccaacagcatacctcaactacagcatgagtaatatcatgttcatcagtttgacctatcgggttgacatctgaaaactcacattagcatcacttcctgaatgcaagataatacataaaagattatgcataacgtttggatgaacacaaaagagaaatgaacagggcgaattcttaccaccagtcatatcttcatcaccttcatctctatgagcccagccattctcttcatcactctctggtaattaaaaaggcatacatcaaacaaagaacattcttttattgtttattaactattaaaacttaccagcattaggatcggggttcaattcagcacaatgtgagaatgcttcaaagagtccatccactgaaacttctgtcaaggatccaagatataatgtgaatatataatagaagatacaaatgcttcaagaaatagtattagtcaattcttcaaataaatagcatttcaaactgctggaaataaaaaatatatctgccatgatgatctgcagtatgatactaattatgcaaggtagtttattcttgattagctattaatcccaacagagaaccatttgtaactgaataacataagacaagcaaatttttacttgtgaaggaacagaatgcacacattacattcttaaagtagtaccctctagagtgaagacctactcttcaagaataaacaaatctaatcatgactattagttgctacagtcatgagaataaattaaaaataaagagctaatgaaaaatgaacatagagcattagaaatgatagttatttcatgtaaacctgcactcatatcaaaatttagtatgcaagcatcagaggtagatttatacaaggaaaaccaataaatgctcctacatcagacaatttactgtaaaaaggatacactgacaaggatcagatggtatgatacgcatctcagtgactttcgatagctctgtttccacatttacttcggagtctgattcatcggactcctcatcagaaccatcttctgtctcaatctttgaaaattccaacaaagggaatagcaaacattagaatcagataataaaagataacaccgaaaatagacaaagaatcaattgtgatatgccaaattcactaaatacatcaacatcacatttcagaattcaaaatttagcagctacaagagctctaaacaaaaaccacgaagaactccgcacccacccagcatacaggacaaatgatatatccagactaggatcactcttgagttgaaaattatgtaccagctctatgaagattacaaaaaggctgcacgtgataaattacatccatacatttatctttcaactatttgctactatgctagtagcaaaaatcaccttcactggtgtttgctgcgtacaaactgaaatctactaatgctataagatcaaaaggataaaaccaaagagaataaacaatagcagtgtccatccgttagtacccggtgaaccaaaggagaaaatttctgccaatcctctcaaagaaaaggaaaataaactccaccttagtcaaatgggtcatagcctgtagtttgtcacggcggcaacatctgtagcagggagttcaaagcagaagccagcggcccagcctgtgaatcggcccagaagggagaagcagcccaactcccgtttccctgcgagtgtgtggacccagtagtgattggctgggccactgtcagtgagtgagagaggctgtgtagtgcgatgctatataagccggcaggattgagaggaaggggatcgaatcatgtaatcaaacatactcaaattcaattccatctctctcctgttcaattctgttctgttcttcttcttcttcttcctcaagccaactctctcaatctcttcccttctctactcgaccgaatctctcctacgagttcgagaccgtgacaatttggtatcagagcaatttcgatcctggagaagccacgatatacttcccgtttgcaacttcaagtcgaagcgatggagaagcagaacattgatttcggcaaggtgttgatggagatctaggagtccttggtgaggctgaatcgtgctcaaggcgaaactcaagcagcggtcgtcaagctagatcgcgaagtgagcagttggagacctcaagtagaagcagcagttcaggagttgcgtgaggaagtcggcgaccttcgtcagcaactggatctcgtcggcaaaatgaagcaggcttctccggcgacgtcttcccctccagcaccatggcgcgggcctcaagggcttcttcgcgccgccgggacgccgcctcggtcttcgccgcccgccgttcccgggcagcggcggcgtcaaggaccccccgggcggcgtcgagcttctttcctagctccgccgcctagctcccgtattggaggcggagatcgtcccgcgcctcgttcagcacggcggtggcaatgagggcagcctctcgcttctcctccacctccctggcaatctccgccagctccttccgacgggcctcgagctctcaggtgtgccggcttctttcctagctccgccgcctagctcccgtattggaggcggagatcgtcccgcgcctcgttcagcacggcggtggcaatgagggcagcctctcgcttctcctccacctccctggcaatctccgccagctccttccgacgggcctcgagctctcaggtgtgccggcggtgtgccttgcggcccgcctccaccatggcctccaccgagcattgcccctcttcgacacgcgctcacgccgcgtcgagctccgcccgctctgcctgcaggacctccatctgggcatttaacccatccaacaccgtggtgttcgcagtggccaaggcttgcagaaggggctccgcgctcagtggggcagcggaaggcatgggagagagccgcctcggtgagaatgccgcacggctcggcccgccgatcgacgtgccggactcggggacgtcccccgaacctggctcgtcctgagcgtcgcccgaggagtcgggcccgagcggtgcgcctgcggcctagtcgtgggtggcctcggaagtcatcgtcgcctcgggcggagtcgggtcgggggcttggcaggccgcctggcgtgcgcgtgccacctccgcctcccgggcggactcctcggcccggcggagcctggcctcctcccgagcggcttcctcagcctggcgagcccggacggcctcctgggcagcctcctcggcttcccgaaggcggtccgcggcttctcgccggtcagcttcccgcctccgggcctccgcggtcgccgtatcctcggcctcagaccggccggacttggaatggcgggaggggcgcgacgggatctcgctgaagcagaagaaaaaccagaagacaaaaagaaacaggtaagtgaaaactcgctttgaaagaatgaattcggccgtagtaggcgcggggacgaacctgcgaggaggtcggttaaacgaccaccttgggggggagatgaggtttccccggcttggctcggtcccccccatcttgcggagccgtttctttttccgctccccctcgggctgcggcgttggcgcggcaccttccgagcgcctgctgctagcacgcaccgccccgccccctcggggaggagatggggaaggggtaccctcctgcttcctcttcccccgggcgtcggcagggcggctgccccccgggcccccgtcgcggggcccagaagcacgaccccctcctggggtagattgttcccccctgcggctcccgcccgcgccatcgtggcctcgaggagcccgctcctccgacgccccgaccgccatcatgatggtcaagatgttggcgcgatctggatcgctgcagagggggaggactccttgggggatgagggacgcctccacggagctgagattcagcacccgttggaccaccatcttgaaatcctcaggggcccagtcccatctgcccccctggtgggtcctcatgtagtccttcgacccggtgtactcccaggcgccccgggcgcgccgctggagcggcgcgatccggcgacgaaggtagtcgtcgtacaccatggcccccgtgagcccctaggatcgcaggcccgccaggcggtcaaggacggtgtcgtagccgtctcccagatctaccggcacgcgccagctggaggcctgcgccgggggctggctcggaagtcggaggcgcgcttcgtcggcgaggggggtgtagaaccagtcgctcttccagtcgtcccacttcttgcgcaggacgcagggaatgtagcggctcagcaccggcccccgcggctggaagtagcagccaccgaccaccgacggcggcgacactggctgtacggtgaagaaccaccggaacagccgaagagatgggcgcaccccgataaacatctcgcacaggtgtgcgaagatggccaacgtcattaccgcgttgggggtgaggtgcgccatctggagatcataatgctccagaacatccatgaagaaagaagagaatggcgggactagccctgccattgcaaaagagaggaagaagacggaccgccccgggtaacgtggcgccgggcgtccctcgcccagcgcgaccatctcccggccggtggcagattccggcatgaagcggcgcggtagcccagcctgcctctcgctcacgatgcgggaaggcggcagcacgctaccatcgagcggtgcggagccccgtgccatgacgccggcagaggaggaacttgagaacgagcgagtgcggcgagggtagggcacaggaaacgaagagttagagcgcaagcggcgaaggcaaggggaataatggcgagaggaaggaaacgaatctcttcctcggcgtctttatacccttgccaacgctctgcccggctcctcgcttcccgcgcccactatctcgccccctcgtttcttgcgcccacgcctctgctaatcccactcgcccgtttgcggcgcacgaggccgtggcagtcgagatgggacatatcgtgcgcgcgttaacttcgctcgccgaccgaagcgccatcatcacgtctccaggcgaaacgaactgactcgtcccgattcgcgcgctgctcgagtgatgtggcagtctcgaagaggccgctcattattatcgatcagttttccctgccaatgcgtgcgacttgcgaccgctgagttcctacccgcctgtagagaccggccccacctgtcaccagatctaaagaatggcgtcacgcccgagcgcttccctcgaggggggcgatcgccctggcgtgacgccgggggctactgtcgatgacatggggccgagggtatcatgactagaggttagggtagccgcagtcacccacgtggcccgggtcgggcccgagggtgacgagacctccccgccttttgtctccccgaggggtcgggccgctcccgtttcggccccgagggcaggggcgccccgaccccctgtggttttgacgccacgtgtatggtttaggtgagcacagcagggctcacctaaccgcatttattgcggtttg

SEQ ID NO: 43844 - DNA, 719 bp, Oryza sativa; identical to SEQ ID NO: 39800

SEQ ID NO: 43845 - DNA, 797 bp, Oryza sativa; identical to SEQ ID NO: 39801

SEQ ID NO: 43846 - DNA, 767 bp, Oryza sativa
tcctgcagcccagaaccataggagcatgtgaagaagcaatcatcttagcacgacgacacaatgtacaaaccagatcaagatctttcttaagtttagacaaaccacgaacaagatccaaaccacttaacctcgtgagatgatcaaatccaatatgtcgaagtttacgatgcgaaaacatcgcatccttattaaacttagaaaccaaacatgttatcataggtaaaacagaattttcaaaatcacctttaaacactcttccatagcgagagatattcatcataaaatcaccacaagaatcaaatactttacttacaattttcttaaagtgaacctcaaaattttcatcgacaatttgtgaaactaaaagcaaattatactttaagtcctcaaccaaagctacatttttcaattcaaacttgtcatttaccttgaccaaacctgtggcatgaacggcactagtagaagcatcaccaaagataatcgattcagtcttggatgcctattcgagggaggagaaccaatttttattaccggtcatgtgccacgaacaaccggaatccatgatctacatgttcttcttcctcgccaccaaagcctacacacaagaagatgtcgaagccttagtattggggctagataataaaaatttaggaatccagtactgagatacacgaccattagatccaataggcatatatccctgtcacgccgggaatttctatccaaaattccaagcgcttacatgtgtgttaaaccctcgtccagga

SEQ ID NO: 43847 - DNA, 11204 bp, Oryza sativa
  unsure (1)..(11204): unsure at all n locations
gcccaacggcttagggaggggtttctttgaactttttcaaataaaacaatttgtgaaatgttgtttcaattaataaaaatacttcccttgctcaaataattcccagaaaaatctagaaaatagaggagcaagtatagtatttaataaaattttatgtagctcatttttatattgaaaattttcctagaaaattagggtttagcttgtaggcttttaaaataatttctaaaaatgatttaaaatatgcatttttaatttagttgatttttagggcgtgacaaacctaccccccttaaacggaatctcgtccttgagattcagaagaactggcgaacagatgaggatgagctgacttcaattcatcttctcgttcccaagtggcttcttcttctgaatgattactccactgaaccttgcagaaccgtataacgcgattcctggtattcctctcgcttacttccaaaattctgactggcttctcaacataagttaaatcttcttgaagctctatacgatctggatctgcttcctccgtaggtacacataaacatttcttcaactgtgacacgtggaacacgtcgtgtattcccgccattgacggagacaactctaactgataagctacttcacctcttcgactcacaatcttaaaaggtcccacaaaacgcggtgccaatttccctcacaatcttaaaaggtcccacaaaacgcggtgccaatttccctttggtttggaaacgatgaacacctcgtaacggcgtaacccgaaggtatacataatctccttcttcaaaagccaaatctctacgacgattgtcggcatagctcttctgtcgtgactgagcaacgtgcaacctttattggataatcttcactttttcttctgcctgtcgcaatatgtctgtcccgaagacttgacgttcaccggtttgatcccaaaggagcggcgtacggcactttcgaccatataatgcttcatacggagccatttgcaaactagcttgataactattgttatatgagaattccgcgtacggcaaattcttatcccaacttccaccaaaatctagaacacaggctctcaacatatcttctaaaatttggtttactctttccgtctgaccatctgtttgagggtgataagcagtactgaaattcaaacgggtacccaattctaattgtaatttctgccagaacttcgaagtaaactggctacctctatctgacactatcttcttaggaacaccatgcaaacataccactctggccatgtataactctgcaagcttattccccgtataggttgttttgaccggtatgaagtgagcgacttttgtcaaccgatcaaccactacccaaatagaatcatgtcctgccgacgttctaggtagaccggttataaaatccattcctatttcttcccacttccactctggaatcttcaacggttgtaacagaccagctggtttctgatgttctgccttgacccgctgacatacatcacatagtgccacatattctgctatctcacgtcgcatactggcccaccagaattgttgctttaagtcttggtacatcttagtgcttctagggtgaatggaatacaaagtttcatgagcttctttcatgatagtatccttcaactccttattttctgggacgcaaattctttctcctaaccacacagttccttgctcatcttctacaaaaccgatggcttttcctcttctcatgttctttttaatttcttgtatatcaggatcattcacttgagcttctctcacttgatcaaacagagtaggttgagcttccaaagcggccacaaaacctttgctgactattcccaaattcaacctttcaaattcttggcataactcccaaggtaaatgtcgaccttctgacatattacagtagcttttcctgctaagggcatcggctacaacatttgctttccccgggtgatagtggatttccatatcataatctttaatcaactctaaccatcttcgctgacgcatgttcaaatcaggttgagtgaaaatgtacttcaaacttttatgatccgtatacatctctgtacggttaccgaaaagataatgacgccaaatcttcaatgcatgcaccacagctgccaattctaggtcatgcgttgggtagttattctcatgaggacgtaattgcctagatgcataggcaaccacctttccttcttgcatcaacacacaacccaaaccgagtcgggatgcatcacaatacacttggaaacctttcctcgaatcaggcaaaattaacacaggcgcagtcactagccttttcttcagttcttggaaacttcgttcacaatcctctgtccacttgtacttcacttccttctgaagcagacgagtcattggtctggcgatctttgaaaagttctcaataaacctgcagtaatacccagcaagtccaaggaaactacgaatttctgaaaccgtcttgggttgcttccaacttaatactgactccacattgcttggatctactgccactcctccacacgagatgacatgaccaagaaacttcacttcggacaaccaaaattcacatttactgaacttggcataaagctaatgctcacgtagtttctctaaagctagacgaagatgctcttcatgttcttccttcgtcttagagtaaataagaatgtcatcaataaacaccacgacaaacttatccagatattccatgaacaccttgttcatcagattcatgaaaaaggctggggcattagtgagtccaaacgacataacggtacattcgaacaaaccataccgagttgtgaaggcggtctttggtatatcttcctcacggattcgaagttgatgatatccggaacggagatctatcttggagaaaactgtagcaccttccagttgatcgaacaggtcatcaattctgggtagaggatacttattcttgatagtgacctcattcaacgctcgataatccacgcacattctctgagtatgatctttcttctccacaaagatgactggtgctccccatggcgaagtactgggtctgatgtatcctttctgaagcaaatcatccacctgtctcttcacctcagctaactcattagctgccattctgtatggtctcttatggatagggttggttccaggtaccaagtctatccgaaactctatgtccctcttaggtggcatacctggcaaatcctcgggaaacacgtcggggtagtcttgtactatgggaatctcttgtagagcaacttggtttaagatcacaccatgatatttaggagaggacacaaagaaagaaacggtttccccattgctactggttaaggtcaccttacggttggcacaatctataactcctctgtgacgagataaccagtccatccctaagataacatctagatctttggattctagcaagataagcgaggatgggaaaggaacttcttctatttctatggtagcggaaggacaatactgggtcgaaaatacttggttgcctggggtattaactagtaaaggtctcccaagactaataacttccatcccatgattgctcgcaaaacttttagacaaaaatgaatgtgtagcaccggaatcaaaaagcacagttgcgggtatagagttaacaggaaacgtacccaaaaccacatctggtgcattctgagcttctgctgctgcaacatgattaacacgtgccttcggtgctggaacattagagttgttcggggttggggcattcttcacacgccgaggcttaggacacttatcagcataatgtcctggatcaccacaattgaagcatatcactggcttgcttccctgttccttcctaacgggctggttctgagctggagttgctgcaggacgagcaaccgtgttacggttgtcattgccacgattaccagtattgttgttgtagaactggcgttgggggcagacaactgatgaagatcctccttgagggtacggtggagcttgaggtccagtaacgagacgcggcctctggttactgccctgttgtgccttgaattgggcagccctgtgcttcttctgctccatccggttatacttgtcttcctgacgaatcgccttgtccaccaactgctggaaatcccggaaatccgtagacatcaaggcatacgacaactcatcattcagtccctccaagaacttctcctgacgttcctcatcggtacgaacatcctctggagcatagcgagctaaacggttgaaatcatggaggtactcggtgaccgaacgagatccctggttgagtgctctaaattctctcttctttagagctacaacacccgttggtatgtgtgtcttcttgaaagcggccatgaattcctgccacgtaataggctctccttcagccctgccttggcgaaaatgatcccaccattcagcagcaggtctatgcagttgatgcgaagcaaaagaaactttctcctgctcagtacactggatcaaatccaaattcttctccaccgcatgcagccaatctcctgcttctactggattggtggtgcttgaaaaggtagggggtctcacacgtaagaaatctgccagcttgttttggggaggtggggtggattctgattctgattgtttgcctgctgattctgtgcctgctgcactaacagattgatcagttgtgtttgttgggccagaatctgagctagcgtgggatctcctccattgttagtagctccacttccacttccggtgcgcgtgttcaccatctgacgataagcagagacaacaggaaagaacgacagagagacacccttagaacggagttatttaattaatttaaattctatattgctattaactgtgtatgattacatttaagttgcattaacactatctcaccaactatcttacactctgacaagcaaaagaactagactcatgctgttacatcccacccatgatgtaagcaacaactaaaacccacacactcacaagcaaacttaaacaagcaatctaacacagcgaactacggcaacgttctaactaagcgactaatcccgccttgcgtcggaacgaagcgatgaatcttcttcctctggagtagctggctctctttcttcaggatcttcctcctcttcctcatcacttatgatgtcgatgacaggttcagcacgatcgggcacagcttcacccatcacatgaatcttcgaagctaactggagacgaggtggcggacagattctctttcttggagtgaggcgaagcttgggtgttggcggcggcgtttctcctttaagttcagctaattccttctgtagacggtacaccttgctctccaacttgcaaatcttgcctcgattccagttttccctgtcatgagctgctttgtctcgttccacacttactgcatccatagcactaagcatatgcaccgcatgcatcagagtggcactctcttcaccatcaggacaggtatagattccatagtcttgaccatgaggcttgtgaggatgatactggaaagctgatgaatccaactcttcttcaaagtgttcacgcaactctccaatggccaccaacgctgcttcttgacaagcatggcagtatgatcttcctccagcttcgaacttaaaagacggaaggtcttcactatcactagccaacgtcacacgaacacgacacttctcctcgtcggggtcatgggaaatttggcgatactcgggagcaacttcatagcctacctcaaaagccatcaacctcagctccctgacgaatcctaacaccttgatcaaatttctcagtgaatggggcggcatctaaagaaacatagaagagaagaattaatgcatatttttctaagttagctgcaccaactagacttaactgatttttgaccaaaaaggaagaaaagaaaagacacatacaaagctattttataaatatttttagaatttaacttttttggacagagacaaaaaaatttttttttttgacaaataacaaaaataaactaaaatacttatgatctattataagcacggtacagtgtcaccataggaaagatgagtagtactagtgctatcatgattgtatcgataccataatggatgtacagtgccgacaaatcaataagacttggtaaagagagaaagaaacattttgagaaggacgaatttttgcttttaaaagaaaagaaattgaattaaataaatttttgtgcataaccttgcatgtgctgccaacttaattaatttataagagactagagaagagcagttctatttttttcaaaatattttgaaggctacttaaggtttaccatttggcttatcctaaggtcaaggtggctctgataccaacttgtcatgccgggaatttctatccaaaattccaagcgcttacatgtgtgttaaaccctcgtccaggaatcaaccgaggcacacaatgacaatttgataatagagtacaaataaataactatcgaataatcgcaaataataaattattacagaggtggatagttcctctcaaagaaaaacattctacgcatcggaaaaaaaaaactataacaaactacggaacagctatggcgactccactccacaggcatcttaaccgagaacaagcctaatccaccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaacagcatttaataaatatttaagagaatagtaaaacggttgtataattaatcaatattaaataaacaccacacaacacacccatgttgcataggcccaaccacatttgaacaaccaaccccagttgaacaaattaaacctcctaaccaggaattatccattccaaactaggaattaaattaattaccacattattaccattaatgagtagtgtgagactaatcacgaaaaacattgctcaactcacccataaccgcgggtacggctattcgaatagtttaaactctgaccagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggtatggactccccagcgacccccatggacttctcgccacttctcagtctggcgcactataatgaatcacgctatacaaaagataaagccgttgcccacgctggcttgtggttggcacgataaatgtatcacaacagtagctcgcgaaccggtccttaattgtcatgagcacaaccatcaaaaccatatgctcacaacccaccttagccaggttttaattatcaattaattaacatcacacgatttaccatcgtgagctaccattgaatataaccctaattaataataaaataatttagatttaacccctttagttagctaatgtttctaagcatggctaagcaaacatacatatatagcatttagctgaaccaatccaatatataaggttcatgctaatcatattataacccataggaaaataaagtcatcttcggccattaattaactgggaaaggttcaccacccgatgacattcgaaaacaatgcatagttgaaataaaataatagctttaaacgggttcaacatgctcaaagggttgtttaggatctgtgtgacttgccttgggcttccgcaaacgcttcggaaccttcctcaacggaaacgctctcctccggaacgtcggaaactaaagcaaataaacaaaatcaacaaaacagtacaaaaacaagcataaacagtacatgtggatatttttaacatgtagatcttgattttagaagaatttagcaacttgaaccacctaaaacggatctacggttatttagttatgattttccgaagttttaatctattagaaaattggaaaaaagaaaagaaaaaggagatgatgacgtcatgctgacgtcagcaatggcggccggttagggtttgcgagctcgccggagctagggcggtcgaccgggggattggaggacacctacgcgtagaggacatcgagacgaacccgatggtactcaccacgacgacaaacgatgcacgacgacggccggcgacgagagggcaacggcggcggctcggcttgcgcggcgacggcgggctacggcggtcggcggcaaagaaggatgggcggccgagcttctcctcaccacggcgctcctatcagcggcggcggcaagcggcggcgacggcggaggcggcgcagcgacgacgccgaagacggccggcggcggcggcgagcttggcgcgcgtggcggcggcgctatggggcacgggagaggacgggaaagggggcaaacgggagaggacgacgaggggatgctttataaagcattagattgaagagattggactccaaacgagaggaatcgactcgggaaaaaattcaaactcggttttagggataaaatcaaaacgaactcgattcggatcaaatcctcaacgattcgctccgattcttgggggaaaagaaagaggagaacgagaggaacaaaacccctcaaaaacccggaggaatcggggtcggattgaggcggatttggaggtagaaggcggcggcaaagcggcggctcgggcggctcggccggaggttgaagacgagcccgacatgtgggccccacatgtcggtgactcgagagagaggagggcgggcggcggctgggccggcgtgggccgcgcggaagagagaggatgttgggccgaattcggcccaacggcttagggaggggtttctttgaactttttcaaataaaacaatttgtgaaatgttgtttcaattaataaaaatacttcccttgctcaaataattcccagaaaaatctagaaaatagaggagcaagtatagtatttaataaaattttatctagctcatttttatattgaaaattttcctagaaaattagggtttagcttgtaggcttttaaaataatttctaaaaatgatttaaaatatgcatttttaatttagttgatttttagggcgtgacaatccccttacaaaaacagtttgaaaattttcagaaaaatttctctgaggccgatctgaccgaaggtgtacagccggtctgaccaagggtcggtctgaccactgctgtaccgttggtctgactggtgctcagtctgaccgaagcacagccgccggattgactggtcgccggtctgaccgcgggacccattgcggtctgaccggtttcctcgagaaaacaccagatttttgccactttgattttgcaaaagcaatttctctctgctttttctatctatgagctaatctaaaacaaaaaccaacaagatgtccatctttaccacaaaaagaacaagcatcctttttctttagaagaagatggttttgaaatatttgtttttgtttattttagtgttgtagaaagagagggcataactccagcagacttgaaaactgttttcttagcactaggtttggtcaaaatttagccatgttcagtcacactcaaaacattgggttgattttttattgaaaaagtcatgaacatcaaaacgaacacccctattgtagctagtcactttagattgatccaaaataatgttaagttgtttcttaccatcagaaaatctttgcaaagaacttttcaaataagaaacctatttttccaaattagcacaattttcacaatctaccatgacacttttgctttttcgacatttggggcaagaaagcacttcattggttttcacaacatcttccatgtactcaacacgacctaaagcatgttttagtttcatcttgtttagtgtgcatattgagcaatcaaaaacactttgttgttgttgttttaactttttagcacaaaccatgttaaacatcaaactagcatgaaaagatatttgatatttttttcaacaactttttagttaaaaacaactcatccaaagtacgtgtgtgcaagacaaaaccaagagcaagacaagatctatttttcaaatgatgtgcaacgttgacatctctaatttttgaaatttcatgcattaaaacctcacaatttttgcaaccatcatcattaggaataagagattttaatctataaattttagaattaagggattcaataataaattcctgttttctatacatcttctcacacttcttattttttgtacttaaaataagaatagcttcctcaaaagaactcacatcattgtcttcacactctgaatctgattcaccatgtgccatgaagcaaacaccggagatgttctttcccttatcttcatcttcactttctccatctacatcgcttagtggctcaaaagcggcatagactttctcaaacatcttcttgagattctccttggtcttcttccccttgaatgtgctcttagactttgttctccttagtcttctctccaccattgtcttcctttttgcctctcctaagcttaggacaatgcgaacgattgagatcaagagcaccacattcaaagcaacgatcgatttggaccacttcttttcctgtacctaacattattcatagctcgagaaaacttattaatgaccaaaaccatgtcctcctcctcgaactattcgagttgctcattcgacatggcattaattaaagcaagaatagtagtaattcgatgaagaagcaccaacatccaaagaagtcaaggaagaaaccaaatcactagacttagagtcaactttacaagaaataatattcatctcatgtgttttgagttttgtgtaaagcgaatccaaagtcaaagtaaacatatcaacagactcctgaattgatgtaactttcatctcccaaatagacatgtcaagaccattcaaaaagtgacgagaaacctcagattgtgtgtaatttatatcataagaagaatcaacagatttaagatcactaaaaattttttgaacctagaaagatagtcattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43848 - DNA, 6532 bp, Oryza sativa
actttcatgtagaaagcatatttttattttgccatttaaatggtctaagtcgcgcttgaaagcaggcttggtttatgggccttcacatgttggcccacttctaaagatatttttcttttgtttatttctgttaacatctttattttaacaagtcaatccaaacttaaaaaaacctaaatatcttttaatatacggggtattacattcctcccccttcaatcgaattcgccctcgaattcgcccactgtagagcttgagaaaccgtaagatggaaaggaatacacaaaacatacatataaagtagttaggactctcaagcaatttcgaggacatctcctatattcgcaacactgcttgcgtctaggtatggtagataataattaactagcataagaaagtatggtagccaacaattcaaaagcagctaataaaccaacttggacctactagacaggaatattggcttgccaaagaagtgcaatgcacatactaaaacacccaattgggacatatacaaaaatcattggaacacatcatgaagaatcttactacaaagcaatgaaacaaattgtgaaaacaacctttacgctcaagggaatcgagaatacaacacaagcttttaatttaaaatttaaagaaataaacactcacacccatcacatcttattagtatgttgctcatcttcaacaactaaaagtctatctttgattgcaaattatttagaggtaataaacaatatctacgaagtcaatctcaaggaccataggccacacttgttccacttataatgaacattctgagtaactagaacgaaagcattatcctcaaaaactgctctgaacatcgatagatcttgaattttctaagaaactcaaacattccaaagtaaatgaattaaatccactcaataaaaaacaatttgttgggtgcatgtaattggaaagaaataatcaaatatggaaggtcaagcaacaaaacaaacacataaaaaaatgaatatttagtctcaaacacggttttcttaagaaatctgagatcaggataatgacaatctgtaataaattcaagaatcacacgtaaagacaatggaaatatttagaacatggaccgagtataaaaccactttttgaagaaaatgcgtagaaggaagcatcctcttcaacttgatttttttaaaaaaaaacaaaaaggaaatatttttttaccataaactcataaaccaaaattcaaagttttggagtttgtttgtcaactcaaatagcgaatccgaaagccattctataaaaaaattcaaataaagattaataatcaaataagtgtggacatcaatccaagaatatcaatactgcacacagttctgagccatgtaatgaaaataaatcacttggtaaagaaattcaaatttaatacaagttctccataacaagatttaaattagtattttcaaatagtattgtgcatatcaataatttataatttatcagtacaaagcaatcgcacaacacttatgtttgaacaaccaagcgaatgaaagccacaaaagtgaaactaaaataaatatttagtgttaattcctttctgaaagtaaaaaaaaatagaaatcaggagaatatttgtcaccaagtgatgaatgcagagtcaaatgttttccttttggaattatttcagaacgtgtaccacgaatgagaaagtttttttttttcattacctcaaccatagtcacataatagaactcacaaaaagaaactaataagccatatcgcctttgaatctcaagtctgaaaaatggaacatcctttttttttcttactttttttctttgcttttcgggtgaagacatcactaccttggtgcatcatgcataacatgtagacacatctcaccactgtaagaaaagaatagaatgagtagatgacatgggggccaatccatcccatacccaaactattaactcggtacagtgatagatgtatcacgacctaacactcacactcggacaacctcacttggcattgggaaaaaaaataaagaaaaagtcccctcctctaaccactttgcattgcctatacggaagaaaagttacctattcttaaaggaccattgagtcttataggatacaacattaattacttctataaaagagattaacacaagttagagccatgatcaaactagtttaactaaggtctagggaaactaaaactttatcatgtacactcacacacctcaagtataactgtaacaccccatgttgttctccctaatagctttccgaatatagttatgcgcaaacgttaatctccacactatacaccacaccaacgaatcaaaactgaataatttttttatacctcctagctttacttattatgcaatcaggtcttattcgtagaagagcatatatatatatatatatatatatatatatatatatatatatagtaacaacataactccagaaatcacaaatacaatgagatagagatcagtaatcgataaaataaatcagaagtgtgatgcaaagaatgacccaaacccatcctactgtgcaccagtgtgtcaaattttattggtttaaatttaactcaaattttacttctatttttcccatcctaaggaaaacatgatcaatattttaagttgtcatatttacttcccatggacctactgcccactcacataccaattgtaacacaccagataaccacgtaccaagagtgccacaccaaaaaccactcaaaccactaacttccaaaattattagaaattacggcagagtctcccctgtaaatacggacatccacgacagacaattataagttaaactaataacaatatcattcccacaatacgatccatccttataatccatggggaagaaaatattagaaatctaaaagattattacaagaccaaaccaggatataatttaagtgtcattttgaacctgagcctgtcgaacaaccttgtgtgatgtactctgacggctcatggtcgcacaagggggcgggcgccgcggcagtactcacttcgccaggtggcgtgccaattcgatatgccacaaggctgcagttcgacacgatcaacaacacgacagagtatgacgctgtactgatgggcctaagaaaagcgaaagcattgggggttcggcgcttgcttatccgaacagactccaaactggtggcaagccacgttgacaagtcttttgtcacgcctagaaatttagcccaaatttctagactattttgtgtattaaattcctgtccaggaccagccagggtacacaaaacgacaagtaaaatatagttccaaacataaataaaagcgtaaaatacttacagaagaagtggggtcgctgggcccacctgtcggggagggagagagggaggagaacccagggggttatttagactttgcgcgaggggaaggggaaacgggccgaggcgagagaggaagagagggggcgtgggccgtgggaggaggaagggacctggggccgaaaatggcccaaggaggaaggggaggttttatttgcttttctttttatttaattttattaaatgatctttgtgactttaaaattatttcttgagctccgaaaattcgcgggaaatttcagagagttcattagggcacagagaatattacaaaatatttccggccaaatgatttttaaggaaaatttcaaattctcccattatttcactttattaaattgctttaacttttattaaaaatctagaaaatgcattatttaatgggttttaatcccgaacgaaaatcggggcgttacatcttttgaggcaaaggaagaaggcatgaagaggtatctggaggctgttcgatctatggaaaagtgtttcgccgcataacggtcgaacacttacctagaggccagaacgaggagccagacaccctggcgaaatccgctgcttgcggaggaccacattcgccaggcatattttttgaagtcttgtacgaccaagtgtgcccacagagagcctggacatcatggcaattgaccaggcagaactgggcgaagacccagaagactggcgaacaccgttcgtgaagtacctcaagaatggttggctcctagaggatgaagtagaagcgaagcgcctacagctcagagccacaagatacaaactcagggcagttgtatcgctctggggtgctccaacgcttgcttcgctgcatatcctttgctaaaggcgaggaaatagcgaaagaaatacactaggggctgtgcagtgcgcatcaagccgcaagaacggttgcctccaaagttttttgccagagtgtatattggcccactgtgctaaaagtttgtgtgtgtcacgaccgaaaataacccaacgggtgttccttacgtgagtgcattattccttgtcccaggaggcaaggtacaccaaaagttgatacagttcagagttcaacaagcggaagcgtaaatagttaatttattacatgggcggcgaaggcccagcacacacaaagacaaacgggaaacagcagaagactagggcgacgaccacaggcgcttgacggtaggcacgagctagacaccaaagccttcatcttccagggactcctcttctgggtttgggaaaaattgagcaagactgagtacaaccaccgtactcaacaatacacacccataagtgcagaataaatgaaagggagtacaagggggttataatataaagggttagggtttgcagtaaacagcattaaaagacacttagttgctcgaagctattttgtaaacacgattctagagctatacaatattattaatcaaggccgtggacccacacgaacctgccttaacccaaggcctacgatgattcagaccgaactggcaacccgaccctgggtcccagctcgtcccaagccaacccaggccaattattccacattttagttgttaagcaggttttaagaattaaaacactaacttgggtacattgctcggcttgcccataaccgagggcgcggcaattcgaatagattgtactctgatcagaggtgtacatctttacccacaagacacatcttcctcacgtgtaaccacgtgccgcagaccaccacggtatacggacggaagacgtgacatagtttccaacccatcctagccatagacaagaataccgacccaaccccacctacggctggaacccctgggacaggtaggcaggactgagccccgagcagcaggacaccggccctgtgccatgacatctcgactaccgggccacagctcatgtagccttcatttgtcctagagatgtccatcgatccccgacttcgtccatctccatctgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcgtaaaaccattttggggattttgaatagagggggaggtgtgaatccaattccacaataatccaacaattccatagtgtccaggtgataagagtattcccaaggtctagagttgtaaaaccacctaatgttgcctaattaaccagtgaagcatctacctaaaatcatactagtggtaccatgagtagagtgtccactagttggggttttgtttaatctagggtgaacaaggtaataataacaataacaataataataaggtcataataaaggtaaataggcatggctaaataaaacagtgataacgcgggaatttaaataaagcggtaatgcaataatttaaatcaaaataattttataaactgggattcaatatgttcaaggacgatgtgacttgccttgctcgctttcccaaacgtcggcttcaacctccacgaagagcggatctttcgaagctgcagcgtctacacgaccaacagaaaagaaaaggactttactctaataaactccatataacaagcagaaacaaagcacaaaaatgggttcttgacttcttaaggaaaaattagagacttgaacggtccaattccgagttcaaatggccaagttatagtcatttgaagtttatatgctctttaaatgaatatttgcgaatttcttcatttaaattttaatttaaaaagggtttattgcgtcagccgaggggagggggcacgcggaccgggtccacgggagtggggcccacgcggctgacggccgggccccacgcggcagccactcggcgcgcccgagggcggccaagcctgtgcagccggcgggaggcggcgcgcccgcgccccgatggtcgccgccggtgaccaccggcgcggcggagcggcggccgagagaggggaagggaagggggaaaagaagcggcagtccacggctcaccctaggttgacggcgacaacgaaaaaggcggccggtgcggaggaaggcggcagcgctgctcgggtcgacggggtcgacggcgttccggcggtcggtgagcgaaacggaggggtggacgaggtcggt

SEQ ID NO: 43849 - DNA, 15681 bp, Oryza sativa
caaatccgcgcgtttgaacgtgagagagagaggggaaaatggggggaaagggagagggaatcacggggaataattcccccctattgattgcacgcggggaggacgggggcggcgggattcgcggcggcggcgctagggcgcgggcgaggcggcgggagcggcgggaggaaggggatgacgggtgggccccacccgtcagcgagggtggcgggcgggcccgcccgtcagtggcgcgcgcgcggggagaggccggatgggccgcggggagaggagagggagggggaaggggatgggccgagccggcccaagagggagagggagggaaaggggacttttcagagtttttctttttataaaatcattttaactttgtttatttcttaataattattatttgtgctctgaaaattccactaaaatttatttacgcattttaggcttttaggaaatatacaaaaatcctctaagccttatttgacttttaactttgcacattttaattgttggaggctttcacacggattttaattattctaggcaccatttagaggatatattttagggtcgttttgggacgtgacagtgtggagcaagccaagaaatgcaaaagctgccagcggcatggccgaagccagacagcaccccagtacgagctgtagcctatcgcagtagtctggccttacgccagatgggggttggacatcattggccctttcccggtggcacgaaatgggtacaagtttgcaattgtagcaattgaatacttctctcgttggatcgaagccgaatcgcttggtgcgatcacttcggcagctgtataaaaatttgtgtggaagaacatcgtttgccatttcggagtgccgaaagaattcatcactgacaatggcaagcagtttgattctgacaagtttagagagatgtgcgaaggcccagacctgcaaatcaagttcgcttctgtcgcacacccacaatcgaacggggcagtcgaatgagcaaatggcaagatccttgaggcgctcaagaagaggcttgaaggggcggtgaagggcaaatggccggacgaaatgttatctgttctttgggcccttcggacgacccccacaaggccaaccaagtttagcctgttcatgctcctttatggtgacgaagcaatgaccccaacagagttagaggctaactcaccaagggtaatgttttctgaaggagaagatgggcgcgaggtgttgctcgaactcctcgaaagggtgagagtcgaagcactagaacacatgcgcaaatatgccaagagcactttggcaccttacaacaaaaaggttcaaccgatagagctgctgcctggctaaggaagaaggcgaacccaatggcggttggaaagcttgaatcgaagtgggaagggccatacctcatcaagaacaggtccaggacgggctcttttcgcttggcgacgctggaaggcgaagagttcgaccactcctggaacgctgcttctcttaagcgtttctatgtctagaaggggtggcaccccattcgccaacttgtaaaaatgtacatactattatgtaggcccttcggcacaaaaatacaaaaaaagaggaaaataaaaaaaggaaaaaaactggatgtagggctattatccatcctggaggcccgaaccagtatataatccatgtgtctttcacctttttacttgtgtaaatgataattcgtggaaaaaccctaaggcaaacacctgataagcgaaagcgccaggggggcgaaatgaatcgaccgaagcatcgctcgctgaacattgaaaccgcaacatcttgtttcgggaaataaataaccgaacacagtcatattcgatctatgtgaaaaacacgagcatttctttagcgcggaatactacagatcgaaaacggaagtaggaagctgaaaagtcagcagacatatttcgctaatatacgcaagggggccgacatatttcgacctaacaaaatcatgaaaggtgactatgcgtacaatagcgaaaaggaaataaaacacatcttcattaacttcgaaaaaaaatataggccatacaacatggtacaggcgaaagaaggtaacgggctttacagcctaacttacaaaaaaattacatctccacccccaaaacaccctccacgccctaaggtatgatctggcgaacttggttcgtcatcactactaatattatacactaccctaagaggagaagggggcgagacataaactagaccgtaacggcgttgggcgatcgcttcctgacgatcagtcctccgatgatttcaccaaaagcgagccatgtcctcccgatgctccacatggacacggtcgtagtcgtccatggttcgcccggggtgtgcccgcatccagctggaaactttcaaaaccttgtaactattgccatttattatcatctcgcaacatgaatacttaaatttcagcaagccttcaactgtgatgaatttctcattctttttacgccaatctctgaaaggaagccgaacacacaatttctagtgaagaccctgctaaaacaacataaaaaggggcaaatgggaaagcacaaggttaagagagggcgaagctcataaagcgggcaaaaagtgtagcccctattcgtgtacaaaatgatgcaaccatacatatcaaagccctaaaaacgggataattggcgaaacttggttcatctattccatataaaaaaggccattttcggctacagtacaaaagggggaaacatcggccaaatttacatcgttcgccttccgtggccaacgcaaaaaatctaaaaatctaaagagcgggcggagggcctcacacctctgggtgattatggccgatgtctaccccagcgcccgcatctgccccacctccttcgcccgctgcctcctcgccttgatccgccgcctctgcctttgccaagtgctcgagcaggcgcgccttggcagtagatcagccgtccatttgccagaattgtttgcgccaagcacgaagtgcggccgaaagatcctgacaactgacttcccaatcccccttcaccaacttggggaactcggcgatatgctcgcacccattttgttgtagcaggcccatggtaaaggccgctaacacacgcgcgtagcaatcgccgtatgcagtggtgcaatcagagaccacaccactggcctattgagtccactccgagaagtcaaaggcagaagcatcttcgtcggggactcctcgcaccttcgcccacatgtcggtaagggcaaggcaaagcgtgcggcacacggtctttgcggacttagtggtcttcaccatctcccgcgcgaaccgttgtgcgtctctcttagcggctgcttctaccttgctgacctcctgacgaagagcctccatcttcggctcggtaaggttatagtaatcagtcaaggcggtggactaatctcgttcttttttaagctcagccttgaggcgctcgatctcggccttcgctcgctccccttctccagctcaacttggagctgcttattctcagtcttcgtctccttaagggtgttggctaggttttccatttctagccccttgcggcccagttcttcatccttagcccgaagacgacttttaaagctgtcaaggcgagccctcacggttcgctcggtcgaacaatgagctgcgggtatctaaaaaaaagggggggctaaaatgaagaaaattagcataagttgtggaaaagcaacatttaaagcgggcgaacgacatacccagacggctaagcttttgacagcggtacagccctcgttgaactcgttcaactcagtgaacaggctcggacttccagccggagaaacgagatgacttaccccctcgatgaagggggtaagatccacccgggtctcgaaatcccaagggacgaagcagggcgccgtgagcgaatactctgaagccgacgtctcaacggccgccttcttcccgttttggatggccagcggtgaagtaggtggactgtgcggagggctcccgaagagcctggcagcagccttcacaacccggtcagcagaacctgaagtaccagctgcagcgctccctcccgcttcgcccgtgtcggtcgcagcatcgggagcggtcgaaagatcttggctccacccagcggccgaagtagaggtctcatccgaagactcgtcatcactgaaaacacaggcgacatcgacgaaccccttttttttggaggttttcttaactggccctcccttcaccaccttgcccgccgcaatcgaaaccaatgcctttgccctatgcaaatccttccggcgaaggggggagctgttcgactccaccccagttacgacgtggtctgggcttggggttggggtgtagccgtgcgtctcggtgcggttgtcggcgggctcattcgcggccggttcgaccgcaactttcgcctcctcctcatcctccccctcctcttcatcgtactggtcatcgacagtgtcctcatcgtcggcatcagagtcagtggaggcaggggcctttcgcttctgaggggccgattttgcttgctcgcgtttgcgcttcttcgaggtcccttcatcaccatcggccttggagggcttctcccgagaggggagatcgccatcatgcacacgattcgctcggccagccgccttccgtgtaagcagctggctgtattctgtgatcgacacatcgccgaccatcttccgagcttcggtttcagcctgaacaagagttagcactgcaaaaatgaaacgtctcatcatactggccgcaaagcagggaaaaaagagcgaaatgcaactgcatgtgggaaagcaaaagcctacctttcgccccctttggcatgacgagcttcggtaggccatcgacctcctcgtcctggttcacctcgacttgccatgactaggagagaggaaagatccgaagcatgcaaaactcttccaccaggtcacggcagctaaggtggaggcagaccttgcgaagcagggcgaaatgggcttccatagctccatcagtggcaaccctgggtttcctgtttggcacgatcgccctgcaccgccatcggagagctttcgccgcgtcggacctggcctcgaaggggatggagtggtataatcacttcgacatccagtggcaatcccacttggacatagaagcgctgtaatgccctgatattcgtttgggattaaaaatcgtttaataatgcattttctagaaattaaataaaagttcaagcaaatttaatcaagtgaattattgggagaattaaaattttccctcaaaaatcattggccgagaatattttacaatattctttgcgccctaaaataccctccggattttttcgtgaatttttggagctcaagaaataattttaaagtcatgaagttcattaaaataatttaaataaaaagaaaacaaattaaaaacctcctctctccctttgggccgctcccggcccaatccccctttccctcccgcggcccgtgcccctctctcccttcctcggccggcctcccctctcctctcttgggccgttggcccgtttccccttctcctcgcgcaaagtctaaataaccccctgaatcccctccccctttcgccgacaggtgggcccgaagaccccacttgtcaggtccatccccttcctctcgccggccacaaccgccgccatggccatccgttgccgcccacgtcgccctcgatttcggcctctcccgctcgcaccctcgcgccataaccgagtgaaatcggtccccctccacgtcctccaccatctccacgactttcccccaaaaaaagggcgcctgtttgacctccccacgaactccacgtcaccgcccactccatcgcttcccgccggcgagcgctgcttcgcccggccacgtctctgctccatttcccccttccaccacgaaaaccccctcctcaccgtgccaccctagcgccgtcgtcgccctctaactccggcggtcgtgcgtcgacgttccgggcctccttaggcctcgggcccctcctcctcagctccgcaatctcaagggaaggcctggcatcccctcatcaaagctcttcgtcgccagcatccattccccgctgtgagaggtgagcttctcccctcgttgccggcttccggctgagttttcacgtcgcctcgcgcctcctcccttttccctaacccttccaccgcgctccccaggtcgccatcctccacctcgcgtccgcggtacgccgtcggaccgccaccgccgcccgttgccctcgccaccttggcgcatggtgagtgctccctcctcctacccttttccccctccgctgcctcccgtgtccggtgccgcgtcgcgccaccatcgtcagcggccgtctggctggcgagccagccagcctcccccctcccttgccgattgggggtgccgcccgtggaccgcccgtggtcctggtccacggcgcacccgaggccgcggtggacgcggtccaccgtgtgcctgccccttgacccgctgacgtgtggggcccgcctgtcggcgccggcctcttagatgacgtcagcgcttaatcttttcctttgagaaaataattaattattgcgcaataattcgataataattctagaaattcatttaaatggctcaaaacttctaaaattcatatctaattcatccgaactccgaattcggccattcaacttgcaattttcatctaaaattgagatctacatgtttgtttactttttatgtactgtttccatagtttttattagagtttttcctcgttttgcgtgccagcgtgtagaatccgtcgtttcggaagtccacagtcacaaggaaaagagtttggaagattgtttgaagaagcaaggcaagtaacacattccccttgagcatgttgatcccaatttataaatgttttgccgtttgcaaataaatatgcatgttttgctaattacatgggatcagggtttacctatctgcctgcttgtgccatgtttacttgatatctgttctttgtcaaccgtgggtgataattcgactagcttgtgttacttatgttaacctagctataactatattcttagccatgcttaattgtcactagctcagttgatgggataattatagttttagacctgttagtatcaagacgagctgcttgctcgagacatctggccatgtttcatggtcataattatccaactaaaatgcgactgaatggtgggctgtgggtgcatggttttgctagtcgcacccatggcaattaaggaccggttcacgggaaaccctggaagacttatagtgcttaccacaagcgagagtgggtaactgcttgatctaaagtataactcgaccctttcctaggcaccagtggcgagggtgggcatgatggagttgggtcggctggggtatccggttgtccagctgccggattcaccgcggcgcacgaggggactgcctacctccgggatagggggtgggggtgaaaccttagcgtggtgtggatggttaggggagggttatgcggagggtcttatcacaatcactcgacatggtgacgtatctgcgcggacgcggtgacatgccggtagattgtgtcttgtgggtacagttgtgcacctctggccagagtaaaactattcgaatagccgtgcccgcggttatgggcgattgaccagattcaccgtgattagtcttacacttaataaatcaacccaatgcactgtagttcatgtgggttggttgggcctgttcaacgtggtgtagtgttgatcagtggagatttaatattaccttaattattcaacagttttactgttttgctcaacaaaatgttttacaactgcctttatgcaaatagccacaaatcatccttgcgttccccttgcacgtctgcatcattggtgtggcttgctgagtacggtggttgtactcagccttgctattattcccccttttaagaagtgtatagcttctgagccgaagacgaagttagaagaccaaggctcagacaccagttgagttttgcctgtggagtggagctgaagccccgctagtatcgctttttccgctgctactgctttcttttcggtgtgaggactaagtgcctcttctataagtattttacgctttatttacatttggaactgtaaattacttgtcgttttgtgtaccctggctggtcctgtacagggatttaatacacaaaatagtctggaaatttgtgctaaatatctaggcgtgacaagcgttaaccggccagagatcggagcgctcgggacgaacattgaagtttgttaacagtgaaatttgttaatcgacaaagacgtcattggcttagaatcattatcggctgcagcatctgctcgggacgaacattgaagttctgttaatagtgaaatttggtaatcggcaaagacatcatcggctgcagcatctcggaatcagtcgatgagagttatcaagtcgccaatagtcgcattcctgctatattcggttaaggaaatcaatctactaaaggaagcttatctctaagtgaccgagtttaaagaggatgcggcatggcagtttatctattaattaggaatagtttgttagtttccttttatctttaggaaggtgtgtttagtgtccgataaggactttatgttttccttttacctttaggttagtttctttcttgtccgacaaggacttgtatcaacccatgggtataaatatgtacacccgggctctatgtaatctatcgtcacgatcaatacaattcggcgcatcgccaccttttatcttttctactttattttatcgtccggcgggacttgacacctgatgcggggctgcatcggtgttcgatctccggcgaaggggtaagtccaatgttccgtcgccccaggcaattgtatcgtttacgtcggcgtcgttcaaggctgcatcagtacattcgacctcttggattgctctagtttggatgatatatttgcctacctatttattatgtctctgttaatctagtcttagcatatcaatttagctctatcggctgtctctcgctttagggtttctgccggtatcggctaaatcgcgttgctagattagattagcctaggcatctaccaccctgaaaatcagtcaacggcttgattgtctagatattgtgtttcttttcatacctagtgctgcatcagttaagtttgatctactaagtcgtgcttagaaccataatctctagcctgcttcttgattgccaataagggtttcatcggggtttcagctggtgagttatttgaacgttgcatcggctcataaggattgcatatacatataagttggatttagccgatgacaataaaggtttcactgtttaatctaatcttgtggatttcatgacatcggaccaccagccgatgtgtgctttaactttcggatcaatacttgttctactatatcatattgttagccgattggtttctactggattatattgctatattacatcatcatcagccgattgcctttatatcattatctaaattggacatatagccgattgcttaaaccctatcgctatctgctggtatcagcatcgtctattatcggctatcggctagaactactctatcggcttgtcagccgatcggctgttttgatctactatttgcatatcttgtcagttgcaggatcaaactgactggcacgcccgcatctcatcatatttggacctgcactggagctaagcagatctcccaggccgatgtgttcgattttctcatcaacaagatcacgctcccgaaccctgttttcttcgtccctgctggggtgaccacagtctttgagtttacagtggcgtagaaaatggtgccgaaaagctcgacgctcgattcaaacccagtagttcggcacgcccagtcaatcatgctaccagcaacgattcaagccaaatacgtcaagtgtacttaggtgaagcctccatgacgaaggctacggaacgaagacgacgaaggccagaaagccgcgtgggtacctcgtaggaccagccatgtgaggcgaagggtgtagacttcaccttgacaagctcgataccgaggaggtccaataggtcatccggtgcacggcgaagggtatgggccgaaggaaggagtcttcgcctcgacgagctcggcatcaagcaagcccaatgggccatcctggcctcttaggcctattcaccaataagctaacattcgccagtcggctcatggaaggcccatgtatccaaattacactgtgtacccacataaatgtccctttcataagggcaaccgtgtaaattcccctgtaaaacctaaaccctaatgcgggaacctgtaataggattataaatagccccctagggccatgtaaagggggatcccaagaaaaattttaatcaattagtatatttactatttccaatactgttgagtaaccacgtccttcgacgtacgcggttgtcacttcgacaacattatttgtgtgccgagaagaaaatcaagccacaagaattaaattggtgggtagattaaaagaaaggatttgaatatttggatcaagaatcaaaggataggttaacaaataattccaataacatcggaattgcaagggtttggtttgaaggattttccttggaccacaatttataaaataaaaagggtttacaaactaaatttgaataaaatgaattttgccaaaagaaggttttaaattaaaaccaaatcaggaaatatcccaagataaattttaaaggagaaccacaaaagaaatacaagagattttatgcaagtcagtttttaggaggtctctctaattatattttcatatgtttagaaggttaataagaacgtaagaaccggcatgatgcataattagaaaatagctaatttttagtacgttacacccagccaacttggccgactcagtctccatccaaccgagccgctgcatgctgcgtgttgcacagaacgcactcatttctcaatttctcactccaatctccttcgtgaacaccggcacttacacgcacacctcgtgaagcccgttgtgaagatctctctcatacaatgtctatccaccgtgtgccatctgtatccaacttcgtcacccggtatccttgaccatctggacctcaactcttccctgagtctagtctcgatccccaccgttgaccgaagttgacctccaagaatcctgactctagtcaccttgtcacatggtatcccgaccgcactagacctcttctcctccctgagcatattcccggtcctcaccattgactaatgctgatctcaagtcacctgcacacaatcagacaaaacaactgttcctgggcacatatatcacaacctgacccacattaatcacacacactcacatcaacatccacacatcttttcattgattaaattattttacaaagccaattgttcatcacaaatattaattatgacaatgatttcacatttgggagatcaaccaatgaatagtataacaagatgatgaatagtgaaagaggaaaagggtgagcaagggtgatggatagagaatggataaataaggaatatttagaccaatggattttttttggggattttatacccttctggcttctggttgaaatacctagagtattcatagaaaaaacaaaatagagtcctaagaatccaataaatattccacactttgagtgatcgagagaatcaattgaggagcaaagcaaagttataattttgtgttacttaaaaaaaaccccaagttgttcttcatgaaaagttagggtgacttgagtcaagattgttccatttctcaattgctcaggatcgcatggtagacactacaaagacccacaagtacatgtatggctttgaataatttgtttgcataattattagtaaggaagtcataaccctattgtagagtccatagccttcactcgggacgagcaaaggttaagtgtgggggtgttgttgatggtccttaaatcataatatttgatcgtcaatacttacataaaataaaattaaattatggtatccaacttagtggtagggattattactaatcatttccactagtattggtgaaatatgtgtatgcaagtattttgagaagaaaaaacatccgtcaaatgacaaactgcacctccgcgcattcaggacacatttacacatattggaggccctataagtcaattaaacaactctaaatgggcccaaccatcatgccaatgggctgagggcctcaaaattagtgtccacgaggaaaaatgggctgaacagagccgtcccgggttcggccgaacccttttggtggccgttgatctccaaattttacatggacggccttgatcacattctaatggcggttccggggtagtttgctcatttcgcatacgctgtaaccgtcatacctgcctataaaagaaggagctcactttcatttccaacacacaactttgagctgaattataagaggctctattgtatcttttgtacattagaatagggtagagagtgaggggaaactctggagaagtgcccgaaagtttggtgctcatccgacttctacctcgacgagtgtagcttcctaggaggaattctagaagagtaccggagctatcggtacactctgttccgggtctggagaacttcttctataaagtaagcatttgtgttcctttcttatgttatttaattactttgcttaagtaagatagatttccatctttgtgggttcattgtttagtatttatactaagtgctctagtactaggactctggataaagaagcaagttcatgcgtaattattagagtagtaattaataacttaggcgtggtgtctaggttagagattacctttgtttgttgtgtatcccacggattcgtcagaggtagacggcaggtggtgacaatcctagtaatcctctgttgacggtcattatcgatcagtttcgactgtcaatattactaaaataggagagaactagtgatgcttgcaatgcataagtatgttagaataataatattccactagtattaggagaatcgacatcacctcagactataaatcaatcggacgatgtcgagaaccagacttgtgtgtgaataggccatgaactcagaactgacatgatgaattgggccaaaattcacaagtctgtggagtggagcaatagaggaggccaccagccgaaattgggctagattcggccgaaccaatcctggcgccgttggatccaggttttggaatagacgtccaagattgcatcccaatgacggttggagggcacttcggacaattccccttccacaaccgtcataactacctttatataaggagctcactctcttcacttcaacacacacctcaagcaagagctctctcattcctctcaagtttagtttagtagtatctagctggtggaatagaattagaataggaatcacgagtcctgaagtctcagaagagtttgggtatggctctagcagctttcctttcctcttttgtaagctttgtacttttattagaatactcttctatatagatttatggtattgaaatactttctgagtatatgagtacctactttacattatgttcatgttatactgaatatacggctagcttatctaggagatgctttggtgcgggtatagtgtttgttatgcaattactctatgtcatgacgatgatattagagtagtatctgatagtttagacttggtgtctagattacgggatatcatatttggggttatatattgcggatgagaggtgggccgctgatggtgacagctcagtatggtattcctccgcgcctatatataatcctaagttaatttcctgaggagcgtattcctccgtatttagccccggttgtatggtcatgacgggctatcgtaaggaactcggcagtcaggggtggcttctcgaagtaccaggagggcatcggatagagggtattagctagtataccagttaactagaatgtatgtatactatgtatattagaagtataggaatagatttccttcctcttttctttccacttagcctatatgatatattatgaggacgagtagttaatgcttgtgtgtcactctacccttagattatcttaacccctacttagaatatgattctcacaagtaatatataaattattagttgagttctctctacatgatcttctcacggaataaaataaatacgataccttgaaatactctcggtgaaatgctacaatggtatatccgtgcatttgcggatgaactctgtaaccataatataccagaagtatttctgcactattgctgggaattatatttctagtaatgtcgttaagaaataccaacaaaagacttatacttactgcacaaggtgatttagcaattaatggatgctatacttaccaagtattaaggaggtacttcctgactaatgagagagagatggtaggtgagaagaagctgaccacattgtgtgtatttatccctccatttaaatattctttcttttctcttttcttggtatccatggaatgtaatggaatgtagcatgcatgaccatttcagaaaacactatcattttgcaacgtcatttttttacatatctttgcaaaatgatattttcattgtgttacatttttggcatcaacaaacaatagtgaacatttttttctctgtagattataataaaattattttttggaatgtagcataaatatgtaaaataacaatcatgtgtttttatttaatatatgcctagtgatatatcattttttacaatgtcattttttggacaccaatattgcaaactgatacttctgaattgtcaacaaactgtagtccacattattttctctgtagattataacaagattatattttggaatgtagcatatatatgtaaaaataacagtcatgtgttttttatttcaatatatgccaagtcatatatcatttttacaatgtcatttttggacatcagttttgcgaaatgcatttttgaaattccattatttttgcaaatattgtattcgcatggtgagtggagaatcatcttgatatattatgtcccaataaaaccaaacttagattaaatttcaaaaaatacaaaacaagttgtttagattaactttaaaaaaatcaacatacctaatatctaatcgcgtggagtaatctgaatgttgccaatgaatctaactaagaaaagagtcagttcaccgctctccataggttacctagatacggggaaacggatacgtgatacgtggatatattatttttgaacaaataaggacacgtggatacgtctatatatataaaaaataaaaaaatacatattataaataagggcaaagttagtgtaaaagaatagaaaatcagcacaagttagagtatcgactgtggtggtaggttagtttgatgaagaaaatcaacagaacttaatggtcaaatagagctggaatttactttctgtcagaaaaaaaaaaactcacaggccaaagctgtctcctcgaacatctcacgaatatgcagtggcatgaattggagtgttcaatgcagcagtactactcatatcaacagtacctactatatgatgtgcctatatagcaacttcaccgggaggttcatctttgatggtcattactgacactatggaacacggttgcgaggtgcatatgaa

SEQ ID NO: 43850 - DNA, 8577 bp, Oryza sativa
  unsure (1)..(8577): unsure at all n locations
cctagaatcaaaatctaacaaaaacaagttcaaattcagttcaacttgctttaaactagttagtaaagtagttaatacctaagtaattgaaaaagtttcatactcatttgaattgggtatatactcaatttcaacaatggtgcccgggcaccatggagcaccaaacaaatttaatatatatatatatatatatatatatatatatatatatatatatatatatatatatatatatatatatatatatatatatatatatatatatatatatatatgtattaaagtagttaacgttaatacctaaatatttgaaaaagtttcatactcatttgaattgggtatatagtaaatttcaatcatggtgcccgggcaccatggagcaccaaacaaatttaatatatatatatatatatatatatattatatatatatatatatgccattatgtactcccgggagtacatactccctccccagtattggatcacccgatggatccaataggacctgttgaactggattggaaaaactgccgtgtaaaaataaataaatatttaatttgaaaaaaaaaaccatgaatgtaggcgcattggatcggctagaatttagcggggttcaaattttgaaattaccggccacactccaatcaacgtgcagtatatttcctagctaagtatatgctgttattttctacacgaaagtatatactgttttttttgtaagaaacggtatgtactgattttctacacgaaagtttatattctttttcttgcagtatattcctatataagtatatgctgccatttcaaaataaaagtatgtactgtttttagtaagcaaaggtatatactgttttttattagtagtagcagtttataggcagctgccatatacttctttttcatgtatagaaatatatacggataaatatcccacatacgtgttttttatgacaatatatacttctttttctttacttagtactgtgcttcaccaacctagtataagtactgtgctacagttaagtccagtatatacagtactgtgcttcagttaagtccagtatatactatttcttaggtggtagcaatatatatactcttctttttaaggtggtagatatacctttctttaaggtgcaagtatatactattcttaagataattgcagtatataccatttttaacagtagcagtactcagtgttagtagcagtatatatgctatttttattacttgcttttaccctgccgcagaactcagtgttcgagctgcatgcacgtaatgatgatccaaaagtttcgtatattctcaaagatatatagttccaatagaactagcctcacagacatgagaacatgttcaagaacatgaattgaagtatatgctgaatttctgattgaaaaagaatgtacatccaaatcgcagtttgtaaaaactaggatccttccccttgcgcgtatatatatatatatatatatatatactatctccgctggtgccgttggattgcggcgttgagtcgacatgttctgccgacggccggccggataccatctgcaagcaacaaaaagattaggggcttattcattcagggaactaaacaaatccatccaaaccaccatccagtatgtgcagtatgtgcagtacagcagtagccaagaaatgaaggagatgcacacattcactcatttagtaacaacttgcctacattttgcataagctagattgagatattagactccactgataagaatacacatctaaaacaaaaggcatacttattcaagcagtatatataggacatattttcagcaaagcgcccgtaccccattgacccagaattattagacaaactaacctgggcgtcatatactgatttcttcttacataggtcacatactgaattagaaatacactcgagatgttagcatgcaccgccatcttcagggatctgattggagttgatggttgtgggcatgttaattatcgcagtatcgtcagcctactgaatgtttgtacctgtgtaacgaaacaaaattagtatttttcattctgaactctaggattaatttttatctacatacgtacagagattaaaaggaagatggataagaaatagtgtatactcatctaactgtggatttgtgattcagaatttcatatataaactaaaaacagtacacaccaacaaaaattagaaagaacccctccattaaaaaaaatgagtatatactatcgtctaacaaagttcagtagaaagctccccatataaaaattcagtatatactatcgtctaacaaagagttcagtaagaaccctgccatagaaaaattcagtacataataacgtttaacagagttcagtaagtatccctccaaagaaacaatgagtatataccgtggaaaattcagtacatactaccatctatatttttttttggggggggggggggggctaaaacagcatttactatatccacccaaaaaaccatcatatgcactaaaggggaaatttagcatctgaaactgagagcgtacatgaaccgaactacacataatccctctctacaggcatacatatattcaatttcagccgactccagatcgattacttctgcttcagaaacataggctattgagagaggagccatcgctggaggaaggggacgagtcttcactggaggaaggaacgagctgctatctctgtaccgccgccagccaccccagtcgccgctgaatcactggtccgtcgccgcgccgccccccaaaaccccaattttcgggataagcagttcggcctcttacgagcaaaccccaaatttcgggataagcagttcggttttttaattagaaaaactaatcggatccaccgaggcaaacccgttatgatgagggagggagtataacatatctaatcgatcagatgaacggtggatgggagggggagtacgtactccctaggagtatagatccattttcatatatatatatatatatatatatatatatatatatatatatatatatatatatatatatatatataactactatacagcaccctaaggtgctacgtattaaacagcacctgatacagcctccagccccacccacccacgctcccaccaggtctatagtacgtagttaaaatttaactcaccgacgaccaatcttgatcccacccctgcgccccctcccctcactcctatagtccgagtaaattttttacttcatgctatccaacttcttagtagttctatatatatagttaaaatttaactcatcgacgatcaatctcaatcctacccctgcacccctacccccactccaataatccgagtaaatttttaactcgcgcaccaccaagagccacacccaccccaccctgtcaacgctcctacccaaacgatagtaatttttttactcacaccaatagttctatttataccatccataaccatctcaccgtatccaaacccccattcatactcccgtcctcttccatttttttcggatctgagaaattggggatagagcggcgacggtcgatgggtgactggtctgctcgtcggggcgatggcatggaggctgagctccgagtggtggcgaggagatccatcggtgaggggtggtgtcgtcatgcatccaggtaggagagggcgattggcgtcgggctgccctcctcttgaaggtgcccaatctgaaggccggcgccggtggtcattcttctttggagcccgtgagggtggcggcggccggctacgtcgtccatggcgtgcctcatggtcggttcagggagcacgcgagtaggtggccagcggcagtggtggccctgaaacaacgttcaagccggaaaggaggggaaggttgctttccaccttgtgcggcggcaacggtcttcaggcccggcgactagcttccaggccagcgtcgatgcgtatagggcaggagaccgatgtagacgttggttgctgcgccggatctggagggagcctagcgcatgcaccaccaccacgtacagcgtgcttctcgggtcatccgcatctctgttgtttctatcctcccgtggacgggggtttcgtttcatttttttctctttgttggttctgtagtttgttatgcacgggggattttttgtacgattgatatgcatatgattgattgtaatactccataatctaatattgactgtatgtgtcaaaatatgcgccataaaaggatagcgatactagtattttgatggcttaaaaattttcactcactttttttacggacagattgagtaagtatattactatgaacacactgagagtgatgtttaaaatatatggaagtaaaaacattactaaccctgataagtattatagggaaaaatatgtagtgcaaaccctatatataatgcaaacgtagaaaataccgttggatcgaaaaatagacgcccgatattcgtccatgtcaatatgagttaaaattttactcgcaaactgtgcagcaaaagaatccttgtgagttaataaattgctctggatattacgtttacagaagaaatattgattagttaaaaatttactatcatataccgaacaaaaatacccattagtaaagatttcaccaacggcaagaagattttttcactggaaggatcgcctgtcacgtgtatatttcatttaaacgtaccacggcaatcaacccctatgagtaattttttaacttcaattacgcccgctccaagtcaaatctcataatgagtaatttttttactcagttgtctgttgcgggggggggcagggtggtcgataatcacgtgtttctctcataaaccaaccactgtaactgatttgccccacggtaatttttttactctgtttgcacctgcaggatggggatggggtggcgggtctgtgctggggatgcgggctctcgctgagtggcgccacggtttagctggcgcgcatcgcctgtctcgccatgtataccttgataaaactaccatttatatatatactggttaaacaacgtaattttttcactgaggcagagacgtcgatttctttcctaagaaggcacaataattcttttactctgtgttcaggaggacaactcaattagaactgagaatagatgacagagatgagtaattttttaactctctataggagcggtgcaccacaggggagagaagtggaaagctgcaggtggacccaaaaaaccggaaaatcagggccggccacgattaaaatatcatcaaataacctttaaattaaaattttactcatcacaaaacactctatgttcaaacttactgcaccgatgtctatgggttattttttaactctaacctaagagtgtacgataacttgaaactacactacaagtgaaattttaacaagaaatattccatatgtggatttatttcacgagtaaattttttactcaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaatttaagtccctggatctaaacaccacctcaatctacatgcaggcaggggatggggaacgtggcagggggcggttagaagcgctagaaaattcgctggcaaaaaaaacggaaaacaaggacaggacgggcggaggcgcgccaggaaattggtggcgcgtgtgaccccatcccgccggtcaaacccacgtcaaacacgcacattcactccctccccgccaaccactttgatgttcacgtctcgcaggaattccgcagtaacatgacggtcatcgtgcagtaacaggataactttctcgcagtaacaacatcgaaaattagtcatgatatatctagttttgttaagcacttttttacaaacatcatggtacagacagattagaaaaatactatataatgtgagagatattgccctctaaagattgagatctacttttttttaagttctcgtctatctagaacggcgtagtaatgggacaatcaatgtgcggtaacacgactactttccacagtaataacattataaaagaatttttgtctcgatcatcatatagtaacaggactattgtctcgctgtaacgtcgttttaaagtattatggtgaaaacggttctaaaaaacaatatatgatgtgagagatattattgtttaaatattagaatcctaaaagtttacttgtattaagtttgctactatgtatctttgtatatatgtatctttgtccatacatagtatctttgctaaaagatactatgcatggtcacaagttaacacaagtgctaaaagtgtttttctttgtctatacaaatatacatagatacatagtagcaagcttagtacaggtaaacttttataattctaatatttaaacaataatatctctcacatcacatattatttattattttttagaaccgttttgactcactcaaatagaaatatcatttggagtgagagtcatattagtatctgaggggtaaattgagaaaaataataatttagggtgttaagtacatctaagaaatagtttaagtagtaaaaactgcatttaactagggtgttaagtacattgaagattgttgtatgatggctcattccttggcaacaactaacactgttgttccttggcattactcggctggacttgtctgatgtaatgccatgtgatcggaattcaaatgctggaattaaccgtgaaagagatggaaagaaatgctaccctgttagggttgcctgttgtatatcagttggaaggaagtgaacttcatttttcattaaatcctccaagcgatatctaagcaattactacttttaattactagatatctctccaagcaatctctaagcaattactacttttaattaccagacatgacgtctggtaattaaaagtagtaattgcttagagattgcttggaggatttaatgnaaaaatangaggttcacttccttccaactgatatacgacgaaccagaacatctagttggtaattaaaagtagtaattgcttagagatcgctcggaggatttaatgaaaaatgaagttcacttccttccaactgatatacgacaggcaaccctaaaagtgcagcatttctttccatctctttcacgattaattccagcatttgaattccgatcacatggcattacatcagacaagtccagccgagtaatgccaaggaacaacagtgttagttgttgccaagtgtcgaaacatgaattcggcaataataaaagggggtaacgcacgagacctaaaagtggatggatgcggagacaaggatttagacaggttcaggccctctcaatgagaggtaataccctactcctgtttggggatttgaatccgccgggtgtagtatagatctaacgatcatatatgctcatgcccttagagggccttctgcccaccttatataggatggggagcaggattacaagatagaaaccttaaccaatacggtatcggtttcctaaatctattttacaatattatcaaatcaggactttaggccgctccataatataaaaggaaacgtaataccatgccgtgtgggtatggggtacccataatctccacagtagcccctaagaccttcatgtcttgggtcatataaatgagaaacgcatggagaagcttcatagagatggacttctacactcgtttgattttgaatcatttgagacatgcgaatcttgtttacttggcaaaataacaaaggcacctttcacgggtcaaagtgaaagggcaagtgaactattgagactagtacatactgatgtatgtggaccaatgagctcaactgccagaggtggttttgggtactttattatctttaccgatgactttagtagatatggttatgtctacttaatgaggcataagtctgagtcctttgaaaagttcaaggaatttcataatgaggtacaaaatcatttggacaagacaatcaagtatctacgatctgatcgtggtggagagtactggagccttgaatttggtaatcatctaaaggagtgtggaattgttccacaactcactccgccaggaacgcctcagttgaatggggtgtctaaacggaggaatcgtacattgttggacatggtgcgatcaatgatgagccaaactgatctgccgctaagcttttggggttacgctctagagacagctgtgttcacagtaaacagggttccatcaaaatcaatggataagacaccatatgagatatggacagggaagcgtcccagtttgtctttcctaaagatttggggctgtgaggtttatgtaaaacgtttgcaatcggacaaactcacacctaaatctaaatcagata

SEQ ID NO: 43851 - DNA, 41501 bp, Oryza sativa
catatatatatatatatatatatatatatatatatatatatatatatatatatagcaaaagtactcctggtctagaatgtgtcaataatttgagctcgcgtgatccacgtcaagaaaactaaaattttatagaggcgtgggaagtgctggggttatatgatgtcgaggccgttcattttgctgctccctccgttttatattataagtcgtttgaatttttttctagtcaaacttctttaagtttgatcaaatttatagaaaaatatagtattattttcaacataaaataaacatattaccaaactatattcaatattagatttaatgaaacagtttttatattttaaatgttgttaagtttttctataaacttgataaaacttaaaaaaaattggctagaaaaaagtcaaacgagttataatatgaaacagagtgagtatttaccaatcgactaaaagtttctgaaaagttaaatcgacttttaaccctagtggaggcattgagccatcgtgcatggtgtgcagctgagggggaaggaaaatggaagacactactacaaaatggactttttctgacatacattttaagttttcttaaacagccaatgctaccgccaacgatcaatggccagtgaaaatataccattttcgcttatggccctagataccattatgatttgaaaatgatgatagctggatgtgtttgatcatttaaatcgggtcggcatcaacaaaagagaaatatggatgtgccttcatcccatataatttcaaaaattaagtggaatcatcaagattggtatgaaaatacaatccctaagagtaagggtcacttatgtgcttacctaggttttatcttatggaaaaatagtcactcctagattttcctaccaaatgctgcatagttattttgcttttaacaagatgcttgtatttggcaaattattagatcttttgcccctaaggatttcttaggtatgccatcatcatgttcccctttcaaatcctcttcgacttgacatgatgagaattgtcctcaccgttagctctactctatgttgttttccaacaaagagaaatttatgatgattggatctagttgtccagaggttaagggaaaggcaaaaggggtaaggtcaagggagaagaaaaagaagttgtgggcataggtcaagtggggaaactctaatcatcccttaagaggatatcctctcatttttacatatctcttaaaaagtcatcaaaaaatttgaaaaaaaagtaagatagatcagtatgtgatatatcactccataaacatacatgttcaaattcaacttatacaagtagaaacaaaaatatcaaatttgactatgaaatacgtaattcatggtcaaatttgttatttttgtttcaaattttataggtcaaaatttaacttgcatgtttgtgcaaagatatatcatataatgatctatattaacaattattgacaaatttttttgatgatattttaaacgttatgtacaaaacgagtggatgtcccctcgagggaaaaaaaagtccatctccggtcaagtgtgaagaaaagttgggcaaaaggggacatggcgaggcaacgaagactaactaatattataggtcaggagagaagaaaaggaagcgagggtaaaaggttatctcacaaagcggtggtaatgaggctttggcttagcgaattgaccaatgaaagagaagattcgccgcttgaaaagagcagtgacgttcttagggcaagtattataagcctctacacacttgtcctcaggttccatgtaagctcacgtgatgacgtggaagagatatatgaaaggtgtgagagaaggtgccacctctcatgcaaggggcaatctctacacaaactccaagagagatgagaacaagagaccaatgaattgataggaaacaaataaagtaaattaatatgatgtattggggcaaatgtgttagaggtaatttgttttatatatattgtctcttataattaatgagttgatgatgtgaactaaatttcacatccactataaaacttccccttactggttatcgatgaggttgggatgctcagtggtgccaccttccatgcaaaggtggacagttactcgtacttcacgcgctcgatccatcacccttaaaagttaaagcttgtaatattataggctttgttcattggttgtgagctagtttagaagcataactaggttatcttacgaataaaatgtagtggcatcaacgacgcaattagatttcatatggataatttctaggtgtccaaacaatcatcagacaaataatcaatttagcttttttttaaaaaaagatcgtttttctcttattgttgagtactactttctctattctaaaataaataagtgtagatttgtattgtttgtgtttaacgtttgaacgttctgcacctacggctctacttattttgggatgggacggaggcagtatttggttggtgacatggttggagcccgtagcccaagctgtgatcgcatcgatcactgttctagcaaataatggagcgccagctgagactcatatcgtcccattccaggaaaaaaatagtggtagcaggccagttcccatcgttttgttcgaaaagaagagttcacatcagatctgatcttcacttgtccgggaataatccatgagaccatgctgactcgacatctccaaatcaagcaaggcaatcagattccaggtcattactatacttgcttccctttccatctttaacaagaaatatttttttaatgatcagtcgggacgcgtgcaaacatggacagctaactaacccctcgtggtgataactgacaggactctgaaactttgagattgagctcgatgcattatagcaacaagccaaaatgtttttacttaattactccaaatttcgccgtaaaaatcgcagacgcttgtttagtttagcgtgacatggacaaattaattagatcgtgtcagcaatgacatatatatttgacatgcagtgggaaacctacccctacaactggtaaatatttggagcgaagattaatacggatccgacctgacctgtcgatcgtcatgagagatcccgggtagctggcctgttcacgtcacgcgtttcatgcagcgcaacgtggagatcaggcgcatgcagataccgatcggattacttaagtgcaaattagatgcgtgtctagtgtgtgttgattcgagttggtgaatgatactatatggtgcaaatgtatcctagtcgaactcaggcgaaggcagctatggacagtggagagtggactctgtcgggtggcggagagatactgaaggcacgtgggtttcgtgtggggtactggggttatttttgctctcatagatggccactagctatatagtcttgttcttttatttatggacatgattaagatggtgttgtatgttagattgtcataaccagcgatcaggttactactagtacacttaacagtgtatgtttatttttcatcttataaagttttctcttaaattactcatctgatttacgatccgattacatcattgtgttcgtaacaattaaatttttataacaagatcttacattattatattttttatgaaaagttacaaattacttttataatatatctaaataacttttagattttattaaattacttcttggtcatataaaattaaattcaataaaacctaaaaataatttacatatattataaaaaatttacatatattataaaagtaacttgtcacgacatcaaaagtaaatctattatgggggataaaaacataagtctatctagaaattaaatttaatcaacatattataaaactaacctataaagtacactgatcatgcactgaatatctaaaaagtagtttaataaaatataatatatatatatatatatatatatatatatatatatatatatatatatatatatatatatatatgataaaaataactaatatatataataatagtaatttacaacataaatatttttcatcataatatagtcttgtaagattttgttataaagatttaattgcaatgaatataatagtgtaatcgaattatagatcggataagtaatttaaaagagaattctataagaagaaagaaaggcatgcattgttgggtgtactggtagcaactagacatgatagacgtgtattagtagttctcttacgtatgtgtccgtcgctctttaattaagactaaaccgaaagtgttatcggtttagattttacctttgcttatcatagttgttgcctggtaatttaactatttaacatttttacgtttgatgattagttaaatatcttttttaggtttgcacttaagaatttaccattggagagagaagattttgtaatattttaccactttctgcactgtgtagcaccacacatgcatgccagcatggacaggcacatgaaatgaccaatctaccctgctagcaattggttgtggtataggctgaatcaggaacggtattaggataaaattgctttcgcaaaatctatggcagaggtatggatgttgttcactgtttatgaggtggccattgaagattcgagcgacaacctgctcaattggtggtccttgtatgaaagatcaagtacctccaagtcggacaacgaatcaatatttgaagaaatagatccactggatggttgtgactaagattaagagcggtatttaatttggctggcattgttggcatggtgctacagagatttaggttgattaaaaaagttaatgaactgatgtaccggaatggggccattgatcttgttgccttgcaaatttaaaatgggaaaattggacaggttgccgattttttttggaatttttccagttaaggaattatgacttagatgcacatgtttgctagctagcatgggtagattagtcatttttttgcgaaggttccatgttggcatgcacatgtaccggccgtggcactctacagtgaaaaaaagtgaaaaaaaattacaaaagcttctctctccaatggtaaattcataagtgtaaacctaaaaaggtatttggctaattaccaaacggaaaagtagcaaataattaaattttccgctgcctctctagttttgctctgcggacatgattagtaaaaaaactaatgaaacgataaagatgtgtgagttcttttacagtgctataaaagtgctcccagccccaccgtttcgcgtattactagtacctacggagactatcaacgcaaccgaaacttttggtttcaaattccaactgattataatttgaaatgagtataaacatgcaacaaagtaagttttctgtacttgaaagagaaaaaatagattttaaggttattgggtgcccttgcatgaaacgcaaagcgtgcaaatatacttagaaagttcaaattattttcgaacttccattatgaccggaaagtaaaatgccagataaatttgaaattttacaattagttttcttattatattacgaaatttcaatgctcaggttaggaacatacttctcttttttttagtgcaatatttaccatcaatagacaataataaacactaattaataaatgttcatcctactaccctccggttccgtacttgtaacgcttagtacgagtttgagattaattaaataattaaacttctgaccatccgtaatttctaaaatacttcaaacttaaatatcaactactctaatctcacattaagtttatttttacaaaaggtgaatttattttattttagagtaaaagttttactttttatatattataatcgagcgtaactcaagtgcttaaatggttagatttcttatgatagaacttgctcagtgattggtcggatttaacatgagcccctatttaataatatgagtgttcctatttacgattagttatttttttaacagtcgattgtgataactttgtctatgttcgttaatcttaaaataggattgtctaatctttcgaaagtgcacatagcgatatgatgtgcatttataaacataagtgcgcgagcgtgtgtgttgtaagcgtttatttttctactttgtttgcagaaaaaatatttggaatttcgaaaacatatggcatatttagaggagctcctgtcagttgagaagcgacagttataaaatgtagaattaaaagacaaaagctgaaaaagtttagttaatacttactccgtccaaaacgatcatcatatatatttattcactaagaccaataataatttaaatcgcattaactaagacaccatacacacattctcctaaaaaaatcgataaaacaccatgccaattatacatcctaaaaaaatcgataaaacaccatgccaattatacatcctagcacatatatatatattctcctatgatgtattaattgtattacaataaaattcgtgtccattaattatatttcgataaaatccgttttcaatatggttacatgatgatcaatttaaaaaaatttaaattctatcatataatgattaatctgtgaaaaaatttaaattctatcatataatgatcaatctgtgaagaaggaagtacaatccggcttttccagatcctcttaaaactagaggctaacagcttctcaaataacagcttttctcataatattgagctcctctaaataactccgaacctctctcaaatcccaatcgcatgagcggcatgggtacaccgcagcacggcagggcgagcgcgctcatgggcgatcgtgccgttgccgggcgcgtcgtttgctcgtgagcctcgtggcctggtggaacgcatgtgggcaatatggcgcgagcctttaaggagcgatctcaccaaatcgccgcggttgactaattacttgatttagccgcctatggcccccggcccgcgcgtcggcacgcatatggacatatggcgccgtagcataacgtccacacataaacgtacgttacagacaccgcgcatacgattcgcgattaaccaaccactcgtgttctttattattactccagaagtctggaaatacacaagttctcgtacactcggcccgtacgtgtgcacgatgccgatttagaagacgtcggagagggtggggagcttgagctcgccggacttggtgagcggcagggtgaagttgccgaggatggggaggtcgacggtgaggccgaccctcatctcgtagtcgatgtcccagtccctgccggcgtccctggcgaggctcaccaggaagtcgtacggcaccttcaccgggatgtccagccgcgtggtgtcgccggcggtgagcgaccccgggtcgggcatcgtccccgacgccacctccctcccggcgctcttcagcgagtagctcacctcgcagatcgggatggagtgggagtaggggttgcgcacgtccacgcgccccgcgagggtggcgccgccgcggcccacgctctggaacgacagctcggccagctccgcctccggcttctccacccgcgccaccttgtccgccacgaaccccttcgccttgtccaccagctgcgccattgtttcttgccctgattctgatttggttgatcgatcgctctcggttaatctgtcgtcgtcgctgtactgtgttaggagtgggatcgctcgtcgtcgtacgtgctaaatacaggcgagccggagcttctggcggccgacacgtccgtggggtgcgtggtggaacgcgtgtcgacgctgcagggctccgtcgctaaccgctcgacgagtgtactcgcgtcatcagtttttcagtgtttttctcgcgagaagacgacttctgcttggacagttggagcgtctcgtggaagaaaattacataggactgaagtcctacactcatctaaaggacttcgtccccttacgtgacaagtgtccattacgaatctcaaagagacaacctctctcccctctaatccccattcttcttcctccgctcggtgaggcatccctcgaacccgaccaaagcgggcgcgacggcgagtggcttcgggctcatggatgactgtcgggagagtgcgacgatgacatcgtgctcaactgccgctgccagtcggcttgcatcatgtttgctgtagcgtgtgaactccgttggtccgctccacaatatgtattcgggagttgatgtacaccaagcctcttgatgagaaagcagacaacgatgtgattttccaaggttcactgtccaaaagaatcatcaaatgctcggataaaatccatctccccttaataaatcgcctcttaccatatatggattttgaccgcaaagcgcaatataacctcgttccccattagtcaacatcgaattgtcaattggctgggtgagtgttgccgctcgacaccggcggccgccaccgcgtgcgttggtcgtgcgtaagctctacttggtcgtgttgaggaagaacggcagaacacaggagattggggagataggaagaagacagaggctgcctactttgagattcgtagtggacaggtgtcatatgtagagggacgaggtctttcggaggactgtaggacctcagtcttgtgtaattttcttccgcgtctcgtacctgctagtactagtatgactatgctcgtgtgctaatgtgctatgctttctgggctaggcttaaacacgtgcctagttttgtgccatgggctccggcccggtagcttagatggtgactaggctggaaataaaaagttgtgactagcacgcttggctcgttttttaaaatggaataagttcacatttggtccctctatttgtcgtccagtccgattttcatccctcggtcgcaaaaccaggtatgacgggtccctcaacttacaaaaccgtgcaaaagaggtctctcagcagtattgtgcccggttttggatgacgtggcgcctacgtggctccctttgtcttggtcctcgtcccacgtggcattgacgtggcgcttacgtggcaattggatctcaggaaataataaaaaatgtgggacccacaagtcagctacacaaaaataataagaaaaggtggggcatatgtggtcccacatgtcagccccctctactctcgaattaaatttgaaagtatattatttatttatttattttataaatattcgagatgtaaaatttttagcacaaatatatcgtcgtcgctgattgaaagagcgaaatcgaaacgatatatcgctaatatatcgctaagccgttaagcgaaaatgacgacaacgggacacttcgtcacggtctcgcagaatcatggcgcgattccgccgcatccgccacggtatcgcaacagcaggtcgcgagaccggcggtctcgcttcatcaccttgcgagatggcctgatatgactcatgatcagtggacgattaacgggtgattaacgattaattaattactaatgatgttagttaaaggagtaattgtaattaattaattgctaattacactaattaatttattgatagcgagagtacgcgggttaggtaagcgaagtcgcggtgcgagaccgagcggtttcgcgcacacctcgcgcgacatcgtgcagtaacgcacgatttcgcgctttcatttcacgacaatggtatatttctgtaaatattttctaaatgagcgtatttgtacaaaaccaatgaaaaagaggtatattttcaattttttttcctctactctctatcccccctctctctcccttacagaacggtgagcggcggcgcagcggggggcggtgggcagagaggcacgcgacggccaggcgaggacgggtagcttgcggtggccaggagaggagggaggcggcgcgcggcggccgggcgagaggaggggccgctcgaggcggccgggcgagcagggaggcggcgcgcggcggccgggcaaggagggaggcagcgctcgtcgaccgggcgaggagggaggcggcactcgtcgaccgggcgaggagggaggcggcgctcatcgaccgggcgaggagggagggctccgacccggatgtgaccatcgaggacgtcggcggtggcggccaggcgaggaggaaggcgcactcggcgaccgggaaaggagggagggctccaacccggatgtgaccatcgaggacgtcggtggccgggcgaggagggaggcggcgctcggcgccgagcgaggagggggggcccgttctgctgggcatcgggggtgaaggggttacgggggtgaggccggggttggcgggggccttcttctttagaattttcttctacgggccacctccgccgggcgttgacccctacgcaccaccgactcccgccggctactgacccccgctcctctccctccctcccatcggccggcgcgcagctggctcttctcccgccggccgccccgacgagctcgcctcctccctcgcagcgctctcgccacgccacccgccgcccgtcgtcgcttcaccaaaccgcccctctgctccgccctcggtcctccgcccgccactcgtcgccgttgctccgcccaccgctccacgacggacttggccggctgggcgttgagccagcggacgggtgtgtgaggacccaaaataggacctcctgtgtataagtgctagtccaggatcaagctagcacacacagacacaaagataatatcacagccaatatcacaaaggaaacctaatatttaatattaataatgactgtgataaaccttatggctaaagtttacatttattctgccacgaagggcctaaggaaaatattaaagtagcagcggaaataagataaatgcgtagtagctccattcaacttgccacaggcagtcaactaggactcacgacctattcctcgtcttcagcaacaaactcctcaggaaacagcgggaacctttcttctggaattgggggaaattgcaaggtgagtacatggaatactcagcaagcacacagaaatatgcatatgcaagctgacaacaaagaaaatggctattttgcataacacaacaatttgcagttataaacaatttataaacaggtttaaaacaatagttgtaaataacagtattaccaactatccattcacacaggattcgtccacacaggaccacatagctatattcattaacctgcacacagttcattcccagttttcacaaactacccctcatgagatatcaccgagcatgtccatgaccgcggacgcgactattcgaatagattaattaacactctgcaaaggttgtgcagcttgacccacaagatacatcgtccttttaacggccatgcgcaagtgtcacacttcaggttgtgtgtggccaaggagtctgtaacaaggctttttagaaacttcgtcccaacactgccttcccccatgagacacctttccctcacacagacaagaaagtccccatggcgaacctaaactcctatcatctagccacctgggccgacagtgccaagactcggaatcctactgggccaggttcttcccatgagaacatgtggttgcacgttaggctcagatccatgacttatgaagtgaagtccttaattgaccaagacaacttgccaaactacaatagcacacagctcaacagtaggctcacacagagaccgtacccggcaacgatcacacagatacattaccacctaaccaggttcacacagaaccacccatcaccccggtcaaaaaggttttatccgcctgtttgtcggtgacatgggaccgggagtatcatgacttagagacttgaggcagacacgatcacccacgtggcctaaccccctcgggggggggggtcgggcccgagggtgatacgaccgcccttctctttatctccccgaggggttggaccgctcccgtctcggccccgagggccgaggcgccccgaccccttgtgggttttgcgccgcgtatatggggtaggtgagcatagcggggctcacctaaccacatttattgcggtttggtcgagcgcgtcacgccgcatgtaacgcagtgcaacgcgctcgtttatccggtcagtgaccagtcacagaccgatcagatcgtgggttaggtggcgacaggcggtctgacgcacacctagccccatcccgtcagaatgagagcctgtcaagcagtgggcccgaccaggagcaagtgtgttagatactggagatggcaagcaggttccggtcagatatatgccaggcttcatcctaaccattacaggcaagatattgaatgaagaagggcgaacatgcagatttatagactgacgcgtggtggacaagaatgaccgatttgtgaccggtctgacactggtcatgtcgtcagcagacagccattttcccacgtcgcgcctgcttccggcggaagtggaggtaggtatgggctgtcccatcagaaggtcattcggacgacaaccatacaagtctccgtctgtttatgaaaagataggataagtccccacaaaaaagagagagatggtgcatgtggtatccccttgaggtataaaaggaggaccttgcccacttagaaggggggattttcggatccagaaagatcagagagggagaaagtaagagctctctggttctccagctcttttgtagcttcttcatacacagatccacctaaacacagaagtagggtattacgcttctcagcggcccgaacctgtatacatcgcccgtgtcttgtgtgtttccactctcgcgaaccttccacactcagaccaggagcttagaatctcacccagggcccccggccgaaccggcaaaggggggcctgtgcggtctcccggtgaggagccccacgctccgtcatctggcgcgccaggtagggggctttgcgtgtgtttttctaagctctcgcattctttcgtgtgcgccaagcttttcctgttcagcccaatggccgaacaagcaaaggcgcacaacctctctccgagtgttagcggtgacgacggggagcagaacccacgccgtcgagctcgtactccaccgccccctccacgccaaagtcctaggcgggaggaggcgctcgagagggtcgaaggatccgcgacttcgacatccacgggtgatagggaagggcggcgagatggggagcgtcgcctcctcgtctacggcgacggcagcacgccccagggcgcactccaagctgcgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcactgctaccaccggctccgtgtcgtcaaggcggagggcgcggcgagcggcggctgttgctcgccattcagccgccactccttcgtcagcgcctccgacccaggaagatctgcgtggggggccggatgcccgcatcagtatcgagcgccggcgtaatggccggcgtgctgcccacgcaacggagggcgcctcctcgtccagagtgtcacatcaacacggacgcggggatcagccctccgtgcccccggttggtggtgtcggctgtagagccttcatgcgagccttcggaacgtccgttggcccccaaggttccggcccaccatcaccgaaaaatatgacgggagcgtcaaccccgccgagtttctccaggtctacacgaccgggatcgaggccgccgggggtgacgacagggtcatggcaaatttttttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccatactatgcatccctgcacacgcggtgatctacgcgttcagggggggtgtgcggcacaaccgcatgctcgaaaagatcgcctccaaagagccccagactaccgcggagctttttcagctcgcggaccgagtggctcgtaaggaagaggcatggacctggaacccctccggttccggtgtggcagcttcggccgccccggatccgctgctcggacagggcggcgtgacaggaggaggaagaagaggtcagcccattccgacgacgagggtcatgtcctcgccgtcgagggcgcttcgcgggccacccgaaagggaaggcctgcgagcgacaaaaagaaggaggccggcgctcccagtagggagcgcccaaccggcaagtggtgcatcgtccacaacacctcccttcacgacctcgcggactgccgcgcagtcaaaagtttggctgagcggacgaggaagtgggaggaggagaggaggcaggagcgccaagagggcaagtccccggcggttccttccggcaatcggcgaagtgaggccaagcagaaggcccccgccgaggacatcgatgacggcgatgatgacctaggcttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatgggggagcagccctcaacatcctttcccccgcagcctttgacgctatcaaggccccagggatggtgctccggccgtcccagccgattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccaactctgtccatggcgacctcaaagtcgcgcttgcttgtatggagcagcgcgcggaccacctcaccgccgcgtccaagcccgagggaggcgacgagaggcttggcacctccgcccccgctgccccgaggcagcggatagtcacatgcgacgaggtcccggtcaaggaggttgccctgggcgacggcccgtccaagaccacacggatcggtggtcttctggacgacaaataggaagacgcgcgtctctttcctgcgggcaaacgctgacgtcttcgcatggagaccgacggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaagccggattcatccgcgaggtcatccatccggagtggctggtgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgcactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaagcatcgaggccaaccttgagaagatacgaactatagagcggatgcgcccccccaacaagcgtagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccaggagagagcagggaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaagagcccccgacccccaggacggcctcgaggccactgtgggaaggccgcccctgtcgtcctccggccccgaggtcgtcggcacagaagacgagtgcaccccgcgaggccgcttggacaaagagcaccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcctgcataatcgagagggtactggacgggtggtgaaatgggcaatcgaactttctgagtttgatttgcactttgaaccacgtcacgctatcaagagccaggccctcgccgattttgtggcagagtggaccccagctcccgagcccgtctcagtccccgaggtcagctcgggcccctcacagctgcctcacaccgcccactgggtgatgcagttcgacggctccctgtctcttcagggcgccggtgcgggggtcacgttgacctcgccgagcggagacgtcctcagatatttagttcgccttgactttcgggcgaccaataatatggcagagtacgagggactccttgcgggactcagggtggctgctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgggataacacggttgccgacgaactctcacggctcgcttcctcgcgagcccagaccccaccgggcgcctttgaagaaaggcttgcccagccgtcggcgcgacccgaccccttaggggagacggacgcgcctgacaggcccccgaagcccgtcggagtccaggcctcgggacccgaggggagcgctcccagctcccttagattgattgcttggatcgctgagatccaagcatacctcacagataagactctacccgaggaccgcgaagggagtgaacgcgtccaacgcatctccaaacgctatgtgctggtagaagggaccctctatcggcgcgcggctaacggaatcctcctgaaatgcattcctcgggaacaaggcgtcgagcttcttgctgatatccatgaaggcgaatgcggatcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtagagcgcgccaatgcggaaatcctcagaggccttaaaaccaagaccttcaacatcctcaagaagcacggcgattcgtggatcgaggagttgccagcggtgctctgggcgaaccgaaccacgccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagcgaaggtggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagttgcctaacccgtggaacatcgaacaccttcgtcgcttctacccctaaaaggggatcgggtgtcaggtttcgggctcgggccaaccccgcacccccctcgggcgtgcaaggttggccgggggctaccacatatgcatattcttatttctcttatatctgtatttcaataaaagcattttcgatttcctaaaggttgtatctgtgctgttgtttccttttgaaggatcttgacttgaagtaggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagacatcctcgtctcatacacacaacaaatagaattgacacaaaaaattttctctttatttgattgcagattaaattagtctatacaagaagggggcccgaaggcctcggaagaagaaaagaagaaactatttaaagattggcgggggcctgggggctcactccgatgcacccgggtcgccagcctcgtcgccactgtcgcccactccgccgtcatcgtcctcctcgtcgaagttgagggcaaacgcgagccgaggggccgaaccctcgaagctgtggacaatatggtcggcggcgtcccggacctgcgtgcgcgcgccatcctcggtcccgggagggaactcgtccagcgccgtccatggggagaagtcgggatccctggcttggtaactcgccagtacgagctccaccgctcctcgggcgagatccctcgaggatgacttaatcgtcctctcgagctcctcggggagccgttggagagtcccggctatctccgagaggcgctgggcgaggcccccctggttggcggcgtacttcgcagtccgcccgccccagaggcccgcctgccggccggcgcggtctagacgggagacggcgtcccgaagcatgccgggccctacctcgcctgccaagcggagggctcaacctccccggcggacgagtctagcgcgccctgcaaatcggcgatggtgtgttcggcagctgcgaggcgggcggttaagtcgctttcgcccgcggccgccccgcagctgcgcgccctcgcgtccagctcctcccgcgcctcgagctcagcggcccgctggttcagcgcggccctctcggcgcgggcaccttccagattacggcgcgcttgttcctcttgcgcagcctcgcggagggacaggctgtccaccagccgttgcgacgcggcctcggcctcctcgagagctcgctcccgctcggtgagcgcgtcctcgcggaggcggagcgcggactcttcttcggcacaggcggcttcgtgcaccgccagtgtgacctcccgaatagcaacgacggcctcgcgatccgccaggtccctctccacggcgcaggcacgctcttctagcgccatggcacgggcctcaagggcttcttcgcgccgccgggatgccacctcggtctccgccgcccgccgttctcgggcagcggcagcgtcaaggaccccccgggcggcgtcgagctttttccctaactccgcctcccagctcccgtattgaaggcggagggtgtcctgcgcctcgttcatcatggtggtggcgatgagggcagccccccgctcctcctccacctccttggcgatctcccccagcaccttctgacgaacttcgagctctgagacgtgccggcggtgtgccttgcggcccacctccaccatggcctccaccgagcggcgcccctcttcgacacgtgcccatgcggcgtcgagctccacccgctctgcttgcaaggcctccatctgggcacttaacccgtccaacaccgtggtgttagcgacggccaaggcctgcagaagaggttctgcgctcagtggagcaacggaaggcgtggggaagagccgcctcgaagaggatgccgcgcggcttggcccgccgatggacgtgccggactcggggatgtcccccggacctggtttgtcctgagcgtcgcacgagggagtgggcccgagcgatgcgcccgcggcctcgtcgcgagctgcttcggaagtcgtcgtcgcctcggcctggcgaagtctggcctcctcccgagcggcttcttcagcttggccagctcggacgaccacctgagcagcttcctcggcttctcgaaggcgatccgcggcctcttgccggtcagtttcacgggtcgcctcggaggatgtcgtctcctcggcctggcgaagtctggcctcctcccgagtggcttcttcagcttggcgagctcggacggccacctgggcggcctcctcggcttcccgtaggcgatccgcggcttctcgccggtcagattcccgcctccgagcctctgtggtcgcagactggccggacttgggatggcgggagggacgcgacgggatctcgctgaaacagaagaaagaccagaagacaaacaagatggatgagtgaaaactcgcgttgagggaatgaatacggccacgatgggcgtgggacgaacctgcgaggaggtcggttaaacgaccaccttggaggggaaataaggtttccccgagatggttctgtcccccccatcttgcggggccgtttcttcttccgctccccctcgggctgcgacgtcggcgtggcccctccgggcgcctgctgctggcacgtgccgccccgccccctcggggaggagatgggggaggggttccttcctgcttcctcttcccccgggcgtcggcagggcggccgctccccgggcccctgtcgcggggcccagaagcacgaccccctcccggggtagattgttcccccctgcggctcccgcccgcgccatcgtggcctcgaggagcccgctcctccgacgccccgaccgcctgcataatggtcaggatgaaggcgcggtctggatcgctgcagagggggaggactccttgaggaatgagggatgcctccacggagctgagattcagcacccgttggaccactatcttgaagtcctcaggagcccagtcccatctgactccctggtgagtcctcatacagtcctcggacccggtgtactcccaggcaccccgggtgcgccgctggagtggcgcgatccggcgacgaagatagtcgccgtacaccatggcccctgtgagccccagggatcgcaggcccgccaggcggtcgaggacggcgtcatagccatctcccagatctaccggcgcccgccagctggaggcctgcgccgggggctggctcggaagtcggaggcgcgcttcgtcggcgaggggggtgtagaaccagtcgctcttccagtcatcccacttcttgcggaggacgcagggaatgtagcggttcaacaccggcccccgcggttggaagtagcagccaccaaccaccgacggcggcgacaccgactgtacggtgaagaaccaccggaacagcaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccattgcaaaagggaggaagaagacggaccgccccgggtagcatggcgctgggcgtccctcgcccagcgtaactatctcccggccggtggcagattccggcatgaagcggcgcggcagcccggcctgcctctcgctcacgatgcgggaaggcggcagcacgctaccatcaagcaaagcggagccccgtgccatgacgccggaggaagagatgtttaagagtgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggacatgcggctgtggcagtcgagatggaacatctcgtgcgcgcgttaattacgctcgccaaccaaagcgccatcaccatatctccaggaaaaatgaaccggattgtcccgatttttagaccggccccaccatgtcaccaggccttaggaagtggcgtcacacccgaccgcttccctcgaggagggcgatcgccctggcataacgccgggggctactgtcggtgacatgggaccgggagtatcatgacttagagacttgaggcagacacgatcacccacgtggcctaaccccctcgggggggtcgggcccgagggtgatacgaccgcccttctctttgtctccccgaggggttggaccgctcccgtctcggccccgagggccgaggcgccccgaccccttgtgggttttgcgccgcgtatatggggtaggtgagcatagcggggctcacctaaccacatttattgcgatttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggttccggtcagatatatgccaggcttcatcctaaccattacaagcaagatattgaatgaagaagggcgaacatgcagatttatagactgacgcgtggtggacaagaatgaccgatttgtgaccggtctgacactggtcatgtcgtcagcagacagccattttcccacgtcgcgcctgattccggcggaagtggaggtaggtatgggctgtcccatcagaaggtcattcggacgacaaccatacaagtctccgtctgtttatgaaaagataggataagtccccacaaaaaagagagagatggtgcatgtggtatccccttgaggtataaaaggaggaccttgcccacttagaagggggggattttcggatccagaaagatcagagagggagaaagtaagagctctctggttctccagctcttttgtagcttcttcatacacagatccacctaaacacaggagtagggtattacgcttctcagcggcccgaacctgtatacatcgcccgtgtcttgtgtgtttcactctcgcgaaccttccacactcagaccaggagcttagaatctcacccagggcccccggccgaaccggcaaaggggggcctgtgcggtctcccggtgaggagccccacgctccgtcactgttgttttacacggtgcaacacatactaccgaaaagatagcacacagccacacaattcatataaaaatgattataaatatatgattaatcaaaattatattttgcttgtaaaacaaccttgagcgggctaagcataactactctaccatgagttgagcccaatgttcaactcacaaagactagggtgacaaggtattatgggcaatcaataattatcaaaggtaggataatattaacaattaggtcacgctacccatcgatagtttataaacaaaacaatgcatgtattcaaaacaaaacatttcacaaatgggttcaatatattcaaagagtgcacttgccttgttcccagtattgtccttgcacagcgtcttctgaagcaaactgctcttccgctccaacgtctacacgattgcacacgaaaacaaataaacacaaagaaaaactaactaaataacatcaaatgaaataaccaattaaaccagaaggtagagctcgattttagaagaatttaggaagaagaatggatcgaatcggagttcaaacggaaaagttatggcctccggaagtttgaattcagggaaaatccgagggtaaaagaaaaaggaatattccgagaatattctctggatatttaatttcggaaattgaattaattttggataggaaaatatatgtgggcccactgtcagtggcatagagaaaaggacaaggagcagctgctccatcacacggcatggcgtgctctggccatggcgccatggcggctccagcgcggcggcgtcggcggcgttcgtcggcgacggcgcacggcggctgcggcaaacagcggcggaggcagaggaggtcgaggccaacgcggtggcgcagcaccgagctccgggacggcgtggagatggcgcacggcgacgagaggcggacgccggagttgaggtggagagagaaacggcggcgcgaaagggagagagggctcagcctcggggctttaccagcggcggcggcacgggaaggagatggcggcgacgacggcgcggctcccggcggcggcacagaacagcagcggcgatggcggctgctcacggtggagatggcggcggcggctttggacgaaggaggggaaaaagagggcggcgaccagcgctatttatagaggagggagtagctagggttagggcgacgcacggcttcgatttatggaagggcggcgccggttcttgcggggtttagcggcggccgattgggcttgtggcgcggccggcgcgggctcggtcggcggcggcttgggccggcgatgcagagaggaggaggaggccgggccgaggcggcacgtgggctcggggcttggtctccccgggcctgcggctcaagaaggagagagagagctggaggtagaaggtggggaaaaaggaaaaagagagaagaataagggctaaactgaaaaagggcagaatagagaaagagagaaaggaaaaagggaaaaaaaacagggacttctctggaaaattccaattataaagtatttggaatttttggaaaggatttaggatttgaattagaatattggatttggatggaatttgaattagggattgagctccacttccgaaatacgaattaaatccaactaactccaattaagaaccacaaagcaaacaacgtattaattaattaatcacattaaaacccttttgatttaacgaaattttcattaagctattttagacgaataaaccaaatgtgaattttcgcaaataggcgagcagaacagaaagcgaaaaatcaggacgtgacatggtggcatcctcgccgtcctcgcagtacccaagaactccgagaagggcgcggcgagcccatcgaaggacctccgatgatcatggaacccgaacaagccgggcatcatgtcgtccccgctgccctaccccgccccgccccaccggcttcgcatcgctgtgcaccggaagaagatgacgacgaggctggcgccccttcggcttcgcgctgccgccctattcatctgcccgcctagcgctcccgccgtcagccgccgccgtcgccggagctcgcctgctccgccacccacccgctccgtcccctgcctgggaaggagagagagagggagaggggaaagggaagaagagatgagtgaggctgacatgtggggcccacgtgggccccaccatttaaaaactatttttgtttgtgcagctgacatgtgaggccacgctttttattatttttccgagatataattgccatgtaaacaccacgtcaatgccacgtgggacgaagaccaagacaaacaagccacgtaggcgcaacgtaagccaaaaccgtcttcaaaacagccgagggaccacgtttacccggttttcgtaagttgggggacgggtcatacccagttttgcggttaagggacgaaaatcggactaggcgacaaatagagggacccaaagtgaacttattccttttaaaattgttaacgtgctaagacaagattttatctcgttatagatattccctccttcccaaattgatcatcatataatgaaattcaaaatttctcaaatcgatcgtcatataaccacatggacacagattcatcagaatacaattgatacagcatgggagaatgtgtgcatgctaaggtgtgattggcatggtgttttaatcgatgtatgcattatagtagaatgtgtgcatgttgtcttaattgatgtgatttaaattatttttggttttggtgcataaacatatatgatggtcaatttgggaagaaaggagtataacgagccacctaactcacaagctaaatatgccaatgtaattggttgcgtgagcaaaccttgagtctaggacgacagtaggggtggcaatatagtattatcgataggggcggatccagaacaagatttaaggatttatctctttcttctttagtcctccctactcttcattttttcactattctttcccttttatattcccttctatcaatggttgatccagtggggtagaggggactcgagtccccccagcacccacgctggatccgcccctgattatcgagttgtagagccaacacatcgtgttcgtacgttagtgacgaggagcacgtctcctcccagctggtggagttgaagtcccggccacctgccacttccggctgcgcgtcattgatgtacggggtcgaaaggggacaccaccgtcgtcagcagccgtgctccgccgccacagaccactgacacctccctcgtcatcgacctccaaccgccgttatcgtctcccgcagacgcgctcactggtcgtgcccctcttcctatctggtcagctcaggaggaagagaggggatatgtgggagaggtggaagtccacctacttgcgtacatatggatctcatatgttttttttactaggttgccatgttggccaaaatagtcatctatactatcttaggatattatttaatcttgtttcaaaagatggggttcaatgtttttatattgcagtttaaggatgtcattcaaacgtcacattaagatgagatacaatgtgaacttattcctctatgcttagatgtgtggggtggggtagagcctggaggggtaggccggtgcagtgcagcagtgaaaggaataagttcaccggaggtccctcaacttaacagcgagattttttaggtccctcaaccacaaaaccagaaatgttcgcccctaaactcattcaaaccgttcacaggaggtcccttggcagtataggtgggtggtttcgctggcgtggcatcctagtcagcaaaaaaaaataaagtacgtggggaccacatgtaagtgagagaaaacggtgcgggccccacatcccttccttttttttccctttcttctcttctctcgtcttcttcgacgagttgagacgggcggggcaacggccggcaagagcggcggcggcggcggagggcgagcgcggccgcggcaggcgaagcaggcaggagcggggcgatggccggcgagagcggcgacggactgcgggcgacctcggcaggaggttggggcgggatccgggaggtggaggcggaaccgcggcgcgttggggtccccgaacacgaggtcatccttgagcagcgctgtccaccgagcgcggcctgtgggcagaacggaggcgggcggcatggcggcacgcggagcggcgttggacggcggcgggcgagcggaaggcaagcgcggcgagctgcgggcagagcggacggcgggcgtcgggcgagccgatgagcactgcaggcggatgagggggccgcaacggcggaggtggccgaaggaggagcgtggcggcctactccgctagtcgcctcggcgggggcggcgagagcggcgcgcaaagcggacagagcgaacgagcacgtcgtcttgccgctggttcccgccgccgccgtcgcactcatcgaaggagcccagcgtggtggcgcgccgcagcagcgggagcggacggagttggggaagatgaggctggtgggagagggggaaagaggcgacgcctcgccgccgctcgcccgccgcgccccctgcccctctgctccgcccgcgcccggagacgccgccgctccacctgctccggccgcgcaccgcccacactcggagctgccgcttgcctgccgtcacgctcgcccgccgcttgccgtcgccgcagccgcgctcacccggagacaccgccgctccgcctgctcgagcgcactgacgccgcccctccacctactccagtcgcacgctcgcccatcgccacccgccgccggcaaagagagaggagaagaaagagaagaggagataaaagagaagaaaaaaataaagtgcaactgacatatgggccccacgaattttttttaatttttttttgctgactaggatgccacgtaagcgaagccacccacctatactgccaagggacctcctgtgaacggtttgaatgagtttagggtcaaacatttttggttttgtggttgagagacctcaaaaaaatctcgctgttaagttgagggacttccggtgaacttactccgcagtgaaatcgtgtgctctgctttctagactgggcctaaatgcaggcccatgcttttgccatgggcaccggcctggtaacttcaaggcccatgaactattcaccttctccccgctgcttagatggggtgactcactcttgcagtcttgctatgtttattcatccctgcaagccgcatgctgcctcaagattatgaacgaagaacagagagttgataaagataattgttcttcgtgtgcttccctgtggttattatatatcttatccttctttcgaaactagtcgtgtggggtgaacttcaacacgtccactacattgtttaccaatgaacaacttaccatatagcagtatttaactgcacacatgcatgtactgcgagccgaaagaacaaaacgtggacagacacctatccctctgatacaggagcaaatctgttgcaatgcggtcaccaatgttagcagaagacagacgggaccccgtcagattttgaaaccgggagcgcccctccaattcaaattgcccacttccctttgttaacgcgtcagttagcgtggatcgcaagagatttagcgacaagatctactgctgaatctttccccctgctagatatatatacacccggatataaaatttgattcattccctgtatcgtcttcctcgtgctctgctctacagcatcatatcatgcactcgtgcatgcatggatggatggctatagcttcgttgtccaggtacagtgatcttctcttcctctccaccaagctctgttgattgcaacctcagctccatggataagatttttcagagcttttccggctatcaagattgccactgttggtgccccgtgaagcgcccacgtacggcgcgctgtccgagctagatccatggcgtttccggacaccggacagaacatgtctcctgcagagatcggtcagtgcgagcaagcagctagccgagaacagggcgccgggcgagacagcctctgccgctgcgtgcagaatggcagcagcggccttcgaaaaagggtgcctcgcacatggctccccgactccgatccgggacgagtcactgctgcccattcacggcgtagtacgtgcgtgtgcactgaactttcaccggatctgatcgatccactcgaaaatgtcgctaccacttaccagatggaggagaagctgggcaggcagtgtaattaacatcttcctgtaaaaacgtatcaagatatctgacagatcgagtcacccaacagttaccatatactactcgtatcggtatagtaaattgattgattagaagagttcagaatagagaagagtaaggagctttgcttgttcatggtagtcgtagcactgttgtcttcatctgaagtggagtacttgctaaattgctcaacttgagcctgcacgtgatacgatcgagcacaccaacgtacaaagcgaagaaaggttagttaattacttactgttctggaagtggattgatgccaacgccaaacaggaatccgaagtgatcgagtacgtgaagctcccccaaggtaggtggcaagatctgaacccaaaaaaatactactcccttcttccctaaatgtttgacaccgttgatttttttttaaatatgtttaaccatttgtcttattcaaaattttttgtgaaatgtgtaaaactatatgtatacataaaagtatatttaacaataaatcaaatgatagaaaaagaattaataattacttaattttttaaaataagacgaacggtcaaatatttttaaaaaaattaatggcgtcaaatattttgggatggagcgagtaagtttcaactcaagcagagttcaacttacaccggttggtacttgatagtattgcactcttgctactacgtagtacgtactactccatctccaataaacatggtttaagttctcgtctgctgttctctccatgcaaatggccgtaataactttattaacaagtgctagtgaaagggggaaagaaaagggtatagtatctttttttttcaacagcgcggtatcatgtggctgtcgagtactcgctccgtccttaaaaaaaactaaatttagaaccggatttggtccttcctaaaacaacaaatatagataaagtatagtttagattcactgtattaggagtggtcataccgtcttctagggccaagtttagtttcaaaatttttcttcaaacttttaacttttccatcacatcgttccaattttaactaaacttctaattttgacgtgaactaaatataccctaggttgatttttttttggacggagagtatcgttgtgtgcatgacggcgtcgcgttgcaatggtggtgaatccgtgagacgcatgccgcgacgctgtacctgtgctcacttgcgtgtagtgtaagagcagagcagcaagctgagctgagctgaccagagagattcccgcgccatccatgtgcagtcgctgaaaccggcgagagacctcacgtgtgacgccagtactactgctactgtaggagtactactgttgcatcttgcatggctccttagtacctggtgcaagtactcacgtacgctccggtccccggtttacccgcgcatgcacaatacttgtctcctccacatagacttttgaagtctcctccgcctctcacgcatataagcacaaaatccgcctgatgagaaaaggtttttacatatcggtgtgtgctgggcattcttcctcacagattcggccttcaggattttgagtcaagtctatttttagggtgtgttcgttacatggacaataagtgagatagcatatcgttttccgcgcgcacgcttcccaaactattaaacggtgtgttttttcaaaaaaaaattctataggaaagttgctttaaaaaatcatattaatccatttttacaatttaaaatagttaatactcaattaatcacatgctaatgactcacctcgttttgcgtatcttctcaatcttctcaatcccctattcctcaaactcacccattaatgttgtctatatatacttaggatgtgttcgtttgggtgatagggagtaagaatgcacatcgttttccgcgcgcacgcttcccaaactactaaacggtgtgttttttgcaaaaaaaattctatatgaaagttgttttaaaaaatcatattaatccatttttgaaatttaaaatagttaatactcaattaatcatgagttaatggctcacctcgttctgcgtatcttcccaatctcctcaatccccttctcctcaaacacacccttagtttcatcatgccttttgttatccaagttagctttaggtatgatatttggcaagtgatctaaattaaagtcaagattggcagcacaagtaagctagcacacataaatattgtattcttgtgggatataagggcatccacaatgtactacaaaagtagtccataggaaataaactattccattcagccatctagtaacattgtgcaactagtccatataaagaaaatagcaaaaggtatctatatgcatatggactacccatataacataaataatattatctatctctacttctctctcttctcctaatgtcacattgtatccatatacattgtgaggattgctataggtaaagtttatttatgtggatcctatctatatagaccacttttgccatatacattgatgatgccctaaaccaagataccaaacaatcttaccttaactatgatttatcccacacatatatacgtgcatgacggttgaaatggctacatgaagcaattttttttagataatgaattcatttcggcatttgcttaaagaaagttatatcaattattagagaggttgtaagatgaatggcaacgaattacaaaatcacaaagatgatgtggactaagatgctataatagtacttgtaaaatcacatacttagcaactccatgacactaaatagccgaaatgttttatatatgccgggtcgagagcagcgttgacagcaatatgacaatgtttgcatatagctagccacaagctagaggaggaccatggatgtaggtgtgatcgaggacatcgtatttagagtggttaggaggcaatgggcacatccaacgcaaacaagcaagaaaaggcaaaatgaaggatcaatttaagtagtagggttggaggaagagtggattgaaagaggcatgtggtatagtacttgccggtgctagtggtaaggtgggatatataagtgcatcgtataatgttagccataatgtatatgtgtctctttatagagagataagatatttgtacctattaaatcacaaaagaatattgatgtttcttactctctggggtagaaaaaaaacaacttttatatctagacttaggtcatgatcaaatttgtgtataaaagttgtttttttttctaaaatagaaggatcggagtaagtgataaaagcaaggtctatactcttcccatgtgtttggtaaacagagagagtaagagttggctataagctagctataaacatattttaaagagataaaataaagagagagaagagcagcggactacagatctgtagccagctgcagcacagactacaagacgtaatgtgtgtatgacaggtgagaccagatattaatagtatagtaagcaactattgtatgaattagctattacattggctatatatgatttggagctagtagtgggctatactattaaacttgctcatttcttgatctgatcttaatggctaaaacaattatgtacaacagtccaagatcggtataggccgtgtttagattctaactttttttcttcgaacttctaacttttccgtcacattaaatgtttagacacatgtatggagcatcaaatgtggaggaaaaaaccaattgcacagtccgattgtaaattgcgagatgaatcttttgagcctaattgcgccatgatttgacaatgtggtgctacagtaaacatttgctaatgataaattaattaggtttaaaagattcgtctcgcagtttacaagcagaatctgtaatttattttattattagtctacatttaatacttcaaatatgtgttcgtatataaaaaaaaatcagcacacaaactaaacacagccatagccactccatatgccatctgtccttaaggttactctaactcgttgaggtgtgtactgcgtccatgtatctttgtcaatctcagtgcaactcggctgatcattcccagatcaaagtaaacaatgcacatgcatgcaaatcagaatcccatcatctgatagagcaagttcatctgttctctgttcctgccagttagcacatgtcgtccgagcacacacgtactgtacgctagtacagtagcattacaaagctgcagggcagagcaggccagtgctcgttaactaggaggaggtttaggtgatagcacatcagaacttaatgtgaatgaaagttatgggtcccataggggggactgtacatttttaatggcctaatattactactgtgtttcctactgttgtaatctcctctgacgcctgagcacagcgttactaatagtagcatgatattgcaccttcaggagcaacaattaaaatctgtaccggatactgtattctgaaacaggaaggagactcttgactattgagcagctactactacctcgttccaaaatataacaatttttagttataaatctaaacatacagttatttatagctaaaaatgcttatattttgatacggagtaagtagtaagagataaaggctgagaattttataacctcttagagacaaatccagcatcctgggaccctttttgtttctctgaaatcattagcagtttggagcaaggcggcagagtcaccatcaaatcatcaatcagagccgagcccccaccttatattagtatacatttagtagccaccaggagcattccatccctgaaaatagcttatcatgatcgatcaagctctctcatgaagcggccaccaaacagtggcagtaactctcatgccgttcagtatgtgaccgcagttttgccaccagtggcagttttgcaagccctcaattctcataaacgatgactctgtgagctgatctgacccgcatggtacgttgacagcgaggagagatatgatttgatttcctcccgcctccttgtcatcagcgccacgccaatcaagtaatctatctattatattattaaaatagccttaaaaataggcaccacgttcgccgtggagactagaaattcctacaagaaaaaaaagaaaaagagagtacaagtagaagtacaatctaaaaatagctaaaattcggaattaaaaataagcaatatggaaagaggagttcatgtaggaacccaatacgtggttaattaaaattcagaataataataaaataaaatctaaaactagaaaaggaaggagagtccaagtagaaatacaatttaaaaatagctgaaatttggaattaaaaataagcaatattgaaagaagtttccatataaaaacccaatacgagattaatcaaaattcaaaataaaaataaaataaaatctaaaattagaaaaggaaatgagagtccaagtaggaatacaatttaaaaatagctgaaattcgaaattaaaaataagaaatattaaaagaagagtccatataagaaccaaatacgagattaattaaaattcagaataaaaataaataaatctgaaattagcaaaagaaaataaaagaagagttcaagtagaaatacaatttaaaattagataaaattcgaaattaaaaataagcaatattgaaagaagaatccatataagaacccaatacgagattaattaaaatttagaataaaaaataaaataatatctaaaattagaaaaactaaaagagagttcaagtaggaatacaattttgaaacaactgaaattgaaaataaaaaataaaaacaataaaagaacacaatacagtattaacttttttttttcaaaaaaattctgaaattagaaaaagaaaaataaaatttcaattaggaatacaatttataaataactaaaatttgggataaaaataaatacaatttatcgaatatttttataacccaatacgtgattaattaaaattcggaataataataaataaatttcaaaattataaaaaggaaaaaagaagatttcgagtaggaataaaatttataaatagctgaaattcggaattagaaataaggaatattgaaagaagagtccatacaagaatccaataccaaattaattaaaattcacaataaaaaaataaaaaaatcgaaattagaaaaaataaaagaaaataagagctcaagtagaaatacaatttaaaattaacttaaattcagaattaaatataagaaatattgaaatgagagtacatataagaacccaataatagattaattaaaattcggaataaaaataaaataaaatccgaaattaggcaaattaaaaagagagttaaagtaggaatacaattttgaaacaattaaataaaaaataaaaaataagaatatcaaaagaacataataataaataaaataaattctgaaattagaaaaaaaaagatttcaactaggaatacaatttataaataactaaaatcggtgataaaaaataagacaaatgaaagaaaagaccatctaaaacacatgacgagattaattaaataacaggcctataaaggagcagagaggtggcggttgatgagacatctaaaaaactattaataaatgaccaaatagaattctaatgacgattaaaaggaaggacgacgggtaggtcgtgaagctatctgtcaaggcggttggcggggacttctagaaagtaaaaaaataaactctaatgataatcatatttgatttttaaaatctcaattacggtaaaaatgagacgcagcgggcgggtcgtataggagtataatggtagaccgctgatggttggtgggtcttctagaggagtaaagtggcagcgtttgacgggatttctaaaaattataaaaaacataaaacccaacaagacaataaaactctaaaaactataaggttcaatttttaaaagttcaggcttctaaaaagtaaaaaaaatccccaacgataatgatgtttgattttaaaatctcaatgacattaaagaaaggcggcagcgagcgagctgtagaggagtagatagacaaagtcgctaacattttggcggaacttctagaaagtaaaaaaatgaagctaaacaataattatgttcgatttttaaaataacaataacaataaagagaagatacagtggacggttgtagaggagtataatagcagcgtttgacgagacttctaaaaattataaaaaagaatcccaacaggacaataaactctaaaaaatataagtttttagatgaaggttataaggagaatggtagatcgagaaagctaatagaaaataatataacagaagcaagggtagcaactgatgtgtcttttaaaaactacaaaattagaaccacgaggataataaggtttggtattttaaaatcttaagacaacgagagaactatttaataaattttaagtaaaatcatattaaaaatatatataattttatatgggtgctagccgcgtaattactcgggccacccagctagttataatcaaaccatcccgtcacggcattcccggcatgctttccaacgcgtcgtcgtgtcgtcgttgccgtcttggctttagccttcgtacgcgtccctccctccctccctcggtccctccccgcggcgcgcgcgtactgcacgcgcgcacacacacacacaccgtgccgtaaccacccatcgcgcgcgcgcgcgccatgcatgccaaccaaggagctcgacgcggcgaacacatcacatgccaagaggggcacacacgacgactaccggtcgatcgcctattcgcctgtagtagcaaatgattcaggcgggtacgtacgcgcctccggccttggcaccagcaggcacgcgcgctatcagctggtccagccgcggcggcgagccaccaccaggccgtcgggtctccctcacgtacgtaccgtgctcgtctcatctgtgtgcctaccttggccgtatgcatcgcccgctaataatattctcccgctgggaccgacgcggcgcttgtctactaacagtgtttattaggcgcttgattggtgcaatgcaagagggatggaataaaatcacgcgtcctctgagcgagacgggtggatggtggatgcacggagcccacggccatggcgacggaatgaattgcggtggacgtgctgtggtaaatgctcaactggccggtgctgcagcagctttaacttcggctcggatcggacgagcggtgaaacagataaccactccatcatcggtggacacggactaggaaggctagcgcttgcgttgctcgcggcattggattccccgactcgtggatcggtggatacggttcacgtttatgctattctgacattatctaaagtgcagtgattagtctatgcttcactcatctactagagatctaagaaagtcaatgcggttaatgagcgagtggatgcctgcgtcaggctgacggacatggcccacggcaacgaatgtgcaagcttccgagggagggtgaagacgtatggtacgtccaaaaaggcttaagagcaagtttaatagtatagctcactaggttctaattcatctatagctaattttgtcggtgacatgggaccgggggtatcttgactagaggtttggggcagctgcagtcacccacgtggcctgaccccctcgggggggggggggggtcgggcccaagggtggtgtggccgcccctccctctgtctccccgaggggtcgggccgctcccgtttcggccccgaggactggggcgccccgaccccctgtgggtttggcgccacgtgtgtgggttaggtgagcacaacggcgctcacctaaccgcgtttattgcgggttggacgagcgccccacgccgcatttaatgcagcacagcacactcgttcggtccgtgacaggtcacagtgtgtgaccggtcacagaccggtcagatcacgggttaggtggcaacatgcggcctgacacacgcctcgccccgtcccgtcggaatgatgagagcctccaggcactcgtccctagccagagccggtgtgctaactcctggagttggtatgtcagtcccggccagattcattccaggcttcatcgcaaccatggcaaggaagtcattgtatgaagaagggtagacgtgcggcatgctaaactgacatgcggtggacaagaatgaccggtctgtgactggtctgacgccggtcacgtcatcggcagacaaccgtgctcccacgttgcatctgcttccggcggagtggaggtaggtatgacccatcccatcggagggtcattcggacagcggccattgcaaatctccacccattaatgaaggaatgacagggttatcccctgtgtcaggcgagtgatggcgctgggcctcactcaaggacaagctgtgatttagcttccaggcgaaggcgcgagccaagttttggtcaagatagggtaggtccccacccaaaagaaaagtaggtagaagtggtgcatgtggtatccctttgagatataaaaggaggaccttgcccaccaaaaggggagagaaaaaaaaagaaaaaaggaggctagaggggttctggagcctgaactctctggctctccggctctttgtaactccttcacacacatatccaccagaacacaggagtagggtattacgcttctcagcggcccgaacctgtctacatcgcccgtgtcttgtgatcgatcgagggcgaagaacctcacttagcgcccccggccgaaccggcaaaggggggcctgcgcggtctcccggtgaggagctccacgctccgtcaaatttacacaatatttgcttactatattattaatatatagtcctacctgttatacgcacattaggtcttagagtccgtgctgcagctggctacagatctatagtccgctgcttttctctcttatcttttatcttattaaaatatatttgcagctggttaataagtatactattgtacatgctctaacagccggcgccgtagatccacttcccgaatcaatgccgacgcaggccgcagtaactccggggcgtgtcgacgccacgtcgtagtaggctggtacgtagtgtagcttctgtcacgtaccgcccgtgttgtacgtatgtgcgtatacagtgtgtgcatacactcccatgctgcagtgcagtggctgtatttacacgggcggtagtagtgtactccagtacgctagtgagtcgtagtagtagcaatatgcccagctacgcgtcgcgccaacccgcaagcgtacgtgcgcgcgcaccgaagcacccatgccaccggccgggcagaggccggccacccgtcacgcaccgccgcccgcggcgtcgtcgcctcgcgcccgccgtgacgagatggcaccgacgctatccacgcgcgtacgttcgtgggtggggtggcctcggcgctgtcgcctttcgcggcgaccgaggcgagagacgggagagaccccgcgggcgcgagcaccggcagacgcgacggcacggcacgccgaggctgagacctgtttagatctagtttggacattaattataaatattaaacataaactattaataaaaattcatccataatcttagactaatttatgagacaaatctattgagcctaattaatccataattagcctaattagcctatgtgatgctaaagtagacattctctaattataaattaattaggcttaaaaaatttgtctcgcaaattagtttttattacatagactacagttaaagtccgagctgcgccgcggtggccgcctgtgcctcgtgccgcgacggacttgacagaaagacgatggatgttttttgagggagggtgggggggggg

SEQ ID NO: 43852 - DNA, 10339 bp, Oryza sativa
  unsure (1)..(10339): unsure at all n locations
acgtgttggtcgcggctgtcgntggggcggggcgcgggcgccttttctcgaacggaaacagagattcgggcgtgcaaaccggacggggaaagcaccggtgcaaaatcagcttttcttttgtctctcggggcttggttttatcccccgagttccacacacggcaggcatagtggtaaagctgcccgtccccgacacagccgtcttttctcagcaacacgatatattgacacaagacaaccaaagtcacacggtatgcctacctacaccccccacatgaccccatcgcatgcacaaattctgatgggaaaaaaaacgagcaagaaagtgagagatgtaacaacactcccgagattacgagaaagggagcaatttactagagagcgacttcacatgggagatggaaatattttacatatgcatactgctaagctagcactaccagattattgagctaagacggcggcgagcaaattacagataggaacaagatgggagttcatcgcggccaaaaagacaatcttttgccacgttgagacaagccgcacacatgcacgtttttttatcacggcatcatgtgttcgatatcaacaactaattatactactagcgtctaagctacggtttgagcacggcgatcaccgtttgtccgtagcggcgaatcggccggtccgagtcaagcgccgccgtcaccgccgccgccgtccttggtgtcggcccttccgccgtccctcgtgtcgctcatggaccgcagcaatggcgactccgaccctactacagagagagatgtcactacgttgcgtgatagtgtcactgggaggtgggccatggaggggggtgtggtgatggctacctttggaggcgttgaaggagcgcttgcagtgagcaatggcgctctggatgccgtcctgcagctgcagcagcgagtcgtcgcggcgctgcggctgctgcccggcggtggatggcggcggcggcagcgacggggacggcgcggcggccactgcggaggacgcggaccggctcttgccgaggcgcttgcacacctgcttcagcccggctggcacgctggcgcggggcgcgcgcacgccgcaggcgacgacgaccggctgcggcggcgctggggccaccgccgccgccgccgccgcggtaggaggctgggtgggcgccggggagggggaaggggaaggtgacggcgaggggtcgggctccaggtccgtctcctcgccctcgctggcgctggcgaagcggaggcgctcgccgtagcggcgggagaccttgacgtaaagcggtttgatcttgttcaggtacttgagcagcatctccttcgcgaaccgccgttcctcggcggtgatggccgccgcctcgggagtctgcagcgcctgcacagccggcctggctgcgccggcgccggcgccggcgtcggaggtgcgagagctgttgtcgcgcgtgaagagcgagacgaagggcgcgtcgtccactcggaacttgatcaagaaacggttcgtcttcggcgccggggagccgccgccgccgttacattccgccgggacagggaccttcggcttcctgagcttcagcagcagcacgcggaacttagtcgccggccggaggaacgacgccggcggtgccgccgcctccgagaccagctccaccaccttcgcctctccgcactcgccacccggcgccaccgccaccgcgtcgtccacggtcaccacctcgccgccggacgcgacatcccccgcgacagagaagttgaactcgaccctctcctcctccgcgtccgacgcggcactctcgtcgccgggcaccgcgaactccaggtcaaagaacgacgcgtcgtcatccacctcccctcctccacctccacccccacccccacctccgccgtcctcgcacgccgacgcggctatggtggtggccgccacggcgccgcccttgttgccggcaaccgcgccgccgcgcaagaacttgaggaaggtgaacgtctccatgccacacaacacaacacaacacaagacagcagctagccgcagtgagcttcactcgtttctagctcctactcctacctcctactgcctcagcactgagaaaaggactcttttggggagccttttgagggtggaaagagagaggtcggagaaggtggtgcatcaaggactaaacggtgagatcgtgagatagtttgttccgttttcaacgtgcgctcttcccgaactaataaacgggtgtgtttctttgtaaaaattttctatagaaaagttgttttaaaaaatcatattaatctatttttgaaatttaaaataattaatactcaactaatcatatattaattactcatctcgttttgcgtatcttcccaatcttctctatcttccctttttcaaactcagcctatatagatgagagaagagagagcgggtcagtgaggtagtgaggtgctcggctcgcgccatcctgtccgttcatcgccgactcgacggtgatgggcgagtcggggtcaaacgatatgggagggagtaactgaaacatttgggacgagtgtcccaagtgtccactaaaaagctaaactggtttggtttttcggtttcgatccttttggaattttgctggcctttctcaccgtagcaatcctctgtatttgaaagagtcgttttgaattagaattttgtaccccctcctcatcaaatgcatgcttacagtacacctatagttcgttttggaccacttcatgttttcttcctaatttgtgtgtacatctctctggtcaaaatacaacaggcatcttgatagaaaagcaatgtatccattttctgtttctatcttggtcacttgatagttgagaaggataaatggccttgtttggttagcctaacactgtaatgttttatgtctaataaaggcataactaagggcccctttcaaacacaggataggaaaaacacaggaatagaaaaaatataggaattgaagtggtatgttttactaatcctacatgaatgaaaaacacaggaaatataaagagggtccctttgatagcaccataggaaataaacaaagcaaatgatagtttccaagaggttgaacctcttgcttattttcctatgaaattgagctataggaatacaatcttaaggaaaatttcctatactttcctatgaatcaagggtttcataggaaaaattccttaggaaattaaatcctccaaaattcctataacaatcctccaattcaaaggggccctaaacttagttatttcagaaggggtttggccaagaaagttgaagggatttagcataactagctagagaggatttggaagaaggtgcatcgtgaacattttatcgggtgggtgcgcggaacatagcttatatttgcttagagtgatgattatatatcatgttgtttgagtcatgcatatgttttctgatggcaacatcttgctagccgtgttaagaaaactatctttagatcaaacatgatagagctacctaaggtttcttttgcagtaagcgataataaaggatcttttgggattttgaacctatagtgtttttttttcctagccatttggaacgaaggagattggacactattgaataaatggaaaatcctatggaatacatcaatccatgagagtttcagataaaacataacatgtggttcaaccttacgtaaattatatatcctccttttttcacatggtttatccaactaatcatttttttttaattttctttttttgtcaattttttgagtttattttccctactcctatgttttctcaaccttacgttatacaaaagatccctaacttattttgggatatgaccatacgagagtatcacccgaacgatatctctttggcttggtctagccagagacaatggttagagaccagtaaaccaaaaccaaacactacactctactccctccgttcaggagtatatacagattcgttgtattataatatgtcattagttttatatttatttatttatggagggagcttatatatatgctgaaatttccatgcccatcatttccataaaccatgataccaggaatgattgcgtccaaccagaagcatgcagtcattggcaaacgatgacagtgacacaaaagagaacgctgcagtattaccatcgcaatgatatttactcgtttctttggagatggaaggccatgatggaatcatccaagcctgacacgaaaatgatgactcttgagatacagtatcacttctacagatgtgagacacagttgggacttgggaggcttgatcagtcgtcaatcatttggagaatggatgctgaacattggagtttgagcgagagccagtagttgcaatgtgcaatgcaaatttggacgtataatttggcctcgccaccggtctggactcctactatgtcagtccttttaatctgagacactaccgtccatttgtgaggggggcacttccacatttctcctaggagtacttcattctcaccaaaatataaaaatctagttgtacgaatttaaacagagactgttcagttttatggtactaagatatatcactgtccagattcacagtagtagtactatgacatgtcatatccaatatactccatccgtcatataaaataccaatctaatactccctccgtcccataatataagagattttgagtttttgtttgcactttttggacactcgtcttattaaaaaaattttggaattattatatacttttttgtgacttactttattatccaaagtactttaagtgtaacttttcattttttatatttgcacaaattttttgaataagacgagtgatcaaacagtacaagcaaaaactcaaaatccattatattatgggacggagggagtacaggatatggcatatcctaatactacgaatcatatgccacttccagttttagatttttgtttttttgggatagatgaagtaggttcttatgttttgggataaatagagtagctagtatctttcttttcttttttttctttgtttctgttgttgcaacaatattactgttagttgacttaattggcattttggcaatatgcaacgttgccctgcgctagagtgaagctcaaatagagaaaatttaccttgttttttcacgtacatatatacttttcgaacggttaaataatgtattttgttaattcattttttaagtttaaaataatttatatttaattgattatacgttaatggtttacgtatcttcttcttcctctcttttcactatcaaccaaaacacgcttgagaatgtatagtcactggtattaggttcgaagatgagaagagtagtaggcaagtagctcgagatagtttagctctctggtgtctaatccaggccttttggatcatggcccgtccacgtgggctggggtcggttaggcaagacgcggcccaaagtcgctacttgcgtgggccttgcggttgtgaatgtgcgtgatcgtgtgagctcaaagaccaacagtttccttatctatttcgctttaatttgaacagaatagcccccattttgtttttctcaactcaaaggcaggacgcaaaccgaatttgcgagatgctctactcttgctgcagtctgcactcgcgctagtttgttcatgatttctcgacacggaaatatgaataaaccctaaaccctataccctaaaccctataatcccagcgtagcattcaagacaattgttccttcttctcgtgacaagaagcaagctaggtacgctcgctagctgaaaaggcagccttagctagctggactacgtctctctcagagcaagtttaattaatagtatttggcttcaatttatctgcagtcaatctaataacttatttatacaatagttacatataataggcaaacttttatatatatattctgagcgacttaaaattaaataaaaacaacattgaaaaaataaaaattaacttttaaaatttaaatttagtaacagcttataattcgtaactcatagcgcaagggatgagaccttaaggagccctttgctagcgattcaacctgtaacaccagccttattttgcttcgtcagtattaaggccatagacattgagtcattgacgcgacatcctctttgcaatgcgattattccttttccacatgaatagtacttctccctctatttcatattatataacactttgatttttttttaggtttctttaagttagatcaattgttctttaaaaaacagcaatatttacaacaccaagttaattttattaaacatagcattgaatatattttgatatgtttgttttgttttgaaaatatcattacttttatataaacttgatcgaacttaaaaaatttgatcaaagtgtattataatatgaaatgacgggagtttcttttttggttaaaatagtactacctcattttttatatacgatgtcatttttcacataacgttcgatcattcgtcttattcaaaaatatattgtaaatatgtaaaaaaaatataagttaaggctggagttttttttataataatacaagttgtcagggttatggataccatatacctaatagtagttgactaaatctcggcaggacccaccacataccatatcctatacggaaacaacctgcgaatatagaaggagttccggataagggaagacaatcagagttctacatggaaacgacaagtactactcagattgtatccatattggtttccctaattctacttggacaggggatacctatgggtataaatacaatgccccctaggaggagaggggacacaaccacctcaatcgacaccacaatcaacagacacgggcaacatagacaccacaaagccaatacaagccaacatacgccaagacaagacgccggatatcggcttcagggataagcacggctagtcccctacggtgtctccggatactgtcaagagaaacgaaagcgctatctctgatctcgccgggcacagattcgaggaggaagactaccctgttgtcgactacgagtcagaccttcagaccgccatgtcgacaacagttagataggctaccccaaatattgtactggtatgattatggtgaataagatcaataccggcttcggccaacaggatgtagggctattagctgacaattcaggggcccgaacctgtataaaaatcctcgtctctatctcttttacctcagtctcgcgtataccctagtaccaacgatccccataccatgcaaataccggaatcgcgacatcaaacttcgacacaagtcacaataaaaacaaatagcatttttataattttcttaataagataaatagtcaaatatcatcataaaaattagcgacgatatatatttaaaaacggaagtggtacaccatgggctacggccctattcttttctccaacaaaagttggataaacttttagataaaagtgacatgcttttcaaactgctaaacggtgcattttgtgcgaaaactttctatataaaagttgttctaaagtatcagattaatacaaatttcaagtttgtaataattaaaactcaattaatcacacgtaattaccacctcgttttgcatgaaacactttatcttcatattcatcttcaggagattcaaacaccatctaatagtagctccggggagaagtggcggaaacaaaactaaaatgatcagcttcaatttgaatctgtagttcgacgagtttcaaaagatttaactcattaaagtgcgtcacaatctactactactctgtcaaaaaaaaagccaaccctagcaatgaacatgtgtctaggttcgttggtaggattgggttttttataggatagaggggataggtctgtacatttggtcggataatcggatcacacaatgcaccgatcgagggggggataaggcctggtttagttccccaatttttttttctaaaaaaacagcacatcgaatctctagacatatgcatggagcattaaatataaattaaaaaaactaattgcacaattagtagagaaatcgcgagacgaatcttttgagcctaattattccatgattagccataagtgctacagtaacccacatatgctaacgacagattaattagactaaaagatttatcttgtggtttccagagttataaaattagtttttctattcgtatgaaaaacctttccgacattcggttaaatatctaattacatttagcgaaataaacaggccataagtttgaagttgtgtgcacaaaaatgtccggattctccacgcggacgcagagacatttggacacaccgtacgtacccgtgtggtgggcccatgccacgtcggccattttgggatactagtaggccggatactctacaaatcaaaaatgacgcagagattccgaattcaagcagatcgtggggcccggtccagcagaaaagctggccgtccgccgcagcggtagggtagtgcccgccacgttgattccggggccctttttgacatcacccgctactctcctcccggtcctcctttctttgctagatgcacccataatgttacccccaacagtttatagggtcaattaattagcacgcacccataaatccatctactatcattataattatatttccttctttatcactttatacacccaaaataacgggtcaggattaagtttcacagatcaagattgatataacctgtcattacacagcgagagagagaaaggtggaaaggagcatccgacactatagtggagatggctattcacggtgcaatataattgtttgtggaaataggctatcatatagcacgaggatgtgagaattgacataacacggtcatattcgcacaatcatgcactactgtagtagactgcaaacaatgatcgtctcatactccttagcacaccacttatattatatcgagtttggcaagtttatttgagttagattaataatgctgcatccgatagtgtgggttggcttagctagttagtgcacggaaatcaaaacacatgattagcgaatgattatttaaatattaactatcataaacttcacagattatattcatttgatttgtaggaaatatctatattttttttaaaacatatcgtttaacagttcgagaaatgtactcactataaatgagaaagtagatcagctcattagagcaagtttaacagtatagcctactactagctccaaatcatttatagctaatgtaataaccaattcatacaatagttgcttactataccattaatacctggtcccacctgtcatacacacattatatcttgaagtccatactacagctggctacaaatttgtagtccgctgctcttctctctcttttttatctttttaaaatatgtttatagctggcttgtagcctgctattgtacctgctcttagctgataagaacccaaccttagactcatattggtgtagccataatggtggctgttgttttttaatgcaattttcacgccccgagaactattagggtaaaacaggattatcttttgtcactgaacaattttgatggtataacctcaaacaagtttttttgttctaaagagagaagttcattgtgacaatctagtattctactataatcgatagcaaagtttaaataaatactcctccatatctaaaagattgtctttttattgtgaatctagagtcctcaatagtgatgtccaggtttatagctaaaaagctatccaaattcatagccaaaatgatactatcttcgtcccaaaataagtttacttttgacacaacccacacataccaaacaaaaccagaaagacaagaatatccatactatcaaatctcaatacaagtattccttactttatcttcttccaatacatcaattttgtactttcacaaactttgatgcaatgatagctttaaaaatgaacttattttggtacaaatggaagaaactaaaaatatgggacggaggaagtactcatttaggagtaacattcaagttcatagcttttttttttgagacggagctagttgtactcaatatagagaaaatatatttgattttgagaaaatgtctttcaacgttaaacaaatttgagataagggagcatgtggaaaacccaaatcgtcactaacatgatcttaaccaactttataacctcaaacaagttcttttttttaaaaaaaaaggaaaaaacattgtaacaatatactagcattctactataattgatagcatagtttaaaaaggtactccctccgccctaaaagaatgttttttttactatgaatagtgtctaggttcaaacaagatataattaggtatctaggttca

SEQ ID NO: 43853 - DNA, 9581 bp, Oryza sativa
aaatacattcttttggggatggatagtgttatactcactatagagaaaaatagtcgacgtcgagaaaattgaactcggataattaacctcaaataaatttgacagaagggagtacctgaaaaaaaaacccaaatcagctccgctcggcgtcagctgatttggaggaaaattttacctcaaccttcctaaagtactaaaatgttgctccttttttttaaaaaaaagaaaaatcacttaaaaaatcaaatcaaatcattttttaatttaaaataattaataattaattaatcaggggtttatctttttttccctccttccaaacacactcgagtaccccaagcatttccccattccaaccctgggtacccagtaggacatgcgtattgcggtccactcctccgcaaaaagggcccccccccgtccacccccatgggtttccccggtccaatccaaatccaacgtcccagattcccccatttgccctaaacccccacccccaatataaaacccccatccccttccaccccgttccaggtttcctcaattcagatttcccccatttcaattccctcctcctccaatttcccccccgcattaaacaagaaaacggcaatggcggaggaacaacccgggccggcggcgaaaggcggcggcaaaaccttaatggaaaaatttcccgacaaggttcccattggtggggacgggtcgtcgtccgactccgacgctgacgagcgcaagcagccgaagccctcggcgccgccggccccggccgaggtcgcaacggagtcgtttgttgattcggctgctgctgccgcggccgaggccaaggccaaggtgttccgcctcttcgggcgcgaggagcccatccacaaggtcctcggtggaggcaaacgtatggctgctctctctctgctgatgatctctctctctctctgtttcaaagctgatttggtttgaatttgttagagcgggtggggatgggctggatctggattgattgggagtgttgggtttcgggctagatctggtagattagcacttggccaatgggagtagggttttagccttttgctatgtgtgaccatctattcagatctgtgggtatttggggatgagtttagatatctttgacaaatcggaacaactaatgtgatcctcgctgtgctagttaattcaaatttcggcaatgcaggttgcgtgcgtctcgtatactcgtatacaatctgatctatgtgatttcattttatccgtatctttttgagtaagtagtggacatgtttagctttgatgaatcataagcgattgtggcaaagagaaaaagatatgcttgtatgtgtcaggatccatgtgaagcggggttttgattgacatgtaaaaagtaatggaataattgaattcatgatttccttggttggtctgtcacattattgtctgctggtgtgctagtactggtccctttagagtgacaatgagcaagaattgaactgtttgtaaacagtatgtgtttgaaggttagtgattagcaatagtgtactccgcctcgtcacacagttaagccgtagctaacacaatcatattgaatgaggatgtacctcattctggtgaatccttatcaatagctacaaaggattactataagccacatatgctgttgattattgctatatttgtctgggattgttagtcttctgctgtcctgccttcaaaacaaacacctttgctctctccataggggtggtcatattttgtggttgaggtgaaatttccattatgtgctcatgttatatagcctgattatccattgttcatcctgccatattgatttcagttctctatttgcagccgctgatgtgttcctatggaggaacaggaacatctctgccggtgtactaggcggtgccactgcgatctggatcctttttgaattgcttggctaccacctcctgactttcgtttgccatgggctcatattctctttgggtcttctctttctctggtctaatgcctcatcatttattaacaagtaagattgtttttcatctctatcacaacttgttcaagttttggcaaagcataatcatgttccacaggtagataattacataaaaggtctctaaactgtgccctttctttcaggtctcccccgcggatcccagaggtgattattccagaagatttggttgtcaacattgctctatctacacgttatgagatcaacagggcctttgccaatcttcgtcagattgctcttggccgggacatcaagaagttccttattgtatgtctgtgatgcttttgtgtttgtataattattgttcccatagcaaactgaatatttatgatctataccacacttttaggtgattgctggcctttggttgctttctgttcttggaagctgctgcaacttcttgaccttggtttatattggtaagtggtttgggctactttggacagaattattctttattacctcttcaaactatagatttgactaatgttagatcttttgcttcttatgccaaacagtgtttgtggtgctgcacacagtcccaattctgtatgagaagtatgaagatcagattgactcatatggtgagaaggggtgggttgagattaagaaacagtatgctgtgctcgatgctaaggtcctgagtaaagtaccaaggggccccttgaaagacaagaagcactaggaagaggtgatgcagtgcctcgtggcaggtgatagtagtggttgggttgtggttcttgagatgcactgctgtcacctattgccttgtgttgtgtatggctcttttgttgtctgatcttgatgggagtagctgagtagcttgcgctacgacagtatgcagctgcagcgcatgctttgctccatcgctgtttgatttttgatctgtaagatgtcgcatgcatattgtttatgcgatattgttttgttactaagattgctgcattttggaatttggtgatatttatgaaccaatgttgagactagatgtcatctacccgtcatttttgttgttgacgttggtgaaaaatcttgttatgattgcgctattaaagattcagcctgcgatgtgcacatttattttttcagtttgaagatgcacataatcttggacatataccgaaattttgaagctattccaaactttggctttaggacttggaaaaatttgtggtgttgcgtcactcgacgagtcatttggggaatgcagcatcattttctatccataatgaagttttaatattgaaacatcatctgatgctgctttgtaaaggcttataaggaaccaaacttggtcccttcgactccttgagtccttgatccttgaaagcaaaggtaacacttgggcttctgatgttcacttttgctcttcttccaggctaatctatgagctgccacagctttctcacatgccaatgtgttgagtaaccatggtctcatcatgggcagcactaccggtctacctttgcttttttgcttcctcataagccatttgattgcattaaactctcaatctggctaatataacaagctacactttcgctctcaaaagatgattcttccgcgtcatggttcgtgcgatgcgcttagattcttgctgcagcagtgcagctagccggcatcgctggaactcgtggcgtaatggcatgtttggctggtgccagccacactttgtcatgccatactttcttatttttggttattttggcacggaggagtatgcaaaaagagcacagggatggaaataaaaaaagagacaaaagaaaacaaacgtccgctccggattcattattctgaagcacaacaaccggaggcaggcaaaacatagtccctgtgtatggaagttctctatcaagttttacaacaaaaaaaaaccggtttcataaccaggctcctttggtcccaaacattcttaactggtggaacttaaaacactggactattttcacatggttgttttccgtctattctagttttcaaattatgttcatacactctggatatttagatagttcagagaaagtatgtcaactgttgtttctttctggagcctccttcaccgtacaactcattccattgcttcagctcacccattattgttccttcagcagcaaagcttgccgccacctgcatttcaaagtttccacaaattgttaacaagcaagtataatgctaacagtttttcagttttatattagcaagaattacgttctgtgcatgtttcagaattctaaattcaactgtaacaaaagattcacctggttttttgcttctttcaaatctttcatgtttagtggccttagtatgatcgtctcgtccttctctttcatcttcgaagcatctgaagcattgcctccttgttcccgcttcttctcctgaagatattaggcatatatattttacttttagtataaaatttcacaaaattgtctccagtgaatgcttaagtatcgcagtgactagattaccagttccttctttctttccttttggatcagttccctcactggacgatacgctgctgttgtgcacaggttctgtcacacagcagactactgagttaaccaaagagttctttgggttgacatagattcatgtcttatgatactgacctttagatcactgccactatatccttcagtcatggtggctagttccttatagtctagaccgccatcaactttctccttcgacagaaggctcctcaaaatcaattcccgactttccaatgatggcaggccgaccatgatcctaaagaagcaaggcaatacactcaggcatggaacttggaacaatcgaaaggggctaaaaaaaagtttagatacagatgagagaactagcatctagcaaggaagagatgcaaacctgcgctcaaaccttcgaatgatagcttcatcaagatcaaagggtcggttggtcgcagcaaggacaagaattttttgatctggtcttgacaagaggccatcccagtgtgtcatgaactcattttttatcttcctcattgcctcgtgctctccagctctgttccgctgaccaagcatgctgtcgacctcatcgacaaaaatgatcgtcggtgatactttggcagctaatgtgaacaatgctctaacattcttttcatcttcaccaaaccatttcgatgtgatagtcgacattgaaacatttatgaaactcgcttgagcttcatttgcaatagccttggctagcatcgtcttgccagttccaggaggaccaaaaagtaatatacctctgcaaggtttaagaagaccccctttgaagagatctggtcttctgagagggagcatgacaagttcttgaagggattctttgatatcacttaatgcaccgatatcatcaaatgtgacaccgatttcattagcaggtatcacttcaggtctgatgcgcttttcaaactcattgtctggcggcatttcctgaatacacgaaaaggatgcaattacacattatcaaaattagattcatggggcttgtgaaagtaacataaaacgacacaagatattttttaagaactacgtatgatatatcaaagtcataaaaaaacctttcaataattgatttcaaggaactacgctttactctgcacagcattcaacagaacgacacttccataataaccaacggttctgtaatagttttgctggtgcacgtgtgcttttagacttttaattaatgctcttacaggtgcttttgcagctggagatggattatccttcttctcgaatttctctggttctgctttgctctcaacaggaggggcagcagcagctgtaggaggtactggtggtagcaaagttgcaggttttgtttctgattttgcagcaaatggagcaattcccctgtcagccacctgtatgtgaggcataatacatgaataacggttcgttaaaaaaaaacatgaataactacaaatcaacagaatattcggaatttcctgaagcgtatgaagttaatccaaaagcagtagaaataaaacaaacctttgaagcatcacgctttgcttccaacttcatgctatccttatcatacatcttgttctcttgaaaaatttccagtgcatgggacaagctgtgtcatgagagagtcataaagcggagaagagatgaagaaaccaacagacaactatacaaaaatgctaagtacctctttgcagatagaagtaattttccgtttcggtactccggatctttcttattcatcaggtgataagaaactgctgaaaccacaatctcctcaatgtacctacctagaaccatagtatcagataggcatatcgagcctaaatcatcacactcaaggtcgttttcggcaaggacttccgtaatatggttccggttatcctggaactgaatcatcttcatatcttcttctaattgggagttccagctcacaaggtggttctcattttctggtggcttgatttcgatgttgtatggaaataaagcagttagtctttcatccaactcttcatcaaagtccatatccacaattcttgagccaaggactagcactggcccttcaagtttattcagtagtttttcaaacatgacatacatttttttggacttgtgaagaaacttctcaacatctcttatgtagagaacaattgggttcttcttagatactgaatgcagtaccttgtatactgcttgcaccaaaatcttctcatcaaaagtccagctgctagcacgtctgagagaagctgcagtgtttaaccaaatacaacatgactcatgagaaacagatataggtgcaaaataccagaagcctcaggacaaattttgtgtgcaagagattttaatatgacctggattatttggagggccttgtgatgccagactactcatatcagatgaagttgaggcattccttttaagcttcgggaagctgctcgtactttcagagctcctgcaaaatacataaagaaagcatatcaacagcagccaatgatttgcagtttctgtaacaggttcacagaagcacaattttccagtaccttaatttcatgtccgtcatgctgctttgtctacgaatagttcctgtgataaaaaataaaccaaactaagataacaaatatacagctgcaaaacttcctgaggtagaatgaaatacataattcagttattctctatggtcattcagctgcaaaacttctgaggtagaacgaaatacaattaagttatgctctacattctgcaaatgcaagcaaattcaattttttttaaggtaagcactattacattcgttcacagcatcagaatttcagaccaaattgaggctaaattatgtgaagtcaagaacagttgttttgcgctttgctggcagtaagtgtacttattcattctctcagttcagcaggaattgtagttttctgaaactctgtttgaataccgatgccattcatccatataaataacagcatatacagatggaatcgctagacatttttgtttcagataactgagaatgacagcaacatggttgtattcaagatctcaactgtggtgtgcaaaagtgtgaatttcacatgaaaatacatgttccatctagtttgttctaatagaaatgaaaccagaaaagttcatgtcgtctgctaatgactgagcagagttgcaaaaattccatgcaagaactgaagcagactactgacaagcaaacataattattctgccctacttcagaataaggaacagttgaacatttcttattgtgaagtcgatcatgtcacctttgggtttctccttttgtggtagaatcgaaagagatccaagtaatccagacaccttttcaagggtcgtctcagatatggatcttttgaaagactgataaggagaaagtgctcacaagttaatagttaatttaaactggccactacttgggcagttgataaaaattctaaatttcgcaacaatgtagggaaaaaaaagcactacaatgtcaagaataagcaaaacaggacacacacatttatattctccaaggttcggaaatcagaagaatggtgaccttacaacaaatacgacaaagcgtgttgagttcttaccgagtctgtgctgctaccaccaccatatttgctatggatctgtgaggaagaaaagtctgtatcacaaacatacttaaaaatgtacatgaaaggaaatctgtgccagccaaactcacctttatgagaaaatctgtaggatctagcaacagcaattttgcttcaaaatagtgggcaagcgctttggcaagcatttgctggtaaagttcttcaagataggaacttaattagccttaacttagtcagggccagaagaagagtgattcagcaactccttaacctgtgcaatggaatatgatttacctgcagggcctgacaatagaatcgcacggctagctggtgcaagattcctggtgtattgtgagatgtctgcttgcttcaagtgaacatacgccgcgcttgtcagcaatacacgcgtttgctcgctgcaaatcatagtttggggaaaaagagaaacaaaggatgatgacatggagggtggaaaaggaaatgaacgtgtacattaaaaaagagaacagagctagaaatctatcgttcatctagcatcttccttgtcctgctgggtgatcattaaaattgaattccagctaatattttgatcttgaaagtgaacaaacagacgtttgacgtctcatcgatgttgttctgtatgtgttctatcgtcccctcattttttttctttaaccaattctaccagcactacctttcaaggctgccatttttcaatcacaaagaggaacatttcagaaaagcagggttgtctctcttcgcctcccacgcaaaattatgaacaagctaatctacagaaatatagcagtgccactgtcttcaatcagagcgttcattttgtgatctccgagccaaaagattgttgaaacctttcaaaacatttctctctctctctctctctctttttctaatttgccaaactacacagttcatctgtaaatctgttgcttgcatatcacagactcagaattatttgtgcatgataagatcataagaacggagggaaaaacatatcccctatacaggacagaacaaaggggaaaaaatcctaaaaaaaaaaatctgacgatgcaaggtgacggaacagttgcatagctcgatgaacgggaggaaaaaaaagacgttgttgatgttaatcacctgaggtagtaggggaacccgtcgaaggtgaccctgctgtcggcgccgtcgacgacgaggcggcggagctcctgctccaccctctccaccgtaaccccgaccctcgccccctgcccgccgccgcctgcccacggcgcggacgccagccccagccccaccccgacgcctatcccgatccccaccgccgacatcaccacgtgcttcccctccatcccctccccgccgccggcgttcgtcctcctagcaaggtggtgagacgcacggagcgcagcgatcgatcggtggcgcggcgcggcgagcggaggaggagggttaatgcgggggaggggtggaggtggcggaatgggtggctcggcgagaatg

SEQ ID NO: 43854 - DNA, 17856 bp, Oryza sativa
tttcacggggagaggtggcgcactgtggcgctgtccaaaccggggggaggttttgcgtatggggccacaagtttctctgtaattgcgtgatggttccttcccctgttttctgtctctcacatggatgttgggatattcccagagccgatacaatagtagactacaagccagctataaacatattttaaagagataaagtaaaagagaagagcagcgggctataaatttatagccagctgtagcacggactccaagacgtaatatgtgtatgacaggtgggaccatatattaatagtatagtaagcaactatggtatgaattggttactacattggctatagatgatttggagtcagtagtaggctatactattaaacttgctcttagggcctgtttggtaggctccaactcctaaatttagctccaggagttgggtctggagtggagttgtggagctgcctaaacccagctccacctctctagttcattttggtgagagagctccacctagctccattcacatttatagtagaactgaaactgtttggttgagctctagctccaggagatgccctggattcttatattgtgagttagagaatttattttgaaacagagaggatactgaattcgatacatcatattattgtaaagtaaaggaaaaatttagaaaataccatcgtatgtgagaatgacatatggggccgaacccacatgtcaatgacacatactatagtatttttcaactccgtgatttttgtgatggtactagacaaattaggcctattgtaaatctggatatatctatgtttgaatttatactccctccatactcataaaggaagtcgtctaggataatgtttaagtcaaaccttggtaatataaatcatgaataactctcaagttattgagtttgaaaatataaaaattatatatatatagatttgtcttgaaaaatactttcataaaagtatacatatatcacttttcaataaatatttttttatagaaataagaagtcaaagttgtgttttggagactgtgtcgctgtcctaaacgacttcctttacgagtatggagggattattttaatgagataaaagatgagaaagaagagcagcgagctacagatttgtagctagctgtagcatggactctaagacacaatatatgtatgataggtgggaccgtatactaatagcatagtaagcaactattgtataaattagctattagattgactatagataaattggagctaacagtgtgctatattattaaccttcctctcctgcggtggaatcaccaatccccggattttaccggccggggcgacctgaacatggccatgcccatacccatgccccatgcagatgcaccgatatgatccaacgcacctccgcttgagatatgatcaaactgttttgaatcattggcatcccccaacttgctgtactacttaccgccccgcccggtgtccccgtgcaacgcatctcgccgcaaaaatctacaccggttcctgtacagttcttagcctggactgcaacttagacagtcatattatggctatccattaattattataacaaaacagcacaaaattattataacaatgttactgtagcattaatttagaccttccattgaaaaattgaatgaacaagatcttgtgtaagctcctaacgagagcccgatcccaatgtcgcgttagggcacccgcaatagttatttataggctctctacaagaaatccatgtcagcatattttcctacttggaagagattaaatgaagagggagaggaaagctatctactaacctggagatagtctatagagaaaaacgaggcaatagattagagagctatagatacccatgtagacataccattgaagtggtttactattaatctagtctattgctgagatgtacatgttttatagatagcaccttactttaccattgtgggtgctcttaggagcagctgtagttgagaatgcacctgatcccaatgtcgcgcgctccatgcgctgggcgcacgggttaactgccgttgggttgcacagagacagaggccgcggacttcagctgcgggtgaagccgccacccggcacgtcgggtcgggactccgggagcgagtacgcgctctctcaggtgtcttcggtggtcgcatcgaaagccctgtttagtttcaaagttttttcctaaatttttaactttccatccatcaaatctttcatacacaacttttcagcacatcattccaatttcaatcatatttccaaactttcaaatatcagtgtaaactaaacacaaacataaagtggattttttctttcatctctctcgtttgccacacgtcctctctcgccggagcacgcggtgacgagactcatcgctggataaaatgcccaaagcctcagatgcagaattgagaaagaagaagaacgctctagtaaccgccagtccttcattagttcatgtgcttcaaaaccaagctataaaagataaatatttttttctgtgctttggacgatgacaacctagcgcgacgtggcagcgcgccactggctcggagaggatacgtggcacgcatgcacacgcctcgggacgcgagcgagacgcagaaagaaaaatatctctcacccggcggcacgcgtcctcgcggcacgggccttcttcttgcggcccaccaaggggaggaggcgaaacgtacgtgggccactgggccgtgcgtttcgtttcctggactccaccgagcgagcccgcggcttcctcctcctcctcccctctccctccgctccggcggagcgccgcgaaacgcccgccgcaaccgagcccaccgtcgaggcgatcggcggcggaggcgagggccgccgccttccgtcgcaggggtcaccttcttcgtcctcccccggtctccccctggtaagactcgatttcccctgagcctgattccgcccgttcctcgcctcaactgcagcgtggtgaactgacctaagggaggggattttgagggaagctgcccgccatgttccgaccaccgggtgctttcggggtcgcacccccgccgccgccgccgcagcagcagcagcatcagccatggcagtggcagccgcctttccagccgccggccgctacatccttttggcagcgggacaatgtgcgggagcatgtggggaggctgcaggaaaccatcgaattagccactgcagtgtgagttcctgaaccgcctaaagctagcgataatcatgcaactttgtctcaaaaccgaaggcatttcctttattgctaatttattagaccttttttttttgtggactgaaaatggaattgaattggcaggataaatgagctcgaggaaattgcgcaggctagaaactcggtcgatgctagcacgcaaggacctgactcgtcttcagcaaaattgtcatcagagcctgatggttcttctgcagataggccccggcatttcgttgagcttgctagagctatgaagattagtcaagacactcatgagtctctggccacagatgctgctaattatctttgttctcagattcagaaccttcttgcacctatttatcctgctgtgaaccaagggggtccttgggaagagaggtatgcaatgattaggttagctcagaagctgcagaaatccaagagaaataagcgatggagaaagagaaaaagaaagcatgttgcagagcttttccagaaggtgcgctcatcaatacgtttttctgtttatattgtgatcaaatcaaagtgacaactgaccataatgacatcaattgtcttgatgtttcacaggagcatgcagattatgacagaattgatcaggaagctgatgaatggagggctaggcaaatagccaaggacatggcgcagcgcaaggttctttctcatttttgaatttgtcattttgttagtggggttgttttgggtaagatacactgttgctccacagatgatcaattcattgatactgtgaaatcaggtggaaaacatgaagcagattgccaagaaaaaagcaaatgaggaaagaaagcgtctagaatctgaggtaaagttaatgcttacattgtggtgtggaaatcctgcttgtctgtggacatctgcgtggaaattgtgagcgctatgtttcattaattcattttcatacactgctgaattactatacattgtgataccttgagttatgaattttgttaagttgtagtaagcattaagttacaccattttttatctttgaccttatctgattttctacgaatttaggaaactctataagcttgcttctaaaatttcttaaagtcttgtatatttgtgtttgatatgctgcaacccaacatcttcaattacaccacctacctacctgttttctttcattcagaattattgtgcaatcagtttgtgaattcttgagtggttatttcagtatgttatatttagattccaaactattaatattctctgtagaaattgtaaattcaagagcggcaaatacaatagtcttgttttctagaaaactaattttctcaatacaaatcttctattttcagcttgagcttgccctaatggtcgagaaactacaggagcttcgctctatgagagttcaaaaaatgaagaaacaaggcaggatatattcatctacccattatttttaagaatttccttctttttatttatttcaatatatgagtccgtcaaacctatagtcataatctaaagaggtgcaaaatgtgggaaatggttaatacatgggggtcaatcttactgtaatgggtcaatcacattgtaatgcttcaagaatttgtcccttgtttaaatgattgccaaattttggcattcccattcttctctgtcatatctaatgcatttcttgccaatctgttgtccaaatgggtggtgtctgaaaacttcacaaaaatatttgctataaaattatggtaggctcgcgcgaacacactaaggccctgtttgtttcagcttatgattattataatctagattattaagccagattactataagctggattataataagctggcatagaataagctgtgagttgtttgtttgtctggattattgaaggcatggattattgggtttgaaaggctaaagtctataatgccctcagctatctgttcggttgatggcataggtgagtaatttttctcaagtatgtaggggtagtgggtctttagccactcaataatctgaaaaaagctcctctagagcagcttatcagattataataatctggcttatagattataataatctgctataattatctacttgtttgtttcagcttactcctaataagctagattataataatcctaagctgaatcaaacagggcctaaaatcacctgcaaactttgccttttccttgttaatagttatttttttcccctgttttagtacagttgatcaacctaaacacatggaactgatgcatgagttaccatgtaatatatttcaggtcattttctgccagaagaagatgataaatatcttgagcgtgttaaggctgcagttgaggaagaggagcgccaagctgcaagtgctgctcggactgatgctgccaaggatgctattctgaccgcggaagagtcgaggaaggctgtgcagtgttcaaattcaagagaagatgattctgatcaagccaaaagtgcaccaacactggaacaaaaccagagagatccaggaataagcggcagaaatcatcatgcaagccaaaaaacagagcatgaacttcataaagatgacagcaaagggcatgggcattatgattctgtttccagtctgccttttgagttctaccattattatcatggaagcagctacgacatgggaacactcattgaggtaacttatgctggcttttcaacttcatgctaccattaaggttttgtggagtgtataagaataatacagtgtaaatttgaactaggctttgcactatcagtctatcacagccaaaattctgaactaggctttacatatcaatctatcagagtcatagatatggcatggcgggtttcacacttccattgaataccataattggctcatctgggagttttgcgaatgctttatgtgttaatcagttaatgtgatttctaccaagtgaatgttttaggatgatcctatcgatggtctcatatcaatgcaaatgtgcaattactcaatatgttttttgattgggaattactcaatagattcactcagccatcatgtatgtattccacctttgattgcaggtccgcaggatgtgggattcctttattagagctggaggaaggtatgactttcactctgctaaatataatatgcaaactaaattcgctcaacaagcatctttgccatacaacaaaaaacaatggaaatatattttgctgattctctgaagaactaataccaagatgagaaaaaaagaactcatgagaatatataatgttctattgatttgggttatatatgaggtttatgccataggaaagtgcaatctcttttagtaaacagaatgatggttgttggatacattcgaagtttgttgggctacttgtatagtactctggaacgctttcttgtaatttcagtactgggatagcattatagtgctgaatgtcctgtggttctttcaagccatctactaataacttatggtagcattcatgttattttattgaagtgctctgatgataggatttagtacattgtgctctcgattgtagtgctttaccatgtgaaacgaattctatgtagcattctcttatttaacaatgcaattgtctcacctgcctgcagccgaatacctgggcactgggttcagccaccccctccagctgatgaagtatgggcatcctatttagtgcagcccaactgtccaagtaactccacttagctgtaatgaatttaatcttcttctgcctaaccactggaagttttcaaggttatcacaaggcaagtaggtgtttgagttgctactttttccccttcatgtcaactattaatgcagaaatttgatttaatatgtagccaattgcattgatgaaaattaaattgactaagcaaagttcaattgcttgcactatgaaccctcagttaaacacttaattatcttatggtttcacatgagttatccaatataaggccctgtgagtttcttcaccagcataaacactaaaaaaaatattacgaagaaattgtgttccggtctatgctttttccaggatgtctttttgcacatccatgatacgctccacttatggtctgaaaattttaatcaattttgttgactgtggggcaagattgatactgtcagtgacccagtcctgaacttctgataagtgataaccacttctgcagtcttgagtcaccattgtagttcaaatgtgttgctttgtaagttctatgtaatcaagtactaaacattggaaacaccattaaacttctttgccttctctaaagagaacttattgtagttcatgccaaggaccaaattggatgtatacaattcagccttgcgaactcgttttatattcggaatcaagaaaaaatgaagaaaaatgctagaatgggcatcccttttctgataatggtatgcagacatggtggaggcttttctatgtgatgattactggccacaggtccttttctgatctgttgagtagttcatgacaactaccagatcgtgactcaaaatcaatgggattttacatattagatcaaccagtgttgttcctatccactgctctaattgttacgaatgcatggagacatcatgttatacttatgtacccatctgttcttatggtgttgaactgaacgtacaaaactattgtaggctgttgcttagactgtaagctatatattcaacaggctggtgatataccttgaataaatgttaggaatcgtttgcccccttcctaatgatattccatagtaacctgcatcatgaatcaccacctgagaaatgaatagcttagcatatgagctataatgtttcagcatttgatcaaactcccagttcagcccaagattatcttgaaatctaaaacactgttgtatgaaaattacatattcataacataaccttagtattaattatagttatagtgtttattcagttagtaccacaataccagttaaattttaccctatatatctctttaatatgaggttttcattgaatatttatctacgatgcaatcggtcctgagagcactttaaaaaaatatatatgttctactttgtttaaagtttctgagaagctttgtgtttgttggatcagataccctggtgaagatttaaaccgaggaatgttttggattcaattttctgagtaagataggactaagaagtggaccggcaaatctagacttggaactgtatctagcaatagtcaacagatacgagcaaataacttcataacatgatagcttagatgaatagcggatttgttctttagcttatcatttcaatacattttattcatactgagtgcttgaccatttctatctccatgcattacttttccagcagctgcattttgggactattggttaggacttcagcttttcccctatgatgagccatatagatggccccgagaaaaagatggccaacgaaaaaatcgtggacaccattaggagaaaacaagaggttagtgaattggatggcattagcacccagtactatatatctctataatagagtaataaggacacggcataatgcctgctgcctttcttgttgtgcttgcttgctcctcccattttcttatctctttgaggtgattagtgattacacagaccaacaactgaatcctaaagctcgtaatgacaaatttgatgatacttgcaattatggaaagatatcttattgctttcatgaaaaaataatgccgctttagtcattgaagaattattgggtgcacttggtttttgggcctaataggaaacgaagcattctattatgatgaaagaatgttgattcttcctggatttcgagaaaactgtgcttatcaagtaaccctctgactttgctgggacggtttcttttctgcatttgggcatgacgggttagaaagcaggtcaatgaagcaaagcaaaggtcgcatgccaaaaaacgtgctcctccctgcgggtgacaagaattttgaacatagacatgttctttaaaatgcggctgaccactaatttctgccaaaaagaaaaataaaaagcaatacaagtatagtattattaaagttattttcaaggcgattttaaacatacgattttcatacatccaacataagcatttaaaaagatatttatgctcaaggtttgtaaggtttaacttaaaacatgtccggaaaatgatatgttatcgcaacaaggtagtttcttagtttgtcgccagaaactcaatttacaaaaaaagaaagaaataaataaaattgatctctcacacaaggggcgctcgcactcaaaatttataaacaaatcaatatcccaagttttttccatctgaactctattattggtttaagctattttgaatgtaattcagattgctaaaggttaaaaacgacttaatcgtgctctctcttttttttttttcaaaaaagtaaccaagcttgactattccccttttgttttcaccttttagattgtactccctctgttttttaataaatgatgccgttgactttttctcatatgtttgaccattcgtcttattcaaaaattttatgcaaatgtataagatataaatcacacttaaaatactatgagtgataaaacaattcataacaaaataaattataattacgtaaatttttttgaataagacgaatgatcaaacatatgagaaaaagttaacggcgtcatctattaaaaaacggagatagtaataatttatacagaatttgtcctttcgtttaaattaaagcgtggcacctttggctcttttgcgcttttcttcccctcatctttcttgcaaaaatgaccttgattttgacatccccttttccacatagtctggtgtgacactctccttagctaggctgtatgtatacctgcctggtcatgcactcatgtcaagtgctaatgatgctttaaagaaaaacctaggatatgtttatttcgcaaccttactttactatgtctaaccaccttagacatgccgcaataatcagtcaggtttgtattaatcgcaggagtcatggcaagcatatgtatatagcttctctgggtatatgtcaggttctgttttaccttgttttaaattttgttttacttgtggctaacaaatttgttggtcgtaatgtatttaatctataatattattaaaataattttgaaatgagatatcacgttcgctgtggatgctattctcacgttaatcgaagaaaaagagaaagagagctcatgtaggaatacagtttagaaataactaaaattctaaattaaaaataaacaatattgaaaaaagagtccatataaaaacaaaaacaagagttcatatcgaacaaacaaataaagaaataggtgatagaaataaggggtaataactggtgtgacttttaaaaactataaaagtagaatcatggagatgataagttttggtttcaaagtattacgacaacgagatagttgtttagtaaattttaagtaaaaatcatattaaaaatatataattttgtacgtatgctaaccgtgtaattgagcggaccacctgttagttttggtaaagatcatattggcaacttgcaatttacgaaaacatattaattcagttaagcatgtgcacactggggttatttttacaacgaaaccgagtggaaggtggataactggatatttacaacaaaataacttatgaggtgaaatattaaacttcaaataacttttagaaatggtttttgtaattttccctactactactagactggagagggtagttcgttactgtaaggatgttactccgcataactggagaatggagaccagaggtggtgtaaacttccgtatataaattggacgtgcgaggctgagagagagacgcacacatgacacaccggcggacaaggcgagcgaagctgcgaaagagctgcctctgcaacccacgtcaagagctccccacatcacaatgtgtgctgtgtatgcctgatctgtcaaaactctcgaggtcagttcacttggtgtctctagaatctccaaaaatctttcgttttctacacgtgcttcctccgtaaaacaaacaaacctcaaactgaatgtcctactacaataaatttggacttttgacagattttaagttaattttttacggagaaaccgagagagtacactactaagagcaggtataatagtaaactgtaagccagctatacacatattttaaaaagataaaagagaagagataagagtagcgggctacatatttgtagccagctataggacggactccaagatacgtatgtgtatgacaggtggtaccaaacattaatgatgtagtacatgtttataggtaactattgtatgaattggctattaaattgactatatatgatttggagccgatagttggctatattaaacttgctctaacactgagtgataagttctactacctccgttccaaaatacttgtctctttaagattttaattttgtccccaaatacttatcactatggagtacttgttgtcctatcaatcactttctattcaaaagttttcctattttaccctcaataaccattccacttctcatcatacattatttaataaggggtattataaacttttatattaaactttaatctattctagacaatctagaatcataactattgtgggacggaggaagtagtacgaagtaggagcatcagaactattgttcctaactgcacgaatcacgatgcatcggtaattctatttgcgcccagagtcactcaccgcaggtcatcacggcttggaccccacatgtcatgctaacgcagcctctcacgtacccggggtgtgggggcccacatggaccagccccgagagaaggctcccggctaagctgagccgttgattcctcgcgctgggatcccagatcgacggccacgattaccacgaaggacaccccccccccccccccaacacctcgagtccgacactccagccccacaagcagccacacagagagaagaacacccgccaccttcgcggccacccaccaccgatcgccgccgctccggcggctcccagctcgcgcgccgcgcccccacgaccaccgccgcctccacctcgccggccgccgccgacatgaccggactcctcctgcattcttcccttcccccacgtgcatcccgcccgggtaatcatccttccaccatgccgatggaaaatgcttttctttctctctcttttttttggtgagatcgattttgctgaacctgaaaaatttccagcctcacgcggaccgcatagcccacacgccttcgttttcctctcgacacgcttctcggccatcacgatgccctgccagttagggatgctcttgttttcgctcgctccagaattcttctctgaaagcgacgagaggccatgtctctggcgtggtttactttcagacctcgatggcctgctgttcttgagttcggtaggaggggtagtgagacgctgtcagtgatgggagggaaaaccttgagctcgatcgcgttgtctgccagatcgtgcaggcagttcgttttcagttcagaaagcttgctgttggcctagttcatttgtaggtgtcgctgatcatagaaagatacgcgtttacatgcaagaatggggcagggtagaggaaattcggagaggattttcggtttctgttccatcttggttgatggtgattgctgaaagagttatataacagcacaataacaggtgtccttatgcatgcatccgttcatgaaatttggtaatgatttagtatgatattatgaccagataaatttatcatataaagatcatatgccaagattaaaacttaggtgcctatctgaagaagatacattacaaaaaaaaaacctttagaactgcttccttttgtccctgatgggtgagaatcctctactataatattactatcattacagttactgttatgtttgtcccaccctctattgtcccacacgtcagtgcctgtaatggtagtgccatattgccagtatggtagaggatgtgaaccccatatatgaccggcggggtatgcagttattaaccggagaagtagtagcataactgcataaccaagttttcacaccatacttttcacatacttttttcttgtttgtagagatgcgtccaaataagaggacagtgtatgtatgataagcgaatcgagcacattctgtcgtgtcatcgacgactcccaaaaacactatgatttagtggtcaatttcatgctgttgagatttttactgagaccggccgaagattagcagtcagacagagaactggtagaaacattcagagctttcctgcactgcatgcgtgccctgccctgccctgcctgatgggcagcatttcatcttgcctataccgagcctgtttttgcagtagatgccatcatcgatgtatctgacttactgttatcttacccagatttgctcacactcttcacaaccatgagctgatgagtgatgagactagactactagagtctagagaccaatgttggttgccaattgcgagggttaccagccatccaggacagattctgccatttatgtctctggaattccctgcctaacattgctaaacctgcagccagaagcccagaaccaaaacttgagtgccacaagtgccaaggtttgctttgatgtcctgcacgaacgccacacatttgtacggcccagaatgcatctgcatttgattgcaatctctgcctaatcaagctgccccgtgagttatacgactgttgctggtttgaagttgcattcaatgctgccgtataaatgcactcactgatcaagctagtagcagaaaacattggcgagacttgtgtagagttcagataagcggacagaatcttcttctgattctgataagacaagcagaaagttcgaagcttggtttggtctcacggtgaactcaatgtcgttgcctaagccgcattgcaaagtgtgccctcgtaagacacatctcatggctgaaatatcattagttgtatctgttcttggacactaaaacaatgtgatctcaactatccattcttgattcttcttcttcttatgatgatgatggtttacatgtgttgcaggtttcccgaggttgatggaagctgacgaatccggtgtaccgccgcggccggtcgccggagatgttcacatcccggcgagccgctctgccaaggagccaatcttcatggtaagtttcgggccgtcttcatggttaacgcagatcacctgatcggagcacgagtatgaacagtcgcgtgccggtgtaggagcggcacggcggcgacctgctcaccgccatggcgtcctccccggacaccacgctggcgttccacgcggctcgcccggtgtccatcagcctgccggcgtcgccgaccgggttcgacgtcgccaggtccggggtggagctccagcgtcacgccatgacggacgccccgtgcatgctgccgctgcccgggtggccggcgatgatggccgtcgcgcagcccgacaggatgatcttccgctcacagccgatcgccgtcctcggcggcgcggccgctctgccccagcagagcagaagctcccaggtgcacgacggcacgagccgcgatggcgcgccgcgcgcggcggcggcggcggcgacgacgacgggcaaggcgcgcgggcgcagggacacgagctacgactcgttcaagacgtggtcagggaagctggagaagcagatcaccacccacctgagaggcggccggcaacagcagcagcagcaacagccagagcagcggcggcaggatgaggaacccgaggacgacgacgcggcggcggcggcggcggcggcggcgacgacggcgagcagcagccggtcgtactcgtcgatgccgagagtacagcgcttcttcgcggcgctggaaggccccgagcttgacaaactacgggtacaccatgagcaaccctctccctgtcgtctcgcattggtcgaacagttggcatgcaccctagtacgtagtcgctcacaacgcgccgccgtggtggtggtgttggtgtcgtgtcgtcggcagtcgtcggaggcgctggtcctgccgtcggacaagacgtggccgttcctgctccggttcccggtgtcggcgttcggcatgtgcatgggcatgagcagccaggcgatcctgtggaagaacatcgccatctcgacgtcgacgaggttcctgcacatcaccgtcaagatcaacctcgtgctctggtgcgtctccgtggcgctcatgtgcgccgtgtcggcgctgtacgcgtgcaaggtcgccttctacttcgaggccgtccggcgggagtactaccacccggtgcgcgtcaacttcttcttcgcgccgtggatcgcctgcctcttcctcgccatcggcgtgccgccgatggtggcggcgagcctcccgcactggctgtggtacctgctcatggcgccgatcgtgtgcctggagctcaagatctacgggcagtggatctccggtggccagcggcggctgtcgagggtggcgaacccgtccaaccacctgtccatcgtcggcaacttcgtcggcgcgctgctcggcgctaccatgggcctccgcgagggccccatcttcttcttcgccgtcgggctcgcccactacatcgtgctgttcgtcacgctgtaccagcggctccccaccagcgagacgctcccgcgcgacctccaccccgtcttcttcctcttcgtcgccgcccccagcgtcgcctgcctcgcctgggccaggatcaccggcgagttcggctacggctcccgcgtcgcctacttcatcgccatgttcctctacgcctcgctggtacgctacgtacgcacgcgcacactgacactgcctagctagctttctacgccgcgcgccattgcagcgagcagctgatgcgatcgatgttgggtgtgcttgtgcaggcggtgaggatcaacctgttcagggggttcaggttctcgctggcgtggtgggcgtacacgttcccgatgacgagcgcggcgatcgcgtcgatccggtactcgtcggaggtgaagaacgcgttcacgcagtcgctctgcatcgcgctgtccgtgctggcgacgctcacggtcacggcgctgttcctcaccacgctgctgcacgccgccgtccaccgcgacctcttccccaacgacatctccatcgccatcaccgagcgcaagctcaagcccatcgccgagatccacgagcagcagcagcagcagcgcgacaagaacgccaccaccgccgccgacatccaccccgactcagcctgcattaaggacctcgaagccggcgtgccgccgccgccgtcgtacgccggcgatcgatcgacgacgacgacgtcgacggacccgtgcccgctcggcgccgggcagttctgaccgtgcgatcgatcgatggttcttcagacagcgacgtggacgtgcatgtcagtgtaattaattagcttaattaatttgctgtagctactcgtatcgtatgcgtacgtggcgatgtagataggagattgagtcgttgacgacttgggataaggctaagctagcgccagtaataagtccatctgtctcagcctctcagaagcatatgcaccatgcagtgtacaatggttcgatattgtggtcatccccggtagatcgtggcgtactggcgtgagtatgatgaagtactaccaacgtctcccattgttgtagacttgtagtacagtacacttgcgactttgccaaaaagacaggccgactcatccagctcggcccaataccaaaggacggttgggtggaataagttcactttaggtctctcaatttataaaactggatcacaagaaggaaaaggtccatttcgcatcccttagctatggaccgagttttgattcgcgtccctccatcacaaaagactcttttaactattaaaaccgggtattgacatccttgactcttttttaaaacggttttagctgatatgatgtctacatgatatgttcacttgctcttcatcctagatgacgcttgcatggcacttacatgaaaaattatagttaaaaacaatttttttttaaaaaaagtggcacccacatgcatggaagtggattttgatccctctagaggatatcccctcgttgcttgtatgtcactcaaatggttatgaaaaaatatgaaaaaatttgagaagatgtattaacatgcgatatatcactccataaacatgtaagtaaaaaattcaacttctacatctcgcaacgaaaaaacaaatttgactctgaatatacgttaactatgtacggtttaattcattttttttacgagatgtagaagttgaatttgaacttacatgtttgtggagtgttatatcacatgttaatacaccttctcaattttttttaaatttttttaataatcatttgagtgacaaaaaaatgaggggatattctctcgagagattaaaatagtttgtccacatgtaagtgacaaccctttcctctttctcaacctaaagaatggtaccgcagtactgcggtttggacgactatgcatggcgcgagcccacaacaatggctacccaacttatggaagataatgatttccgttgcaggagttgcaccaaatatttatggaactttgctaggcatgtgacttcctctgtgtgta

SEQ ID NO: 43855 - DNA, 14371 bp, Oryza sativa
gtgcagctatcgccgcaactgcctccactgtaagaacgctggtagctgggataatggaaggacacggtgcgatcaggcaggtggttttcctccattttcttcgtaccttgatctcctgatgatccattgatcggtcttgacgacgatggatagaaaggaagctcgaggcgttgatgctgtgcagcgagtaggggcagggatggttgccgaagcttttgaccaacacgtgaagaaaccggcggttcatcgtcgccggaaataattccggccggcggcggtagcagatcgccggacggagagagatcgatcggcgcagctagcgcaggcggcggctggctgcgcggactcgacgcactctagggttttgccaatggacaggccgaatcgtctgggccggcccaattggccgaaaactgcatgttggtcggcctgcggttgagtcactcctgccgtgtgtgccccccaacgtttatccccacatgggccggcccatattgcaagaaaatatgtagcgtaaatcacgactatagaaaatgtgaaaattaccgttggttaaaaaatagacgtctcatatttatccatgtactgcctgtaaaatttttactaataatttaatatagtagtaaaagttttactgatgtgaacagccttagacacctattttaatccaatgatagtttagcattacatatatagtttgtatcacatatagggcaggttcactttgatgtcattttcgaccataccttctttttttttgcaaagttgtcaaaaaaatgttaccgtttagtttgttgctaaatttgatcaatacataagaaatcctgccaaaatttggtaaggtttattttggctataatctgaacatgctcatattctcatatatctctactaattataaaagcacagttttactgacaaaggcaggaggtggtcggctccttttgtgtgtacgtaaccatcgtagaatcctgttcttgttctcagttcatccacccacctagtcaatcaattactccctccgtttcacaatgtaagtcattctagcatttttcacattcatattgatattaataaatcatcaatatgaatataggaaatactagaatgacttacattgcgaaacagaggaagtattatataggtctgactcgttgtaaagcaagaacatattactaattgagggaaaaggccaaatcgtttccctgttcaggtgaggttaacttaaaggtagcaattaggatgcgtgcatcatcaggtgcatgtgcgattgtgcatgcacggaacgttgggtacagcgaatcgagcccctgcacgcggcgtacgtacgcaggcgagtccattgcatgcacatgcatgcatgcatgaacaacaatggattatggatcaaagcgatcgaatatatggccggccatggtcccgatcaagagagcgccgacgcgcccgatcgtgctgctcatgcatcgatctactgctatatatagtacgtacaccaggaccagtactccagtagcatatgtttcttttttccgtgcacggcctttttcctcgacggggagctacccgtgcatgctgaaacagtaaatcgaccatgcataataaatgaaacgcaacgctattgtaggttgaaaaaaaaggacaaaatcatatactccctttgccctacaataagtcattgtagcattggatattacactatctagctgtataacgaatatagacagctttctgtacagattcattgtagtatgtcagatccaattttagattgttagatttccctagtagctgtcaattaacacatgtttgtaattaaactagtaatgtatccatactctgcaacgtgtcagatctatataactaaaagttgactaggatgttagattgaggataaggcaggagctaagccttatataactgggattgttgggtgagtgaattaagaagaaagtgctggatactataatggttacgcgacctccatggtgagaaaggaataggaggatgaagaatgtgcttttaaaggagcattgatgttaatactatactacatcttcatggagcacaactttcgttttaacttgtgatgatgtgcaactagcaagtagctagaaacatactatgacttgtgtaaagaaacagctgtggacaaaaccaacactagtagatggatcagctatctccgttctcatccggctccaccacactagtacgtggctgatccccctgttttacactccaacaaggcaataatgcgtcatccgtggaccatctggtacacgccaagtctcttctggtccacgccaaagtaaagtctcttcgctcaacatatatacgtgaaccatgcatcagagccgaatgcttcttgtgggggatcgatcgatatgatcaggccggccggccggcgctaatccatcaatcacgactcatcatcaatcagttacagctgctgctgctgctgctgctgcttcgcacgtcaccctggcctctcggcctactgctacatatgagtggatcgagtaccaatcacacgcatgcatgcatcgatctgatctgatctggcgatgatgatctctacctggttcgctcctgttccgtgcacttgcctccctcccccctcgaccccccttgatatcggcttcccaggggtgttagattcacatgtataaagttttagcgtatcacattagatattatataaagtgtcgcatgaagtgtttgggcactaataaaaaaattatttacagaatccgtcagtaaaccgcgagacgaatttattaaacctaattaatccgttattggcaaatgtttactgtagcgccacgttatcaaattaatcacaatctatataattaattatttttagtatatatttaatactttatacaggtgttcaaatgttgtaaaatttttatgtgggaaagcctcacttctcatcagtttctcaccaggcggccgggcgggacgagcgaggggacccaggcgacgcgacacgggcacgagcgcgcgacaagggtagtaggacaagaggcgacacgtcagtcgcacgtacatctgcctccccctgcgtggcccggccctctcttgcacagttccatatgctaaactcttttagttctaaaataattctttaaactttcaacttttttatcacatattaaaacttttctacacacataaatttctaacttttccgtcatatcattctaatttttaccaaacttttaattttggtgtaaattaaacgcagcctttaagtctcctttggacgacttcgctgcttgattcatgcatgccgtcccccctggcctctcgagacctcttggctcttttgctcttgcatgcatgtacagcgtgtacagtgtacgcatacacacgcaatacgcgtgcatatatacgtgatgagactaggtacaggtaatgtatatgtacaattaatgtgtatgcaatgcgacagtgtacatgtcgtttgtgccaaccatacactgtaatgtggcgcttaattcactctttgagagatacggagtacagctcattgatatatatatatatatatatatatatatatatatatatatatatatatatatatatatatacatgtttgatcacagttttatatcagaatatatatcttcatgaagtaataaatttgtacaattaaaaagtgtgtagtttttcaagataaatatacatgtaccatgcatcttttatgtttttaaactatataaggcccccgttcgatagggaggataggccggggtgagcttattataagctacacataaaacgaagtgagtgattagggtataattaattgagtattaactattataagattaaaaataaatttatttgattttctaaagaaactttgacatgaagagtttttgaaaactgtatcattgagcggttcagtaagtgtgcttaagatatacagtataaacgagaaagtagtcccctagagtagattaattaattagaacggggcaaagtaatttatagccgtacaaatcaacgatatttaaatcttatatatatccaaaccgtaatgatttgtgaccgaaacgagtactacctccgtcctaaattagtgatcactttaacatttttcttgtaacgtttgaccatttattttatttgaaaattttatgtaaatataaaaaataataagccatacattaaattacttttgataataaaacaaatcataaacaaaataaataataattttataatttttagaatacgacgaataataaaaattacaaataaaaacttaaaaagatagatattttgggacggaggaagtacatgttggttgaaacggagctttcttggctagctgcaggccaagagcttgcgtctaaccgcatatgtccccggctcgaatggctagctaaactagctagctgcttccagcaatccgacacaaccaactccaagcaatcgatcacgaggtccctgctgatctcgttggcgcgatctccgaggcaagtgtatatggttgtgtttagatctaaagtttggattcaaacttcagtccttttacatcacatcatcttcaatttcaaccaaaatttaaactttgtgctgaactaaagacagcctacgtcatcagctccgttcaaagaaacccatgcagctgttccagaggaagatattcgtagtcgtagtagcagcaacagcaatttttacagcaaaattaatgatacagtatgattcgattcggtacgaacagagaaaccatttccccatgtttcaaacgggcaacagtgtacgtacgtcatcccggtagatcgatgatatcatatccatgcttgcacatgcatgttaaaaaaaactgatactacagacttattattctatccatttgcatgcgtttgattcaagatgtgggatgggttggtttggatcaaactatttttcattttatttggtttgagaataagggaattaattggatgattcttgagatcatgaggcctggtggggattggaggggaattaagggggaataactcacaccaaaataattgtggaataattttcctccaatcccttcttctcaaggattaattaaacatgacctaaaagagaatattttcataaagtctgggttgccctttatccttaaaaaaaaactaacggactaattcaacttacttttttttcctcttgataacatgctggacatctttaaaaaaatagaactattccatttcttatgccaaacgaatccaaaaacaaggatgagtacgttcaactttatctcacctcgtcacaaaccaaaacacatgagattattctatttatctactgttccggcaaaaacgataatgtattgtatactagctagtacgttcacgcatgcactgatatgcacacaactccaactcctgtagtgtggtagctaggaggaatcgttcactgtttcgtacatttgttatttgcgcgcacacactgttcttacggtgcactgcacatacgcacgcatgggggcgagcaacccttgtcggtcgatcgacgaacaaaaactgttcgtcatcactagtacgagtccagcctgccaacatgcaggcatgcagctgccgccatggcgttgatacgatgatgacgacgacgacgacgacatatgttgtcacgttgaaggccactacaacaaaacagtttatttttcgagatttagagggagagatgctgctccaacaatactttaagaaaaaaaatgagcatgttgaggattgaacacggaccggaccttggttgaaactataaaccctttattaaatcgctatcaagtacatctttacaataaaacggtaaataagggatgatcctatagatacctgaaactttagacctggggtttatcaaaccgccggggctggggttagcaaacagtatgaaacagtgtaaaatttatcaaaattttaaattatttttaaaatttacttaaatttaaggaggtttgtgtagttttctttttaccgtgccccacggtaaatgtggttaccggcggctgtgtaaaccttgatgccaatagagctttacgtggtagagctgctctccgttcacctttgtgaactactccaacaaaggacgacgtacgcttggatttggatgcatgtatatacttgatccacagcgacgtgtactatactacagaagcatgcatgcatgctgttgcacgtacgtatactgtcggctcaatcttgcgtcaagtcgatcagcatgcagctgttgattgatcacaggtgctggctggctagcttgtcacgtcaagcacaaatgttgagctgctatagctggtgtacgtggtgcgtttcatcgatcgacacaaaacttaatatgcgttcatgaacgcacgcatggttgtacatcttccattcagctcatatattactgatctctctgtttctaacatatactagcattaattgttaagttctttgaaaaaaaaactaaggtaacaggaaatattattttttttcacttcggtagtcgaatttcgaatttcaaattacttagattttcttctgaagcatctcattggctaaaaatatatagatttccgtgcattttaaaatcagtgctaagaaatcctttgtacatcaagatgaagaaggcatactttattcgtttcaaaataaaccaacctcgtattacaatgtgtcacatgccaacagcggtgaacttagaaaaaaataagggtgcctagtacatatatactaataagctagtaagtacttgaataacactacaattaacgtagcctaatacaaataaaaatggacaagttatatatccagtgtctgatgcatgcaccggggacgaggtagccgccgtgttttttttaataaattggtcatttttaaaaacttatttcgaaactagtccctataaaaaacttcaaccaaaaatagaccgtagactcggcgctgtggaccttagtgctgagctataacgtcttagcgccaggcgctaagctctaatccgaggtggcatgaattttctgagtcatcgaagcttagcactaagtaacttggtgctgaggtctctacaatttaaattaatgcggaggcatttcaagtaacatctccctgatagcccaatgggagtagatttcttctataaccgtggggagcaggtttcgatccccatctctcctaattttttttcttttttagttttccctttttcttttctctctcacacttttttttagttttccctttttcttttctctctcactctttattaatatgttttttcttttttttctctcgttttatttttctatctttatttatttttagttttccctttttcttctctctctcattctttattaatatgctttttcttttttttctcacgttttctttttctatctttatttattttttccttttttctcgtaatactatcttcaaaatatatgtttaatacacaactttttttgaatttgaaaaaaaatattaaagtggtactactatattatatggcaaatgagaatttaaactgaaattttaaatcaaatttaaaataaaacaaattatagaaattcgaaaggagcataagagtgactagtcaagagaacaaaaggagggatatcaggattcaaacccagcaccctacgactcacagcctaagacatcaaccaccacgctatcacagccttgcttctatatgttgcttgcgcgttatttaaatcgtagggaccttagtgccaaataacttggcgctgagctctgatgagtcagcaaatttatgccacctcagattagagcttagcaccaatgacgttggtgctgagacattataacccagcgccaaggttcatggcgctgagtctacggcctatttttagttgatgtttttttgcagggactagttacgaaataaatttttgaaaatgatcaatttgttaaaaaaacggctgccgtattttttttaataaattggtccttttcaaaaactttgcagaaacgcccctacgatcgagccagtggatttctatactagtggatcagttgactggtatagaatggaaccaattaatataatcctagctagtcgaatgtaggaacatccttttcttccttccaaaattgtgatgtgcaaagcttttacacattcgaaaaaaaaaagggaacatgatcgccaaagctgtgtatacacacacagtatagtaaataaccttaagaggggtatcaggctaagggtacagacgtagagtagcatgtaacatactcgtatatatatggtacaaccatagtaccatacccttttcctttcttttgctaggagtacatggaataaggcctggttagacggcactacagttgcaggctattcaggataagaagggtgaggagactatagaggcaaaagggcccaacagggttgcaggtgatttgatgttggggagaaatgcgttttcaaatcgaggctgtacgcttgccactgccacagtacctagtctccttttttgaaactcaatgttgatcaacagaaaattttccagaaattctacgggcaatgccttccaaacaagccggcctcaaaaaccctgcatgcagcgacacactgttcagagaagccctgttggaagtggagtgtgctctcttaacttcgttttgttttttcaactgttacaaaactgtcacaaaggtacacattttatactatgtgtcaagctacaagaaaacctacattctgtcctggtaaaaaaacatactcctaacattgttgagcatctgatcaaattatgcagtacattactgaatttgcttccctgaagaattgcagtggccagtgtgtatgtgttttcagatttggtttgatttctctgttcttgagctagagctaaactagttgagtcagtagaggcatggtgcctctgccccagccttagacaggaaagcatatgaatgaatggagtagtaatggccattggaatgttgcctatggatgcgaaaagcagaggctagttattggaggataaggacatgcatctgctcaaagtaatgctaggtcaaggactcctgccacgcctacatgggagagttgttgaatgcagcgtctatgattgatgctcaatgcataggagtatcaaatttatgcaccatacactgcaatttatacaaagatacacttttttcatggttggtttggttcatctccttatcggcatgttttggtagcaaaataaggatccgaaaaaacgcattcatactgctggattttactgagtcaagaaaaaaaatcacttccgagagtcggttattgtgtcaatggtttaactactccgttcgtttcataatatatggtgtttttgctttgtttgaccaagtttacattcttataatatattttgaagaagttttcgacttagattaaaaccaaaacatctgacattctgaaaaacggaaggattacgtaatattcttgttcttcttgatatatagatcagagatagtatatactcgctccctcccgaaaaaaaactaatctaggatgggatttaacctctcctagttatctagattaattgtactaagaggagtcatatcttcttctaggttgggttttttttgggaccgagagagtatgtactagaaaaataggagtatatgattttataaatgcagggtatatataggagtatgtatttgtggattgtgagatgcgttctttggctgaaagcatcagaattcagaagctgcagagggagtaaagggaaggtggtggatgcagaggggagggcgttggaaacatcctctttgccaggcgaaataatgaggccatccatttcaaatgttgcattggctagctgcctagtagcacacagaagagaagaagatgccaccgttgggtagagtactctccccctaccctgcggcgcgagacgcaatataaaaaatactgaccccggttccttcggatctgagcgcagcattcatggcgatcgatcgatccatgcacaccggtgtggatggaatgtgtatcagaggaggagaccacgcatgtctgcacatcgttttgtgtgcttcgtcgtactgtaccactactgttcattcctactgtactctctcctcctcctactcgtatacaaagcctcaactatggccctgtttaattagatcacaccttaaattttgtcggcatatcacatcgaacgtttaacacctataagaaatattaaatataggcttaaaaaataactaattgcatagattgcgactaatttacgagacgaatcttttaagcctaattgctccatgatttgacaatgtgttgctacagtaaacatttgctaatgatggattaattaggcttaaaaaatccgtctcgcggtttactgacggattctgtaattagttttttattagtgcccgaataccccatacgataccctatataatatccgatgtgacatgctaaaactttacacccctggatctaaacaccctctatcattgcatatgctactgaaactaattagtactgctactcctacatctactataattaacaagatgctgctaataataactgaaactcatgatcaaggcatgcgatttgcctgcctgccagccatgtgatgcgagtacactccggtatgtgactgaggtaacatagtacagtactctccgtctctccctcgcaatgtgatcgagactttttgttagattctactgctagcattgcgaacaaaaggcagctatagctcctagtactccatttacgcccgacgcagctgcaggaagctaccacgaatgtactactatgccagtatgcctgatgcaaacgatgcattgaatggtggagtatacggctcctccagctagcactagcaacatgctcctagttatagaggctgtgtttaccctaaaacttcactgtttaaaacttcactgtttgcctgctcaaacctactcctacatatttctggcaacctagatgagatgatcaaccgatcgatcaggaagaagaagaagacggccgggggaccatatagacgatgcagagtcctacttttttttctctcataaaaaaccaacatattatcggataagacatatatatcatatcctagtaatataaatttggatatccatctatcttgattcatattaataggatacatatcaaattcgtttttatgggacggaggtgcgaagaagacgtacgtacggggggccctcctgcgcggttgcgagacgcatgcatggtgcatcggcgcgttgcagatctgttgcagtggctatccttaattagcttatcccttctggtctctgcgacgcaagccgatcgagccagcgatctgtagtgtgtagggatggaggcaggacggaaggagaagcagagagaagggcgtcgagaggatggtggggatcagagtagcgttgtgtgtgtgcagcctcgtgttttcgttatgcaatgcaaaaatcccctgctgccgcctgcagcctcgtgctgtgtctcctcttctcctcgccccccttcacgtgcagtatatcgatccatcgatggctttgtgattaacggccccgtttttgtcagggtgatgaaaatctcagtcagggcgagagaatccatacgctaatatgcaaccaaaaactattactaatagtcgcagagtcacaggctgaaattacgctgtgtcacctgctcgctgcttatccgtacacaatgcatgcacggctacggttcaagttcacgtcttgtttgaatagcttaaaaatagaattttaagaagcaggtactacctctgtcccaatttaaatgttgttgtggatttctatgttaaatgtttgactatccatcttattttaaaaaagtattaaaaagttaaaaatttagtcacgcataaagtactatttatgttttatcatctaataacaataagaaagtactataatcattattttttttcaaataagataaatggtcaaacattgaacataaacaatgcaaaaatgtggtcgttctagaacggaggtagtatttagtactacctccatttcaaaatataagatacaaccacctttaacctaaaaattaaaaaacaattattatcatcttttagtttggatcaccctaataaatataatacatataatagaattaaagatctctacggtgaaggatttagaaaaagaatagtttagtggagaggaggtgctaattaattgcatgcatacatgcagtccttatattatgaaacatcttgtcgagaaatgagcctctctagcgggtgatcgagagatccccttttgtgagttcggccgggggaaagggcacgctgatcgagatcgagtatccgcttcgagttctccgagaccgcgcatgggagccaagattatacaggttcgggccgcttggagcgtaataccctactcctgtgcgtgggatttatgattgagtgttacaaaggttcctaaacaccaaggagcacactcgctcttcttcctctagggtttaggctcactgagcgtcatcctttttctcggcgggcaaagtcctccttttatagtctaaggggataccacacgcaccgcctctacctactcctccacgggagggggacccactccgcttagaccggatcacgattcgtgccttcgcctggaagctaagcagccgtccgtcctcgagtggggcccagcgccgccccccgccgacacgggggacacccttgtcattccctcttaaatgaatggagacttgtggcagtccttctcacgtggagggggctttagatgatgattcgatgggacggggcatacctacccctactccgccgggtacagggtggaacgtgggggtatcaccgcccgtccaatcagacgtgaccggcgacaggccggtcacagtttggtcccgcctgattgacgtgggtcaatcatgcagtgccgcacgtacgcccttgtcgcattagatgcagtgagggacggttggggcgccgcgcattgatggcagctcagcctgagtctccgtcccactcgctcccctcgccacgtagcggttgggcgagggcctcggggcgaggcagcgcgagggcccgaggggcgtgacgtagcaccccgaggccccttggttgcctctgcgtcgcccgagatgtggggggagagccaggctgtagggccgcgtggcttgatgggaaggtgactcccccatacttagcatacccccgggcccatatcaccgacatctgaaaaaataattgtgccttataatccctccgtcccaaaataagtgtagttttgtactattcacgttcaacgttacgtcttatttgaaaatttttatgattagtatttttattgttgttagatgataaaacatgaatagtactttatgtgtaactaaatatttttaattttttcacaaaatttttaaataagacggacggtcaaacgttgggtatggatatccacggctgcacttattttagaacggagatagtattataaaatggagggagtagccagcttctgataattgaagaaagctcgattggtttcttagtttctagattttaattcattttctagattctataaccacatctttttagaatttgaacgaaagttaaaactgaactatttacaaaatcttatgattttgaaagaaactgcagctaacataaactctcctaagagcaagtttaataatatagcccactactagctccaaaatttaaatcatcatctatagtcaatctaatagctcactcatataatagttagctgtagaaatatactgcatcattaacatggtttattggacctcgtgttacagctagctataaatccgtagcccgtttttgctatctctcctccacacaaacataaatctgatgtggtaacttgtatagcccgtttatgtcatcttattgtacccgctccaaacgcgtactcaatggttgaatgtcacctagctagcacgtgacccgccttttccccgcacgtccccttgcctgcctgcggcccagccagtgcgcgtacgcgtacacacctccccctccccgtttcaaaatcgcggcgtctcccgctatatataacgccactgcctcgccgccgctgctaccacctctcgccgtgcgactggctgagctactggtggtagctgccaatggcgatggatcatcgtggtggtggtggtggtggtgggaggagcagcagccggctgcgggacaggctggcgaggatgttccggccgggcgcgctgctccggtcgacgtgcaacaaccacgccaccgcgtcgacgtcctcgtcatcgtcgtcggcggcggcggcggcgggtggggtggtgacggcgtccgcgtgctcgtccagcagggcgctgctcgccgcggacg

SEQ ID NO: 43856 - DNA, 11989 bp, Oryza sativa
gcggaggagcaggtccggcgcgggttcgccgtggtgaagcggtcgcgggacccgtacgccgacttccggtcgtccatggtggagatggtcgtcgggcggcagctgttcggcgcggcggagctggagcggctgctccggtcgtacctctccctgaacgcgccgcgccaccaccccgtcatcctccaggccttctccgacatctgggtcgtcctccatggcggctagctactagctagcttattagccttaataaaaagagagaaaaaaatcaccgtgtttaattaattagctcagtcccaggatgattaatcactgagattagccagagtactactccatcttgcagtaatcatgtgtgttcattacttaatctttctcagagtttaattaatctcctcttgtgttgatttaattgcctctcatgtataatggtcgatcagttgggttaatttgagcttaattaattacacttgggcatgcatgcatgcactggaccgtggacactggcctctagcggtgtgtgtgtgtgtgtgtgtgtgtgatgtacctgcactgttcttggttctgaccaacctttgacttatcacgctagttttttctttttcttttttgaagactggaagaatctgatttggaaggggatttggattgaccagagagtgaggtgtggtttgtttggtagccagagagaagctgtgctgcgtttgaactttgggatcaatcatttggaaatcatgattgtatgcatacgagctagtactgttcctatttgtgtcggcagttattgggtggaattttgatcagtttaaatttgaaaattgatcagtgtgcaccttttcaggagaaaagagtaatttatcatcagagtaacatggttcaccatatggttacatacatgctccattttcctcttaatcataaactagctagggtcttccgtttgcataatacaaaactcaagtgacttgaggtaagttcagatgcatattgacaagcggctacaagtcaaaatggcacttaaattggagtaaaaagcaactataccctcactttatactctagctctgctgaaaaagagagagacatatgtactgccaaacaaacagcccaggatatcatcacaagctcattattcatccatctagagacaaccatgcccggtcaaatttcaaacgggacactataaattctcctttgagcattacttgtactccctccgtcctataatataaaggattttaaatttttgcttatagtgtttgaccactaatcttattcaaaaaatttatgcaaatataaaaaacaaaaagttatgtgtaaaatactttagataacaaagtcaaaaataaataaataataattccaaatttttttaaacaagacgagtagtcaaaccgtacaaataaaaactcaaaatcccttatattataggacggagggagtacatgtattggaggcagtacttgtactggtaatacatgaagtatcattacatcaatctcctcaaaagaacagatgcctttgccggcacaacaggtcaaagggaaaagggaatggaagatggcaatagagtatgcctttctatgctcacatcactagcttgggatttgagcctttgcatttgctgctctgctctgctctctactatctctctcctcctgcatagcctttcacctctctcacctacaaatccaggtttccaaatcaaatcaccaggtgtgttcagtctaacacaagcaaaggtacaactactagtacaacttgtatactagtagtgctccagtacaagtacaagtaggagtacgtgtactagtacatgatttgagtttacttaagtatagctaggagtattagtagtagtaagacgttggaatttcaccttggagcaggtgctgtgcatctttctccaaggacattcagaagagtgtgtggaaaaggttgaggctaactataggatgcaaatatactctaggtctatttgcgtttgaacttgggaaaaggtgggtggccttggcgcattgtccagatcatgctcttggattggatgtgccctgtttgctcgagggaattaagtttagttaaatggctgtgggattaggtttgtggggcggtgtttcaattaattgattaattaaggacaggatatgtcactgcaccaaagtcgaacttgttgctttctgcttaggactttagcgatactattacaagggacaccagccaagcgacctgaatgccatgccatgacatgcctttgcagtactagctttgcgtgtgggggtactccatattattcacaatgacatttgggaagctaattaactacttttctacattgtcttggcagcactgagttgtacttgtgtgcatatatggtttaaattacacctaacactaatagtattattttcctactgaccatgttccaaacgaattaactcggtgacatgacactgcatgttgtcttgctagaagcatacatgcgcgcctacggactatgacacatttgccatttcagatgaagcctgaccattcaaatgtccctattttcagcattgcaaatcaaatcaaatcagctcgaggtacacaattcaagtgagtgaccaacggtgtgctagctagcaatagctttttcactatttctcgaagcagaattcaagcacgctgtcttgtcctgtggctgcctgctatggtagtttgacaatgctcttgaggttaatgtaagaaaactttgtttaatgataatatttcaaaaggaaactttgtttaatgatcttaatttcaaaaaggaactttttgttgataacacaaagtgttctctcacttctaagtcaagagaaaaaaagcagctgctagtacctgtgttcccttttgactcggaggctaatctccacgttttctgctttggaaagatcgcttttagtcagcctaaaaggcgatcgatcgatcgatcacctcgagaggtagtggcctcaactgtttgctgcagaatttgcagatcaaaacacgtacggtgtattggagattggtggtagtacgtagtacgaattaaaagccaacaatgaacacagtataaaaagcaggtgtactattaatactctcttaatccctccctatcgagagaattaattaatgtctcctcgtttctctttgtatcatgcatagattaatgtgtaacgtatcactctataaacatataagttcaaatttacccttctataagttgtaaaaaaaatattactctaaatatatgagcatgatctatcgatagtctcatgtgttcttgttttctaactatctttaaagggatttctagctactattcaaatatataacatgagatatatacatgcatgtgaggccatgcattctctcgagattaggatccattaattagctaaaggttcaattgaacatatacacgagctagatacgcgtactatacgtacgtacggtgcatatatatggtgagcgtgaacagtcggattgtacattttgctggggggtgatgtactgcgtacagtggcgccacgttctttgagagattgcgagacattgtttgtagtggcgggcaggcagtcatgtcatgcatgtgtacacgtacgccccctgcccggcctctacagtgcgcgacgctgtaagcctgtaaccttgtcatagtagcgttgttgagtttcttcgatcgatctcctcttctctctgtagattcttaattatgttttttttttcctgacggtcgtttataacgatcgatctactctacctgtggctggttatgtggtcaccagctcattggtcgagctttgcaattgggtagaacagttacagatgagatgtgtcgcaccgtaaatttaggccctctttggatgcagggactatcatatcgaatgtttgaacattaatttagagtattaaatatagactaatgataaaacccattccataactctggactaattcgcgagacgaatctattgagcctaattaatccatgattaaactacgtgatgctaagtaaacatgtgctaattatggattaattaggcttaaaaatttgtctcgcaaattaattctcatttatacaattagttttattattagtctatatttaatatttcaaattagtgcctaaacatccgatgtgaattagtccctgtatccaaacaccaccttagcttcttaattaaagatgacaagtcgtcggtgatgggtgtaaacacgatatcatatcgaatttattttatgtcactgagtttactctacttcaacgatttgctatcgactttatctcctctatggctctataatatgccactgattttatccttttttacattatgctattaaggtggatacttttcaaaaaaaacctttcatgtcataccagagttgacaattgtttaaccccatggaagtttcagaaaaatataagttttttgtacttagccttcctacaaaatatagaagtttgtatgtgtattttatttctttcatgtttttttatgaaacacttttattatgtagaatatgaaagagaaatcgcatactccatccgtaaaaaaaaaacccaatctagagggatgcgacccctcctagtacaacgagtctgatctagattcattgtactaggaggggtcacatattgttttttttttaccgagagagtacacaaaagatagccgcatcagaaaaaaaaatatatggcaggtgattctattggcatataacacataaattattctattggcatataaaacataaattattttttgaaaattaatatgtgcaaaatggaaatcttgaaatttacacacacttttgtatattatgcaaggaggatacataaaaattttcatattattttttgaaacttctagtaagccaatcaattataacctcttataagccttgaaaagcatttttaggcattttttaaaaagtatccatccctaataaaatattgtacgaaaaaaataacaaagtcagtgacatataattaacaaagggaaacgaaattaatggtaaatcattgaactggaataaactcaaattttgatccctgatacactatgtgagtactaatgagaatatatccacgatgcagcgagagtgcatcgtgtcgggaccgatcgacgggtgcgcgcgagtaggcggatcagatcgacgccgccgccgacgtacgtacgcgcgtttcacagtctagccgggaccgatcccgacgcgacgtagctgcagatcggagatgtaggtatacgtacgtagtactgtatatatagtagctgagacgtgtacgtacaccgagtagctagattggctgaaagctagggcggctttgagctctgccgctagctttagctttgtggtctaaaaagctgcctgtgcggtggctggcttcctgcactgcatgcaggtcgatctctgcgacgggcgacggcgcgcgtcgaggcgttggcggcatgcgcggtcatcgctcacgcgtccgcggggatggtggcctgcggtgaccgcggagcttgtagccatgtgtacatttgcacgcaggtgcggattcataaataaatagcatgaaaggtattccctccgttccaggttaatatgttttaactttgatcaaagtcaaactactttaattttaactaagtttatagataaatatagtaatatttataataccaaattagtttcattaaatcaataattgtatatattttcataataaatttgtcttggattaaaaatgttattttttttctacaaacttagttaaatttgaatcagtttgactttgaccaaagtcaaaatgtcttataacctaaaacagaggtagaggtagtaattaaatttagagcggttcagtgggagctttcatagtcctagtgtcgatagtgagggctcaagctcccacggcaccaatagcagatccgccgttgcaagcgcttccctcaatatgttacacactagtacaaatgttctttattttccaacacctataagcttttagtggtgtgctggatactttctttgtggaagattaaattgccaacaacattctttacatccacatcacctaatgagaggattgtgtgcaggaagggattactagcttgcaccgtaaaacacacaaagaacggtctatacatcacccgacccgagtaaacccctgctcagaattaatattgttggatgtccagaccattgtcgtcaatttggaactgtgagtgtatctcctgattattttttttttataaggaggcgtcactccatttcttgattctagaaagtaagtgcattatatgtatattatcaagattcttatatggtgcgattttttgtaaaagttctatatgtgtataaagccgtggccactgacctaaaattttcatgtgcacatatttcttgttttattcttgatagttcaacttgtgttcgtgataggatgcacaggagcggcagcgatcctgattctgacaaggcgcactggtatatgagcaatagcgatgacgagtcatttgttgataaagataaagattgcagaaggggcaccgtagccccgctgctgaagaaaggcccatggacatcatgggagaactccatcttagagaagtacattaagaagcatggtgaaaggaattggaagcttgtgcagaagaacactggcctcttgaggtgtggcaagagttgccgtctctagtggatgaaccatctgagacctaacctaaagaagggggctttcagcaaggaagaagagaataaaattattaatcttcatcgcaaaatagggaataagtggtcttggatggctgccgatataagttcaccttgtagttcattgttttttcttttgctctcagaatatatatctcttgaaaccgtttataaaagtgttgttctttaatagtttttgcatcacaagtatgtttggtgacctttacatggaggggaggtgcgggggatattaatatttgtagttcatccattggtaaagttatttaatttaaagttgggtagtttttttttccaattgcattacaagtatgttttgcaaccttcacatggaggtatgggtattattaatatttgtagttcaactgttggtgaagttattttctttaactaaacgaatgttatccatttcatttatttcaattaatatttggtagtttttgcattaccagtttatcctaaaatatgattatcatcacaaatcaaatcaaccctaataagcatatataaatattgtcaaagtcccatccttgaaattatcttaaaaatgtagcctatttttgcttgtatagcttaggggttgctatttaaactaaactgctagtatcttttcattgcacttgcattcatcggcctagtttagttctactgaaaataaggagccgtgggacaagctaagttaaagtgaaacttggggtctagctttatgcatataactatcttagttgttgttttagaacattgttactgttatatgcattgttctatccattatcattgttattaacttgaccacatgttctcaattgccagggcgtactgataatgaaataaagaactactggaacactcgaataaagaaatgcaagaacaatcgttggcttttatatcctgctaatgtatgcaacgatgctttgaatgaagatcaatatgggtctgttgaccccagtgttagggagaagctaaccaataatcaactagaagatactactagtatgtattctgcaccccagttttcatatgcttccatcagtaatatacttgataggagacttgcatcaaaagattatgactccatagaagatcaaagaaaccgaatagaagttgcagcagaatatgagatttcacttcctgtgttgaaaacaaccaacaatgacatatttccatcaggtgagctatcccctaaactactctgagaagttcacataagcttttggtattgactttgtatcactttgtgactaactctaatgataagaccatgccatcttttgcagcctctatctttgccaaccatggcatttcaaatggcaatctctctgctttgtccacaactgatgctttgcagatggagctccctttaatccaatttgatccaaacaaccagttcatttactcaagggattatgcgacgcacctaacaaacttagctttattaaatgatcaagcagaagaattactaaatcatattgatgtattgaactatgtggtgatgaaaaaagagctttctggagggagtttgagtcccactattaatatgccatgtaaagcaacggcatattcttcagaactccctttatgcaagggatatcgggaacaagatcttgatttttacacacaatagtccagtatcgttgaaagagcttcatagctttgatctttctttcggttcgtatagtttacttatttcatcttttacttacatagtagtttagctgttgatttgttgatatctttttgaagcacatacctccatgactccctccaatgagctggtggtgccacggtatgaaggagatgttccacctcttcaagatgatttcacaccatatctctatttgaatggtgccaatctatccatcttcgaagacataaagtgaattgtttctggaaaacaagttggatactaaaggtgaacttgtgatgacatgttatgtttcataaaacctgcttatggttgaaatcatcgttttctaaaaatattcgttcttgtaatttcaggtaattgacgtcagattgtcatgagttgatgccctcttggacaaactcatcatgaaaccaagcattttattccatgaagctcatgaagacgatcgagccagtcgttgctatctctcttataaggatttccagtttggatattgccgtactctgttacttttcttcatgtcgaatttaccatgcgtgctacgttgaatttcatctgttgttgtgtgtgttaaactatcgaattcaaaagagtttgctgcaacacgttgcaacgttgtgccaccgaatgcagagaccgttctatttcatgttgcgtataatgtttgatttggttgcatttgcatctggttggtgtttctctgacggcttgccctgttcgacataccgtcagatgtttaaataagttttaattatttaaaattgaaacataaatttatattttaagtaactttgatatagaatattttcatataaaaaatggtatcatttaacacttagagaaacatgttaaccaatgaaacttacttcctcggtcccacaataagttcacttttagctctttccatttatctcacaataagtttatttttaaagctctttccatttatctcacaataagttcacagtaagttcatttgtaaagcaatcattacatcagaatttgtgaaattagagaataattatattataagtagataaagtgagaaatagttaagttgagatttgataaaggaatattattatagttttttttctttgtattggtatctaggagtcattgtggctttgaaaacgtcgctaaccttggtgtcgtcgcagactcactgaaactctgtgaaagtgaatcgatgagacgaaccaactccaaaaccaaaacccgcaccacccttgcgtaagcgccgcgccacctcatcaccccacccacggaatactcgtgctcgcgccgcgccgccacccccacaactccccgctccaccattgccgggggaggcgatctcccatctccatctcccatctcgcatccacgacgaactctccttcccatcgtctatcttccgtcgcggagggtggcagtgaccatttctggcgatcttcgggagggcggaggtttctcccggctccggcgacacttgactcgagagcccaccgctccgtcaccctgcgtttttggtcaggtaaaaaatggctttaggatcaccggtgtgttgcttttttctttttgttatgtttaatggtttgattggtgaattgctgggaatagtcttatgagattttagcagatctgttttttgtgggaaaagttggaaaatttgaggtcatttcaatttactttcctggaattaacaattaaacaggtgagaatggaaggttcccctccttggaacctccttattggtatcctcctttattttttttaggttaaattcttgttttttaacatcataccattgcatttcatttgccttcttttccaatataggttctataacggttccaacgacaagctttcctcgtcattcaaactggcccaccgatctcctattatcccatggctaaggtggtgtcattgtgctaacaccgcaccatcaatctctgtaaggtgggaacacctccaccctctcgctgtttggagtagttctttcccttctttcatctagctacgactttgtttttcttttcttttttcttcccctgggcataggcttgtctggacgattgcgtcgtgtaataaaaagaactctttctttctaatatattgatgtgctatccttttacgcttccaaaaaaagtaaggtgggaacacttcccaccttctgtagatttgtcgactttccaccttctgtagatccgtcgagacacgaattatagagcaaatcaaaggtcagaattcacgtgattctgtccatcatcactgactgatgtatagcatttccaaaaattggattctaacagggcctcttaaaaaaagtcatgtattcgggaaaataacgaaaaacatagcatcatgggtgtactgatgaatcttttagctgaggcgtcagggaaagctcatgaattatgctctgacgactcttttagctgaggcagggatatatggaagttgggcttgtcagaccgacactatctaactactttaccgctgacgatcaaatggctaaccaagcacgtgtgaacaaaaaagctacgagtgtctttttttcccctttccaatcgggtgtgatcgtaattttacaaagctgaagcatgattaatgttactgtaccttttattttgttgtgaaattgatgtatttttttgctgatttgagttgaacttgggatgaaagtgttggtgagaaattaagcggacaattttttttttcaaaaaaactggttaattaaaaagtactaccaaattaattccagttcaatgttcctgcaatccgagtaggaagcggtcgatcgacagcagaatctgattctacgccaagttgccgatcccccgaacagcgaagagagagagagagagagagagagagagagagagagagagagagaggataatgacaaacagatcggagtgaatgctcacattctgtgttgcctggcagggagagcttggcatcttcctgcgggcaattcgggcagaacggcgaccgaggcaaaaaaaaaaaacaacaaagccagcgccagtgaaccaaaccggacctcgtcgggctccgcgccgcatgggctctcgctgcgtcgatgtcgcgggagcggacactgccatcctgcgtacttgtacgagtaggtgcagcaagtacgtataggcgcgcatgccgcggcggacgccagcagctgctgcggtccacactactcgacgactctcgcgactgccgttgttctcgccgtcgtcgacatgggagagggcggaagcagcagcagccgaccgggccggcgtcgcggctggggctcccatccttgtcgtatactcgtctgcggtggcttgtgccagcgcgcggcttctgctggggcggcacgctcgcccctgcacggctgcaccggtttacctgtctgtcgctggaagtttggtgatgattttgaaccccttggaccaagtgagcgacaaacgaccggcccaatcgtatcgtcggctaataagcgaaacggcatagaagtatttgcaaataaaaaataatttataaataaaacttttatatatgtgttcttagcgattcagaagtataggctgaaaaataaacttcaatgaaaaaaaccctaaaatcaactccaaatttaagattgcaaattcaaatttt

SEQ ID NO: 43857 - DNA, 14203 bp, Oryza sativa
  unsure (1)..(14203): unsure at all n locations
gaaaccgtttggatggactctatctttagtaggctggagctatgccaaattggccttggaagttctgagtaagcttgcagtagacgacaggcaggtttaggctgtgttcggaacacagggttcccaacccaaactgttcgcacggaaaacgaacggtctattagtgcatgattaattaattatttgctatttttttttaaagaagtggatcaatatgattttttaagcaactttcgtataaaaactttttataaaaacacaccatttaatagtttgcaaagcgtgcgtatggaaaatgagaggggagtgttgggaactcgctctcgcaaactcagcctaaactgttgattgtatgggccaagtgggcctcagagaaagtccaataagcaacgtcgtcactgggctgactttaattgggcccaccgtgtgctgttgtttctaatcacctgtcaggacggcactaataagcagcagcgagccagtgattctttctttttctttctagtactactactactactagtatactactacactactagtagagtacttcctcggtcgttaagtgtagttttagctagtaagtcactgttaagctaaaattaaacttatttagtataaatagagagagtagtttctactgatgcatgcatcgagaattctactagccagtcaagttgtactcctacataacgtaacttgttgtagtagcaatacgggaaggaaaagaaactgctgagaatttagtactaacacgcacgcacgccacggtcgacacgaatgacacacggctctcgttctcaaacactccttggccctggctctcccctcgtcgtcattatccagcagtcagagagtgctactacactagcaagcggttgagtgcacgcataaagaattcctcagcttacatacggccagacaaatcacctgtacgttcaactgttccaccagtaatgaccacacctcctacgcgtcaacactcgacacgcgggggccactgacccgtccgggtcagctcagttgcgtgtgcgtgccaagcattccgtgcacgcagcagcaagcacgatcgctcgcatcgcgcgcacgggaggcattcgcacggctgatttacctgaaacacacgtactccactcctctgcgatttggctgccgcgcgcgcccgccttgagagatcgatttccagcgagttagtagttaccgtcgacgacgacgacgaggttgatcgagttactacctgttgttaccgtgcggagatatttccggacggtgacaacgaaaatatcctcggttttgctcacgctccatctgggacagcgaggggttggtttgggggaggcagagagaggagggcgaccccaaaaagctaaagcaaagcgacgacgaggaggacgccgacgaggcggcccgctgcggccacgtggcgcgtggcgccggcggggatgaggttgcttcaacgtgtggccacctcgtctttgtgcttgcgccttccccgcaacctagatctttttttgtcctcacccagtcactcgtccgaacacttgtctaatcctcttgccaaactaaaattaaaacgtgcagcatgatagtaaaattaacgctgtcgtgccaataatttcttgacgacaacgacatactacctccattttttaaatagataacaccgttagactttttctcacatgtttgaccattcgtcttattcaaaacatttacgtaattataatttattttgttatgagttgttttatcactcatagtactttaagtgtgatttatatcttatacatttgcataaaatttttaaataagacgaatggtcaaatatgtgagaaaaaaatcaacggcttcatctattaaaaaatggagggagtataatgttgaaattagaggtagataaattttgggaacgaaattaggaatgacttatatctcaaatcataattatggttcagtttaacccgatggatttggacctgaacgtaatttcgaaacttcccaagggtatttcaccaagccgtacgcattatttaaccgatggtgaagtggtgagcacacgccctctcctaaaaccaaggaacccaaccccacaaaaaagcgtaggacgccggagtgcgaaatccttatccgctcgcggcgacgccatggccgccgccgcggtggtccacctctccgtgcacggccgcctccgccgctcgccggagctccacgcccggccataccaccgcccgtcgctgctccggtgccgcgcgttcaagcaggaggccgataacggcggggaggaggcttcgtcgtcgccgccgccgccgacgacggccgaggcgcggaggcgcaggaagggcccgctgtacaagctgaagcggcgattcaggggctcgccgggtcgcggtcggcggccgcggaggcgtacgggggcgagtaccagcgcgccgtcgagaaggccgaggagatcttcttctcggtgagctccattcctgaaccccctcaagctcccccgcaagcgcagtttctctacatgataatatgataatatgtttatggccgattttttcatctgatcgtgtgatctactagtacgactgcctttaattgttgccacgtatcgggaggctcaaccactcaatgcgttagcgagcgctactaccttaatcagctcttgcttagctgcatatgggaattgcacccatcagatgctacagctacaagtgagtttaggcgatctatgttgtttcaatgggtgttaggatccaatacactagctgtggcacaaatcgatgagctgatcaacactaatcagcttgtttcttactagtaatacagtaggctccagttactgtgaaattctgtaatgtcagttccctttatgtttatgtgctggagagcaaattctgcctgcgctaaaattaatcgcaggcctgtgaagcaatttgcctgggcagaggatgcggctcgtagccagaggtgtcattttgtgtagcctttgttgcttttgaaactattttaaacttctttgaaactcgctcttgattaaatttacttcgcccctcatttatatgggcctagattctctggttcttgcatctaccattgtatggggggcatgggctgccaggctcatggttttacatgtccgactgtaagtgcatgcacaggcctgctttatagttcaattgaattgcttctaggcatgctgattctttgtattgatataaataaaatctccggtatcggctgattctctaacctaagcacatcagtaattttctatttgttgcaaacctgaacagagtggttctgaatttatcactactgagttgtaggatcaactccttttctgaaataggtgttctttttttcaaattgacttatttccttctccttttcaggttgctacgcaagtaggccgatatgttatcactatgatgagcagcggtgttgtacttggagttggatttcagttatcaggttagttacattcatttgatatattgcattgcctttggatacttctgtttttttccctacaatgggcattttcagagtttcagtaatgacctagctacctttctatttaggcggagacagccaaatgaatacactaatttggtatagttggctcgggggagtaattattggcacgatgataggtgcaaacagtgtcctagaggaacactgcaaagctggacctcgcaatgttgtcataactggaaggtaacccattttgcattcttcctttcacatgccatctgaatcttttgctaggaagcatgcatactgtgagtacaggtcaaaggtaataatcaaaactaatgaatttattcctagataggaaatactatttcaccttctattattctctattttcttatttgatgagtggagtataaccataacaatcaccaagtttatacgggttggtgcatagaggagattatgaggtgcagtcatatgaacaaatcattaaagtaacctcataaacatgttaatataaacatgacttctcattgcatcaattgtgagctgatttcttattagtatccatgttctgcaatcaacattgaagttatagtttgattttggcagcacaagaggattagggaaagcacttgctcgggagttccttctttctggagatcgtgttgtaattgcttcacgcaggtggtactcatagacatgtagctcaatgtgtgttgttgttgcatatccatgatattctttttatgaaatgcaatgcgttgtcctagttttaaatatcctattttttgaaggcagccctgaatcagtccttcagaccatcaacgagcttgaagagaacatacaggagggcttgtcagttgcgaaaaagaaacagagagaaattttgctacatgccaaggttgttggtacatcatgtgatgtttgtaaaccagaagatgtgaaaaagttggtgaactttgccaaggatgagcttggatcaattgatatttgggtaaataatttacttttacatatctatccccatcatttattctgcattatttcacggtagggtactcagttggatacttggattgagtgcacaagtttttgtacttataacctttttattttgttctgtactgtggcatcgcagaatgtacttaacatgtgctattcttcttattcttatgtatagataaataacgctggcacaaacaaaggttttaggccactggtaaacttttcagatgaagatatttctcaggtacgttaattatcttcggaaaatcagagtcttttccattctaatagagttcatagaactatattcgtcatgcaacctgacttagttatttcatcttatttttctttctgcttagcctaaacaacattattgtgtccttttctgtttgcagattgtctcaacaaacctagttggctctttactgtgcaccagagaagccatgaatgtcatgcaacaccaacaaaagggaggtcacgtatttaacatggatggagcaggttctggaggatcaagtacaccattaacagctgtgtaagtacctaatgatttcaaatttttaatgctccactgttcgtgtagctcttatactggacagggatattgtcttgtggtttcttcattggctaaaaacgagtataattgtattgatgttgttacttgtgcagtgaaactaaaactgatactattttgcaaacttgcagttatggttcaactaagtgtggccttagacagtttcaagcatcacttctgaaggaaagcagaagatcaaaagttggtgtacacactgcttctcctggaatggtccttacggacctccttttgaggtaacctctgaagttatttagatgcaattattgatgatttgcttgtttagttcattctgaacttcaatatatttattgcttggtgcacatgttgtccaaactccaaaccacactttgtgtgatgatagtaaaacaagataagacttcaagtgcataagaagttttcagtaggatctttatggaaccacacatattggttaatcagaatttcacgctatcttcattttgaatttattttagttaatcaacaatcagaatgtctcctttgttgaatggggaagagtcaaaattttgagatacctcgctgcccaaatcttctttgtttcaatctcttctttctaggatttgatttgtggcaactatttctgtagaatcagcttcacattaattattaagttgcttttgctactacacttctagctctggcttttcctatctgctataatcccgatgacacggtaaactgggtgcgtggcggttaatcagaacctgaaagaattaatgttccattcttgtgcaaatactctgccttgtaaatccagttcaaagttgtgatgttgcacatactttatacttgtaaggcttcatagtttctgtcaatatataaataacttgtgagataacttccagatataattattacaaatgactaatgcactggaaagttctaacatattaatattttttattggtaatactatatacggagaataatatgttttttaacttcaattgatggtgcatgccacttcttccatatttatctggtcagctcttctgttgccacatgcccaactatgcagactgctttagttaacttataatccttctatcttttgcagcggttcttctctgagaaataaacagatgttcaatttaatatgtgagcttccagaaacagttgcaaggacattggttccgaggatgcgagttgtgaaaggaagtggaaaggcgataaactacttgacaccaccaaggatcttgcttgccttggttactgcatgggttcgccgaggccgatggtttgatgaagaggtatgtttcttctctatgcagctagtacttttcagctttaccttttatttcagcaatgccagtatatgaaatatgctgaattcctgcagaagccatgcgtgcaaacatgattgttgttttcattattatgcatcttgcatgcacttttcatgatattgaacctcaagacttttgagctattatgcttctgaaatagtgaaatatacatttctagagaaagagtaccaagctcttctaccgttgcaccaaatgtatatgaaactcattgttgaatataaagaacaatggacatagactattcaaattatgcctgtggtgattttcttgtaaattatgctaaataagcagtattcgttctaagactggatcaaccaggcgagtcagatcataatgaagcttgagaccagtgtccagttctgtcaggtctctacataagtaagagccataaatagggtctgtcttgatggttcagtttccaggttcattatgaccagctcagtccatcacctttactgctagttggccagagctcttctggaaggccttaggctggtcctcccctcaatggcggcttcaaacacctggttccaccatggcttagctcggtccaacagtctcagtgctattgtttgtactgcatgttaaatatgacatagttaattctcacatgtattgctggatctcacctagtccacatgaaatccagcaacagatttaactggagagaatgataggggttttaaaaagcaactgcacccgtcaaatgattgcactctagtaatattttggggctgaaatgggcacaagtatacatattgacgttttttttggtatctcactggtttattggctgtgattttgggaaagaaaatcacctgcaaattttggtaccgtcgaagcttctcaccattagattgacaattattaatggaaaaactgaatgaacacatgtattattttcgcaagatatttaggaaacatgacatttgagaaaaaaaaatgctgagaagtgggtaataatttaattataacgtttgtgttccttcagaatctttcacaatataactgaagaaaagtgctgtatacatcagtgtcttttgtgatggacaatgctccaatcatcctatgtgcaaggttgaaaatcaaacagatgaagtaaaagaatattatattcttacaaatgagagatcagcataccaagcgactttatgcatacttcacagttcataatactttcagtctgatgattaattcatgtgaatgtgtgactgatcataagcacattgcagggaagagcagtatatgcagcagaggctgatagaatccgtaattgggctgaaagtcgagcacgcttctctttcacagatgccatggagatgtacacagaaaacacatgggtttctgtgttctcgctctctgtcgtctgcgcattcataattctttccagctcaggtggacctcttccaggcacatgatcccaggagttgccaaactagatggctacacacaccatttttcttcagtacggggattctattatgtactgatatatgacacacgaaacttatgaaggggggaaattgaacccagaaagcttactgcgtacatacgcccaacggtgagaagcatcagctgccactcaccatttaaggtcaagctaaccatgtgctcagtaaaaatgggtaaatagcatttgttgtgtgggcattccactgtttgtaagctgacttgtaaaaacgtgtatctgagctaaactgagcacgaacagattcgatggacaatgttatctgctgtacatgcatgtagtaatgtagttttgatgactgtaattctctggtcgtcgcttccagttgcacggttgcaccgtatgttgcaaccaccaatagaactgaaagtaagtgagagtaatcaagccagcatctgctatgtatatatatgactcatcagtctgttatatatcacaaggaaagcttcttcaaagctaaaagcaaagctatcagtaagacagtaatcctgtgtttttgtccatttgaattcttgatcacaacaggggagattcagaagttgcattaaggtatactactactatcatttatgcagtttgttgcacctgcagccttgcagagtgatgattcttcttgatggggaagcaggacgttcacttcacctcgtacaaacaatgtacggatttctgtgtgcgagccattgtgagcaaggggctttcttttcttccaaaagtaaaatacaggctagtgcttttttcatgaaaaatatctgatggtgagtggagagtgcacacgctgatgagcagccgagccggagcatgcgttggcaacttttctgaactacaagctggagacgacgtgaggcttctttccgagagttgatagcagcgtgcacttccgaagttgggtgtcgatttctccctttttttctgctgagcaatggcaccttccattagttggagggtggaagcttccttcttgagtccgaggccccaatgtcaccaatcctgtctcttctgcattgttcgttgggagtataagacaatttaggggcggagctaaaacgaaatagagagatgtaccattcacttgctttactctactttaaatcaagtttaagctaatatgagtatttgagtttggattaaggaggtacatatatagtaaaaatagaaaaactatagctaaaaaaattttcttggccaggtttctgggcacccctctctcctacctagctctgcccctaagtgcattgcccgttcttctctactagtcaagttttaggttgaactttttttttaggggatagttttaggttgaactgatctatccatatatgccctttaattttccatcagcttaagcactggggttaaaataaaatatgcatgcaaactttgccttactaacacgcatttacttgcaattgcttagctgattgaaatctcactaaatctgctgctactttgattggattaaccaactacagacaagttgactgccctggccgggcagtgaacatggctggtacagtagtactcctcttggacctctgattgcagcttgctaccagcagcagccacggcggcgtttgttttgcatgtcaatgtttagagggtgtttggttgcgagccacactgctgtttactacatctaagattagatagatttaatcccattagcagctgtttgttgtagccatagctatgacaagattcttttctaataaactgagtctcacgtgtcattgacttagaaaaatgtaacaagattctcttagacttactaaggtgtggccaataatttaatcgcctcaacttagaccgtgtgacaatatttattgataaatgacaacaaagtatggttaggaaccaaacacacccttaattcacctagcaaagccacttcttggcctttttctttctagtcttcaatattgccatcatcatgtacatacatgccactgccagaccagtacagattattccaatgtggcgtggtgttcatcctgaacagtggctgatgtgccttgaggtcaatgatttttttggtttcttgacgcgactagacggtgtgagtgctctccaagattgaactcaaccgtccgatccacttgtgctgggagagggctccttttttgtggatggctttgcatgcaggatggagccatggaggaattcatgtagtcatgtattttatgtaagtggtctgtggagccctcaaggcaaaagaattattggagaataattttgcttgtcctcatggagaaatggtttgtcgcacatggacacggttagatctctcaatctagctttactatccaaccgtgcctccttcaatacacgggaatgttacaataatcggttcaatttttattggaattggtttccttttttatattttttaaataataaaaggtttattgaactcaatcaattatatcaagatgatacaaccatctgagactctcatgcataattaatatgcacaaagcggaatcgtacatccacacactaggtttcctccaaacaaaagagattactgaattttatatgaattttacaagaatcagttcaatttatatcggaactggagttctgaaaaggttgaagttgccaacttaccaccaaggaggcaaggacaaaattaacccattttaaaatcttaaagcaacagaaataaaatggatagagctaggcagagtagttgtacaatctattccacgacaagacgaatcccacactaattaagtcactgatttgaactagtatcacaaagggggattaggctaagttatccggcccggtgcgtcaccgcatcatattcatattcatatctcatatttaattggtggccgttatcatatgaggacatgatcgaggtttagcctttggaatgtttatccaaattccaaaacgatcaaaagatgttcatatggggcttgtctatagctgaaggcgatgtgcatgaatcagaatatacacaacacaacgcacgcgtggagtggagacagtggcatattcaagaaaaaaaataataggtgggtctgaacaacttagaacaaagttacagccctctcctatctacatgtggcaaaaaaaaatttgtgggggctttggtggtgttcttttcttctgaagatgatgatgatgattaagttttttacataaaacgaggtggtattaacgtatgattgattgagttttaactattataaacttaaaaatagattaatatgatattttagagcaactttcatatagaaagttttcacacaaaacataccgtttagtagtttgaaaaacgtgacatgaaaatcttaatcaatcatacgttaatacatccaactctagttggagaaaagaacagtgacctttatgagggctccaatagtactcacgtaagtagcggaggttcgagtcctcattgcgcccatgctaatccacccttgcgtggagatgatatattgcatcctgcatgaaatgaaatggcatatttttgatattgcgcgatgtgtgcatgcgtgcatggccagtgcaaagtcacacacacatgtgatgctgtgagcatgttgggggcagaaggatcgaaagcaacggccactgtcgaatctgcaacctttttatttttggcgtaatgttgtgtgatcttgtgtagagtttgcaccgagctattgctttgcaagatttgatgtcatgtttttggtataaaaaggtcgatgtaatatgtctttctttcttcccagggaaatttgaccatgcgtggaacataacgcattgggttatatgattatattttttttaaagaaaaggaaattgaaggtatagacaattatactacatataatcattgatatatatagttcgtggtatgttctggaaaatttgtgcacataaaaaaaatccgtttgttgacaataattaaaataacaattggggagatagacaacctatggtttgacgcagaaactattggagtaactaactaaactaatccataatcatgtatatagatatgcatcctctgcttttcatttcaataggtaggtaccttccgtccctctcttaaaggagaagaagcatgtgctgtccttggactatgctgctgaaaaaaaaaatcaatggcctggagcagaggtcatgagggaaatgtaccctacagatcagaattggcgtaataatgctgcaatggggcctacggtggctgaagcaaattaaatttcaataatttttactgatatgctaactgtatttttcagagaaattcagacatgaataatttgtggacaatagaatgtaaattcttgatgaaatgttaccgtggtttgattatattgtcttaggagactcaaaccattagaaatttagaactgtgcttggccatcagaattcacgtgctatgagtgctgagattcctgcatgttacctttgtgtcctacatgcatgatgaattgctcagataagatgatctttctaaaagaaaaaaaaatagttgatgattgccaaacatttccaatcattacaatgaacaaaatatttggaaggactatgatgcaggcaatgtggttaactcaattaatagagattttggttatcatgatcgaattcctttgagttagacatacatttggtttgtagccacaaccgcgatgaaaatattactttttttactatctaggtcccacgtgtcattaatgtgtaatggtgctgcgagattttcatctcgctggcaccgtgtcatgctgattatgataacctaaccaactcgagtttagacataataaatgtagcaaatttgggcaacttatatataaaccaaagacagtgacaatgttcacgagttttgtatgctaaacggtttggtcaatacgttgggctaccgatcatgccattcttttagggctcgttggtagagctcgaactcctaaattaacttcataagttaggtttagagttaaattgtggagcatcttaaacccagctccacatctctaatttattttgtgaaagcgcttcagctatatccattcttatttagatgaagttgaaactgtttgtctgagtttcaactctagaagagataaagttggagctggagccgtggcaaacatacccttagtttcaatttcgcagtaactatctaatcaattgatcatagtatttctgccaaaatcaaatgtggaaaacgagggcatcgactagcactctaccagtagcctgcaggacacacatttatgcataaaacctcccaacgggatttaatttgcaacacaaaacgtcattaatttggtgctgactttcagttgttccatatatttgctactcctacctgctgtcaatcttataagacatgcaagtaaacacagccacagaaacggtgtacagaagacaaatgcaattaatgattaactttgcttgcatacgcaccgattctagctagcttgaataagactgttagctatagtaagtaattgattaaagaataagagatcaaataaagcaaatatcaaccaatcatgcttcaaactcccatcataggctcgtagctgtatcaaccacatattaagatcaatcatagcttcattaaccatgtctacgtcatatcaaacaacactccaaatttaaccttgctagctagctgccataggcttgttgcgtagatcatctttggtgctgacacttgtatactatgtgcacacataggttgatggtttgtcaggttgtggtggtcacagaatctatattgtgactgtacatcagaccatataatcacaaaccgcgtacccgcgatacacgtgaggcctagagtaaaccacgctaacaaaatactacctttattttaaattatgaaacatgtaccattaatttaaaaaaatctgtatagcttaataacacgtgggttatattacgaaacttatttctccattccaaaataagttcttttttaagtaatcattatattgaagttagtaagaaatagttgcattgagattttataaagcaggggtattctagttctttattggtatgtgtgagatatgtaaaaaataaacttattttgaaacagagagaatatttgttatggtgaatctctaagagtttggaatctcattgtatggaactataataatttatcgaaattgatagtcaaatattaggacaacccagaacaacatgagtattttaattcaaaattatgtattttaaaaaatcgacatgccacagtaaaaaatagaaaaaataatgtgcctattgcttgaatcaccatttcccaggtatttgnnnnnnnnnnnnnnnnnnnnnnnnnnnnnnnnnnnnnnnnnnnnnnnnnnnnnnnnnnnnnnnnnnnnnnnnnna

SEQ ID NO: 43858 - DNA, 13422 bp, Oryza sativa
  unsure (1)..(13422): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagacatctcgtcgatgaggcaactgctactgtggccgttcctgcctccatcttccatgaatcacatctgacagacgttcacatggcgacatgaacccccaaggtcattgatttataggaagggcagcaacaaggagggaagggcgggtcgcaaacacatccccgcggccgtcgcatcactaccaccaccgacgcggagctagagaaggggtgaagcatattccgtatgcgctcgcccagcagcatgagcccttgtggtcatcgattaccgaggaggacggtgacagagagggggagggtgcgcgtcaagcattgcagctagtcactacgacactgtaggggtggataccgagctggctaggctcggctcgttatgctaaagagctaaaaccccggctcgtctcggcttgcctagaagctcgagctagctcgtttggctcgcgagccaatgcactcttgactagtcttcacttcaaaataacatcgaagtctcaaaaataacatctgatattataggagctgctagaaatgatttttgcaattgaataaaaataagcaactagcaaataaaattcttgacatgaattttttgtgcacatcagtttgaaatatgggaaattgaatccaataacacaaccagctacccgagatttaccagatctgaagcctggttaatttcctggatcaacgaaccaaaagatcaaccaaacaaaatcaccaaccaaatcgacaaggcagattggcagatcgacgatgatacagactagaggccaggagggaacgcagcagcggcgtgagcccacaaggggtagctgggacggttgatggtgccatgggatacatgcgccaggggaggagctcgagctgcttcctagtggcggtggcgctagggactgggggcgcgagatgccggtgttgggcagcggcgggcgagcggcgctggcgccctcggcaacgacactgggatgtgctgctcctgtgacctgcgggctgtggcgtagctagcggctgttctagagcaagggaagagaggctgggctgggcattggggttcgattttgctagatctttgtcaacagattttcacccccaatatttgtcgtttttctatccgtaggatttgcgccatgattcgtgcatttccctgtgtggatgagaccgtgtggcctgtgagcagatggcctgggagtcaatgtgggccaacccatgttaaattttggattccgcgctattatgtccgtaaccgttggttgtttcctcgctctctttctttattctcgctctttctctacatctctttctcctctttcttttctcttctcgttttctccgtcgagagagagagagagctcgccggcgagagagagcacgagcagctccccggcgggagagagagagcgcgcgcgctcgctgggggagacaactcgagagagagtgttttttgagtttcttccctgatttgctggcatcattagcttgtgttttggttttttcaatgtcaatagggctaggtttagaagattcgggtcaatacatgacgatttttttttgctcccaacgtatggatctgattcagaatcacttgttttagttttggaatccgtttaggttttggattccctaagtttttagttatagtttgattcagttcagtctagggtgttttgttactagtccattgtttgcaaacgaccagattcgatggtgttctatgtttttttttctaatccacgagggtttttgtatttttggttcgatttttcttcaggggtgttcatgttgggggttggattcaggggtatttgatggagttaaaggtttaattcgaggtggatttagggttttttctaatcacccagatagttgatcattttttggatccctgcatgaattttcttcagggagggggtcagattcatgagttgattatttttgctttgatttatgtgtgatttgaatatagtagggaagcatcattgcaactttatctgaatgttgcatttcactttcagtgattagttgactgatctgttaaactccttgcatgagtctgaatttttctgcatgtgaagcatttcgtttcagagatgatttatctgtcaactccctgcatatatctgaattcttatgcatctgaagaatttcgttttacatatgcatgctaactgaaccccaagtatgttttgtgttgccttctgcagcatatgaatcatttcgtttcagagatgtacggtttgatttcctagtatgctgagttgcttggttaaattaaacccaaacccctacatgcgttctgctttcttcagattgtattctactgtactatttggtttataaaattcctgtacatgttctgaactttttagtgctgatctaaatgagttagcagcaagccaatacctgaacttggtccctgttgctttgagaaattatgggctattggttgcatctgctctttcttctcttctgaacttttgttcattgtcaatcgctcgtaaatcgtaaatctgtttgaattggcgctatttctgaacttgggaacataattggcactatttctgaattgggaacaggggatagcacgctcgtaaatctatttgaattgtcagtattttttgaatcttggagcaggctattgcacagtttcagtcgacatgagctttttaaaatctcatacttcagcaaactgaaaaataatttggagggtttcagtctaatgttgatctaatgcatttcaatggtagcaaaaccaaggtcacttgggtgcctggaggtattcacatgcctgaaatatctgtatgattttttttcttctttattctgaatgacccatcgtcccatcccaatattgttcccatgttaattatgtgtggagcttgttagtcagttaactcatttgctgtgaaatttaatcgggaggctcaacaacaacaccctgtctggtccattcccttctggtccattcccttctgcatcagctaacttgtcacatcttgttgtcgagtgattttaatatatgtgcacagaagtttgagatatgtgcaaattatgtacaaaatttaatatatgggcaaatttgtacacaactggagatatgaccgtttggaccacaatgctctgttttttttatcctaggctctaatctaattgttgtgctttgttaaacaccacggtctgaagatgattttcacttgaggaaaatcttcagtccgttgtgacaaagtgactccttttctgaagaaattctttattttttgaagaaattcaagcatgcttgcagttttagcccagttacagtctatatgtattgtagttacatatgtaacttttgttatttctcactgtaactaactatagatatatagtccttgaaaatttatcaacgctacaatctctaatttgttgtatataattttatgctagattatattgtctgccaagatcattttatggtgcataatgctaggtgagcatgataactgacctttcaatgttttcttgcttcttatttctctggacaaaattttgtcactttcatatctctccgattgcatatcccctgatttttcagactgtaacccatcagaccctgcatgtttatattatttgtaacataatttagaacttgttataataggggaaaatatttaatgctgctgcatgagtactaaatttttttgaagaaattcaagcatgaaagctgttatagcctagttacagttcagatgtaatgtagttacatatgtaacttttcttatttctcactgtaactgactatagatagataggtctttagatttttcaaagccgccatctctaatatatgtgctagattaaattgtctgtcaaggtcaaatatggaccataatgctaggttatcatgattatgacctttagttgtcttcttgcttcttttttcatcagacgaaattaatgttatctctttcagatctctctgattatgtatccactgttacttgagatcgaattgtaacagaacctgcatagataggttatttgtaatataatttagataatgtatattagacaaaatttttttgaagaaattcaagcatgattgtagttacatcccagttacagtcaatatgtactgtagttacatatgtaacttctgttacttctcactgtaactggagatagatagtttttcaaaaaaaaaatcatgctttcatgtatacaaaattgtgctagattttatgactgacaagatcaaatttggtgcataatgctatctgtccattgttctgaccttcaagtgtcttcttgcttattaatttttctgagaaaattttgtcactttgacatctatttgactctgtattcactgttgcttgagcttctaatctatcaggcgttgcatgtttcaatcatttgtagtacaatttagaacaagtcataatagtaaaaaaatgttaatgctgttgcatgagtactgaattttttgaagaaattcaagcatgattgcagttaaagcccagttacagtcaatatgtactgtagttacatatgtaatttctgttatttctcactgtaactggatatagatatatagttctttaaaaatttatcatgctactatctctaatttgttgtatataaatttttgctagatgacattttctgacaagataaaaaatggtccataatgctaggtgagaatgattctcacctttaactgtcttcttgcttctcatttcttcagacacaattttgcttctcatttcatatccatctgattgtgtatctcctgatttttgagattgcaatatacctgaccctacatgattaggttatttgtaatataatttagaacattttgtcataggcaaaaaaaaagttagtgcatgagcactgaatttttttttaaaaaaatcaaaggatgattccagttataacccagttactgttcaaatgtactgtagttacatctgtaacttttgttatttctcactgtaactgaccgtagataaatagttctttatatatttgtaacataatttagagcttgttatactaggggaaagtgttttaatgttgctgcatgaatactgaatttttaaagaaatttaagaatgattccatttacaacccagttacagttagatgtacagtagttacatctgtaacttttgttatttctcactgtaactgactatagatagatagctctttatatatttgtaacataatttagagtttgttataattggggaaatgttttaatgtcgcagtataagtactgaattttttaagaaatttaagaatgattccatttacagcccagttacagtttagatgtactgtagttatatatgtaacttttgttatttgtaactgtaactgactatagattgatagtttttgttacgagtttttctgaaaaagttacatacttttaactacttgatctaaagaaatttcctattccaagcacttttctccaaaagaaattcactattccaagtgcttttctccaatatttttacagaactgagttgtttttgtttgatttaaaagatgactggcagaatatggtgaagtcaatggggaaaggtaaaggtggattttgtgctaggtaatttgttacctggaagattatgtcttgttgatttcaacttcttgacctcaatgttcttggtaagaatttgcttcttcttctttttctcgttctcctcactgtctatggcgtgctcgatttgttttgctcgatctaggggatttgtgcgaactggtgtggtctccctgtgttattttgtttttttctaacctttattggatgtgaagttgatcattatgggccatgatgtatttgcagttatggcctgtataattttttgtattgttctatgggctagaattcgagcccatgtagttttgtgatctgactagtcagagaaaaaaatatgtagcattttttgtgtcctctggatcttaatctaacggtagaaaaaaatctgggtgattttgacccaaggatttgtcgacaaagacatagctagttccatatgggcttgtgggttgggctatcattggctcgtgagcaactcgcgagccaattcgagctagctcgttatctttaacgagctaaattgtcagctcgtctcgttagaaaaacacaatgagccgagccaaccaagtgccgagcgagctaacgagccacgagtttttttttgtccacccttacaacacagagttagaggcggggcgaagctcatcctgatccgttgtcattgcctaggctttaggaaggatgtggatgctagcatcaagttcccatcactggctctgcctctcccgatgcaggtgtccattgcttggcactagacactgcctcatcgcactcggctcctccggtgcctctttgccctcgacaccagtttcacagatcgatcggtccctggggcactggcaaggggtggtggtggtggcactgctcggtgccgacggtgggggatgtggtcgtgacatggttgtgtgcggtggaggtggtgaggtgcggccacactcaagcggagaaaatgagataagaacgaaagaagcagatagaagattgacaaaggacctatgatatgagttaaccaggtcaaaatgcctcttaggatgaaacaagcttcaaaacaaaaactgtccactgtggtaaattgatttggttttaatagttgagggatatctttttgagaaaatttcttacatgccactcaaaattactcatttcctttaaaagccattgaaaattctacgtttccttttatgcccactgagttttagttttcatccctttgataccaccaccgtcaagtcagttgaccctagctcccgttaagtgagttaacatgttagatttttcttcctatatctgttttaccctcactcttctgtccatgctatcactaattaacgatctgaaatgcgcctagcactctcttcatccttggactcccagcgaatcaagatgattagttaaatgaatgcaagctaaaatcaagaataattaaatgtgtgccgatagttaattcatggtctagtatatatgtgcccttgatgcaaattaaatgtgtgccaatggttacatcaaatgactgcaagcttgcaatcaaggataattaaatgtgtgcctacagttaattacggaagcttgttcagcagagcctgtggaggtggttcaccgatattagcaacctctctggtatgcatggagaggagcagacgatgtcacacaatagtgggagtgtgggactacaggagctagctcagttagtgtctcggtgatggaatatgcacgatggtgaaaagaacagaaacgagagtgagaggaacctgagaaaaaacagagggaacaagggcactagtgtcttttcatggcctacttaacaccaacttaacagtagtctaacagtagtggcactaaagagataaaaattgaaacccaacggcatagaaggaaatgtaactttttcggtagcatatatggaagccgggtaatttcgagtggcatataatagattctctctatctttttacatggttttgtagttcaaaggatacgaatcaaacttggctaaaattggacttgaatccagccgaatcaggtctgtttccttagctaaacataatggcccatccaccatgcaaagtgggccgcccaggattcgaaggccgacgaccatggcatatccgaaaggaataagttcatttgaggtccgttgacttgtcaatgaatccgattttcgtccctcaaacggaaaatcagacataacgagtccctcaactctcaaaaccggcgcaaattaggtccctcggcggttttgagggtggttttggctgacgtggcgcctacatggccaatttgactcggtcttcgtttgacgtggcgcttacgtggcaattctatcggaaaaaataataaaacccgtgggacccacatgttagtttcacattaaaaaatggtgggacccacgtgaggcccacctgtcatactcccagccctcctcttcttcctcatttctccatctctctcccctctcctccctcctctcgcagtctcgccggccggcggagataacgacggcttggagaggcgcagcctcctccacttccgccccctcgggcctattgccggcagccgctgggaaagaagcagcacacgagcgtcagccggagggaggagaggagcggtgcgcaggcgcgggcgtgggcgccggccggagggaggagaggaccggcgcgtgcactcggccggcggaaggagaggagacgcgggcggaggccgaggggagcgggagaaatccgcgacgcgctccgcgtccacatgctctctcacggcgccccacgcccccaccgattcaccacctacctcgtcacgtgcgtcaaccaccgcctcctccactcgccaccaacgccttctcatcctcgagggcgatggcggggtcgagaggctcctcgacctcctcgacgcggctgacgccgccgtcgatgcgcgggcagcgcttgagcgcgaggatggcgcggtcgtcgaggccgtagagatggacacggagcgcggcggtggtgcggcggaggcggggcgtgaggaaggaggagaggcggaggtgcgcggcggagacggggcgcgaggaaggagaggcgacggtgcgcggcggcgtcggggaggcggagcttgatctcgacctccatcacggggggcagggaggagaggggaggctagggtttggggttgcaattgggattggtagggaggccgatgcggtgggacttggagggcgcggcgccgggcggtgggtggaggaggaggttggagttggagggcggcggggtcgtggtcggagtggatgaggcggtgggggtgctggccgccgccgcggtggcggtggcaacgcagaggtggtcttcgagctcgtcacgatcgaaggtggtcttcgcgcgccgccgctccagccgccgtctccccacttcgcccgctgccccagtgcacatcgtgaaaaagagagagaggataacgggaagaagatgagggatgggaggatgacatgtggggcccacgtgggtcccaccattttttttattattattttgtatgtgaaacagacatgtgggtcccacagggtttattattttttcggatcaaattgccacgtaagtgccatgtcatatgaagaccgagtcgaatttgccacgtaggcgccacgtcagccaaaaccgccatctaaaccgccgagggaccttatctgcaccggttttaatagttgagggacctgttgtatctggttttccggttgaaggatgaaaatcggattcgttgacaagttaagggacctcagacgaacttattcctatccgaaatttctctctttgttgtatgttactagtaggttggatgaatattggtaagagaggagacccatatttctcacctactactttcgctggccggttatacgaaacaacattggtgcgctgcctgcgctgcttctagggaaacacttgacgaaaatgattggtaaaagtatgggcaaccttctccctagtttgcaccaacagcaagacgaaaggaaaaacagagacttatatcaagatgatacacgcactgaattttctgcgccgaaaccagtccgcgatagtccaataccgaggacgctcctcgctttctgttgcaatgtttgccaaaaaaaaaaaaagagaagagagcaccaaacacaatttgtttatctactggagtgaacaacagaacaacgtcgctaaatttcttgttaggaagaatggccaagaaggcaagaagtatgaacaagagcaatgaattttatttccccttgttgaattcaaaaacttgagagacttaaacttgggccgacaagggaagcaacgccacacggctcgtgtgaagtgcacatatatatacacgatggcgccaaacacatttctcaactcaccaggcgcaccgcaccatttctaaatcacatagtgctaaacccgccccctcttaattatatctccacttagcaaggtgtgtggttgcgagcttaaaacgcacccacgcagggccatggcgaccgatggcggcgtgttgcagctgcacccctacgccatggccgcggctgccgtggcattggcttcggcgtacatggtgtggttctgggcgctgtcgcggcggctgtccgggccacggatgtggccgctcgtcggcagcctacccagcgtcgtgctgaaccgggcgcgggtgcacgactggatcgccgacaacctgcgcgccacgggtgacgccgcgacgtaccagacgtgcatcctgcctctgccattcctggcgcggcggcaggggctggtgacggtgacgtgcaacccgcggaaccttgagcacatcctgcgcgcgcgcttcgacaactaccccaagggccccatgtggcaggcatcgttccacgacctcctcggccagggcatcttcaactccgacggcgagacgtggctgatccagcgaaagacggcagccctcgagttcaccacccggacgttgcgccaggccatggcacgctgggccaaccgctccatcaagtaccgcctgtggcgtatcctcgacgaccactgcaacgcggccgcaagcgtggacctccaggacctcctcctgcgcctcaccttcgataacatctgcggcctcaccttcggcaaggacccagagacgctgtcccccggcttgccggagaaccccttcgccaacgcttttgacgaggccaccgaggcgacgatgcagaggttcctgttcccgagcttgttgtggcgcatcaagaaggcgttcggtgtcggcagcgagcggagcctccgcgacagcctcgccgtggtggaccgtcacatgacggagaccatcgcggcacgcaaggcgacgccgtcggacgacctgctgtcccggttcatgaagaagcgcgacagcaagggcaaagcgttcccggaggacgtgctccagtggatcgcgctcaacttcgtgctcgccgggcgcgacacgtcgtccgtcgcgctcagctggttcttctggactctcatgcagaggcgggacgtggagcgcaaggtggtcctcgagatcgcctccgttctcagggagacgcgcggggacgacacggcgaggtggacggaggagcctctaaacttcgacgagctggagcgactggtgtacctcaaggcggcattgacggagacgctgcggctgtacccgtctgtgccgcaggattccaagtacgtcgtggcggacgacgtgctgcccgacggcacagtggtgccggccggctcggcgatcacctactccatctactcagtgggaagaatggagagcatatgggggaaggactgcgcagagttccggccggagcggtggctatcggccgacggcagccgcttcgagcctgtcaaggacgcgtaccgcttcgtggcgttcaacggcgggccgcgaacgtgcctcggcaaggacctggcctacctgcagatgaaatccatcgcgtccgccgtgctgctgcgcaactcggtggagctcgtgccggggcacaaggtggagcagaagatgtcgctgacgcttttcatgaagaatggactgcgagtgcacgtcaagccgagggacattgccagctacgtcgagccgtcggagccggcgccgccgcagggctccctcgtgataccgactaccaccgcagccgctgcgtagcccagcgtacgcgcccacatgaattgcgtctgattcctgctgcctggtgaggttgtcctgcttgtgccaaaatgattgtctttttccttttcacaattctcctgcactagagatcgaatttccttgcgtacaattaggattgttcgtgcctggggtcatattggttgtatggataccgacgtgtgtgatagtgtgatcagggtgagggtggtgtacttttgttgggatctattatattattaaaacaactttgtggggactagaaattcccacattaatcagagaaaaagaaaaaaaagaaaaggagagtccaagtagaaaatacaatctaaaaatagctgaaattcggaattaaaaataagcaatattaaaaaaagtttccatataagaacccaatacgagattaatcaaaattcgaaataaaaataaaataaaatccaaaattaggaaaaaaagagagtccaagtagaaatacaatttaaaaatagatgaaattcggaattaaaaataagcaatattgaaagaagtttccatgtaagaacccaatacgagattaatcaaaattcaaaataaaaataaaataaaatccaaaattagaaaaggaagggagagtccaagtaggaatacaatttaaaaatagctgaaattcggaattaaaaacaagcaatattgaaagaattttccatataagaacccaatacaagattaatcaaaattggaaataaaaataaaataaaatctaaaattagaaaaggaaatgagagtccaagtaggaatacaatttaaaaatagctgaaattcgttattaaaaataaggaacattaaaagaagagttcatataagaacccaatacacgagattaattaaaatttggaataaaaataaattaagtaacaggcctataaatgagtagagtggtggcggttgatacgacatataaaaattgttaataaaacatcaaatagaatcctactgacgattaaaaaggagggacgtcaggcaggccgtgaagtgtcacgccccgaactagtcccgaccggaactagcccgtgacgctccaaattaacctgttaatcgataccagtcctaggaaacagtgttggtatcacagggagacagagtatcacagcaacagaggtctctttattatagagtagaagtacagtcatgttgggctgcgggcagatcccgagctcacaactgcattacaaaaggaaagcggaagccaggacttggaccaatcatcacaggtgcgacttgggaactaggccgaaaccctaaaactcatcgtagccggcttgctcctggaagaactcctcgtcagcaggatccacttcatcttcttcagcaactaggtggggattatttatatggagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacattggatgagacagtgcgtttcgtccggtcggagtatgtgcaatgtgtcagtctttaagattggaacaaggttggcacccggcc

SEQ ID NO: 43859 - DNA, 27540 bp, Oryza sativa
aggatagggatgacaggtgggccccacccgtcagcgagggttgcgggcggacccgcccgtcagcggcgcgcgcgcggggagaggccgagtgggccgcggggaggaggagagagagggagggagatgggccgagccggcccaagaggggaagggggaaaaaaggactttttagggtttttcttttcataaaacctttttaactttgtttatttcttaataattattatttgtgctctgaaaattcaagtaaaatttgagggctccttttagaccaaggagaatttaacaaaaattctccgggccgcatttgaatttttcttgtacgtattttagtgtttgccaatttcttttcaaattttaattaattctattattccttttagcgaatgatttttaattcgggatgaatttatcaggacgtgacactggctcaactctaccatcctcaaaaccaaagcgggctggtgcacgagctgcacggcggggacggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagtcggctcctcagtcgaagaaacgtcgatcgactgacgcgaagggaccggcggaacctgtcgagggccggcagcagcacgggccgctggcggtgggggagctgggtagtggaaacggaacacggtggaagaaccaacaacacgcttccgcgcggtgcggataaagcgtaggccacggcgggaggaagcaactgggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtggcagaggcggcctgagtcccaagagatagtgtcaactaaggtgacaccctcctcggccagacgggcctccaaagcggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaaggcgtggaagctgccggaaggcggaacctccgagacggtggctgtagtcgtgggccaggcgacaaagcgcagtccaggagaggtcctggtacgcgatctggagagtgggcctggccacagtgaagtggtgggggcgaaggccagctccgtgtatacctccacgggggtaaaggtacaccgagagctcacagtgagggggaacacggtccacggagtaccccgtgtactcgggacacgagaagccaaggaaacgggagaggtctcgaagctgagcgacgtggtgaccctcaccaaaaccgtgggaactgaagctggcgttccctgccatctacaattttgaaagagggagaaagatcagtaaccgttttagaaacaaactattgaaaataaagaaaacaaaagaaaccttagcttttcgcaagtagttttgaacttagtatccttagggtcgtcctaagcgtcgggtttcgccctagggccaagcctgtgctctaataccatctcttgtcacgccccgaactagtcccgaccggaactagcccgtgacgctccaaattaacctcttaatcgataccagtcccaggaaacagtgctggtatcacagggagacagagtatcacagcaacagaggtctctttattatagagtagaagtacagtcatgttgggctgcgggcagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactggggggggattatttatatggagcaagggtgagtacgggagtactcagcaagccaggggaaataagtgtttaatgcaggcttcaaggaaaggctgttattttcgtaattgattttgtttgaactcttttctaaaaagtctaagtgagtgcttctcaaacgacacggatgagacagtgcgtctcgtccagtcggagtatgtgcaatgtgtcagtctttaggattgcaacaaggttggcacccggccaacagcttttcaaacggccacccgggccaacaacttttcaaacggccacctgggcctagctgatcccatcagctgcagatttttcaaacatcgaaccccttttcacaacagcaatttcacaagcagtaatcaaacaaaactacgctaggaatcacctcacatccgcccatgaccgtgggcacggctgttcgagcagtttgttaacctctgcagagggggtacactttacccacacgacattactaacccagatcacccagcccgtggggatcagccacgtcgggagacccccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaagggaatcggtccttaagtgcgagagcgggaaaccgtacacccggtacgttcccctgtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggcgcaactgggtggttacaaggggacatggtataacagttaacaaaggaaggatcaaatgtaacaaattaggtaggtctgccaatctgccttgcagacgggacaacagattaagtgtgatcctatcaatgcataatatttcgcaagcaatataattaaattccaaatataggctcaagatgttcaaaggtggcttgccttgctcgagatccggagcttgatcctcgaaatcctcgcactgcgggtctttgggctccgaaactacacgcgaaatgggacaactcaacaaacggcgaaaataaagccctattaatgacctctaagcgtgccattagatagatctcgagatttgaggaattttggaagttgaacggagtcaatcggatttacggttgggaagatattgaatttctaagattattggatttttggtctaaaggaaaaaggatttatttaaatccttttttggaaaagaaaaagaaaagaagggagggagggaatatagacttttctcggacggctagggcgcggcctaagagaaatggagcggtctggccgagctaaatgggccggccggcccaaggcggcccaaactcgcgcgcgcgcgggagggaggagagagagagccggtggaccgggctcaccacgcgcggtcccgggtgggacccgcttgtcagcggctcggctcaccgtgcggagggagcacgcgacgcacgcgcgcgggtggggaagggacgcggtgcatgcgcgcggtccgcggtggacgcagctgcggcgggcccacgcgcagcctcacggctcgcggtggaacgcgcgcacggggagggactgaccggggtcggctcgatccggtctaggctgagctggcgccgacgtggcgcctacgtggctgccacgcggtccggcgggaggtagacgacgacccggccgcgaatggacggcggacggcggtggcgagcggcggagcgaaccacggtgatacgggcaaaagcgtgcacaccgggcggttgcacgtgacaaggggagacgagccaacggctcggattcgccggaggttgctcgacggcggcgggagaagagggaaacggcgacgaggtcacgagagaccgattcccggcggtgagagcatccacgcgaccacgggaatctgatgctagcgtcggattggacggagctacgccgagcgaggctggcgacgtgcgggtgctacggagctcgagcggcgatggcggcgagcacgcggcgagcgacggcaacggtcggggcggcgccggctagctacggggagtctactcgagctactaccgtaagctagggggaggagatggggcgaggaggaagaacggagggaggcatcaccgagatgaggaggggcgctgtgacgagaggccgacggcgcgggagtaatctctccggcctcgggccggggaagaggaaggagagggcgcggccgaagtccccttccgcgtccttgctcgtgccgactccttcgacacgcgcaacaacgaacggcgacggcgaacagagcacgggggcggcagctatggcgaggaggcgaaaacgagggagattggaggggaaggagctggggtttaaagggggcggcaatgtcggtttgggaaccgacttagggcggtcaaggcgtgagctggcgctcggcggtcgcggccaaagcggcgacagggaggatgacgccggcgggggaaaaaggggaaaaaggagggggagaaaggggcttgcccttttgccgattcgggaaaaaggaggaggggagcgggggcgacgcggcagagggaggaggggcgctgcctccgtcccttggcggcttgcgcgcgtaggggcgggggccgggcaatgacgacggcgatgacggcggtgcggtttggagcggagcggcgacactggcgacaggcgcgtgcagaggctgacggcggcggcgaccgggcggtcggccaccacggcacgcgcgtgcgggaagcaacgagtggcgtccgcgcgggcgcgcacacgctggctcgcgaggacgagcggctgcgcggctgcaggcgcggcagagcgagaggaaagggagggggcgctcggcgcgcgcggcgtgcgggcgaggccgagcggggggggggagagatgggagagcgcgagagagagagagagagagagagagagagagagcgcccggggagagagggggccggggaagaggggaagatgggccgagcgagattcggcccatcgacctcgggggaggcaaaatagacttttgcggaggaatttgattggaaggatttggattcggaattgaactcgacgatagatcggggattgagatcttgagatggcacggacaatagacaacaagcaaagaaacaaatttcgcaattagggtttttaagagataattttcccgctaggcgccaagacggaacgggcgctacatgaagcaaacgagtaaggcggttgctgggacttcttagacagtaaaaaaacaaactgcattgataatcgtattcgatttttaaaatctcaatgataataaaaaggagaagcagcgggcggggtgtataagagtatagttgcagagccaccgacggttcacgggacttctagaaaataaaaaatgaattccaacgatagttatgttcgatttttagaatcacaatgacaataaagaagtaggcggcgaacatgctgtagaggggtatagtggcattgtttgataggacttctaaaaattataaaaaatgaaactataagttatgttcgattttaaaatctcaatgacaataaagaatgaattccaacgatagttatgtctcaatgacaataaagaaggtaggcagcgggtgagccgtagaggagtacaatggcaaagctactgacggtttggcaggacttctagaaaataaaaatgaacccaaacgataattatgttcgatttttaaaatctcaataacaataaagagtagagacaatggatggcccgtagaggagtataatggcaacgtttgacgggacatctagaaattataaaaataaaacccaacatgacaataaactctaaaaactataaaatccaatttttaaaggttccaagaagaatgaataaaaatagtggtagatcgagcaagcaaataaagaagaagatgatataaggggtagcaactggtgtgacttttaaaaaatatataattagaaacacgaggatgataaggtttggtctttcaaagtcttaagacaatgagatagctattaataaattttaagtaaaatcatacttaaaaaaaatatatgattttgtttgggtgctagccgcgcaattacgcgggccacccagctagttatattgaatggagactggagtaatggacattacaatggaacttgcgctttgcaaccgcatgcatccgtaatccgtttgaggcagtcttgcacgagcatattcccttgcacatcccactcaaaattttcacagacagtttcaagaaattagaagaataatacaacactgatacaaaagtgcatatcatatatcagaaatttcaagtccaaacaccttctacacataaaaagaaacagattcagctgaatctgataatgaggttaaccggccatgtacaatagcagggatgcaaaaggagaagattcagatggatagtgatcatatatgccatatttttaaagtgggttctgagtggatgcagattatttccgatgtcggaaatgatgcggagtcgatgcaagctcggttcggaaatggattaaaattgtcaaatattacatgtatatgcattcaatacaacatcaagttagtaatgcaatgcacaataatgcaataactgtttcgttgtttcatttgttatacatttttttctgtacgtacaaagtttgtacatataaatttaaaatgaatttaaaaattaattcggaaaaaatgaaaggtattgactatgaggcccttgtgcttgtattacagctctattaatattcagcctgctcaaaaacagaggaagacaaaccagaaaaaaagaaaaatagaccacccgcaaacaagtccaatgacgaaaatccacgcgtccgaaaattagcaacgggccaaaaaggaaggaaaaaagctaatcgtgctattagcattttcgcaatcctttctaatccctccccctagcttggggattgtctgaacaagtcctaaagactaggtcaatgtaccacataggtgctacataggataaaaacatcgcccacaccgctaagaaaggaaaaatgagccggtttcgatagtggagggagtctttgggtctatttggcagggctccaactcttaaatttgtcgagatctcaagttgcacgtacctgtgcccctttacgctaatcacgtgtaatcacaattagcataaacagtgacatttctactaaattagtaggcaatacatagtcgacttgaaagttttaactttagagttgaaagttaagttttgaattgaaagttttgaattttggagttgaaagtttcaaaacttatgttgaaagttttgaacttttgaattgaatttttcaaattttggagttgaaagttttaaattttgagttgaaagttttaaatcttacttgaaatattcaaaaagtttacttgaaagatttaaattttaagttgaattttttaaattttggagttgaaagctttggattttgaggcaaaagtttcaaattttgagttgtttaaaatttgaattgacagttttgaaatttttatttgaaagttttgacatttgagttaaatattttaaagttttaagttgagtgtttcaaaagtcgggttaaaagtttcaaattcaagttgaaaattcaaattatgctttttttcctctaaattttgagtttaaagttataaatttagcacataactaatccatggttataaaaaactatccacgtggagacattaattacttgatgctaatcataatattggttatggactctgaatctgacagcggcccacaaggctcagcaagagcaagcgcgcttgtgcgcgagcaatgcttatggcacacgagcgcgaaataggaaaatcggttgtggatatgtctaaacactacttcatctttctagtttattttgtgagaacacttcagctactccactctctttttaagtagcgctgaaactgtttggctgaacttgtattccaggagacgttgagctagagctatgccaaacaaactttagaagaggttgagatagagttctgtcaaacatgcctttatattatttttacggttatatctgattccggcaatagttgagagcatcataatggactttttccctgcacaaaaggccatatcctgtttgttactactctaatattggcttactttcttcggcctatcaaactgttcggcccatacgaggggagaaattaaaacgagaaatcgcatactgatttgcacaaaagagcctgttgcaaatattgtattagcaattaagttctatctggttcgatacttggatactttctccgtttcacaatgtaagtcattctagcatttcccacattcatattgatgttaatgaatttagatagatatatgtctaaattcattaacatcaagtctaaattcattaacatcaatatgaatatgagaaatgatagaatgacttacattgtgaaatggagggagtaacattttaaaatggaagtacttttcttcaatatagagatacctcctgacgttaaacatgtgtatgagtatctctatctattaaagctagaagatacctattaaagaagtgcaaaagaattctttccaaggagatccttctcggaaacaatatgtaatttaccaacttcttgaaaaacaacaataaatcgtaaacaatagatagaagccatgagtgacactagtcggctgggcgaatacggagtactccgatcgataggaggctgtgactcgctagttcttttccttctccttgttcttggaagggacgcggccgtcggtcccggcgagtatgctgtacttctccttgcgcgttatggcggtgcactcgaagccgagctggccgctgagcgtcttctggatgtagttggccacctcgatgggcgacttgccgccgctgcaagtgagctccttgggcagctggttcaggaaggtgatctcgtacgtcggccgcgggttcatgaagaagaagtaggggtccatgagcttgaagccccgcacggtggagccgtggaacatgctctccttggtgttgatcgccaccggcacgatgcggtcggtgagctcggcgaagagcgcgctgaaccgcagcaggaacggctcgcggcaggtggtgccctcggggcagatcaccaggtcgccctcctccagcagccgccggatgttctcggcgtccttctcgcgctcccgcgacagcgcgacggccttgatcggcgagatgagctccgagaacttggagatgctgtacgtgacgcagctgaccttgcggcgcagcgccacggcgacctcaaccgggtcgagcacggtgcggtggttgcagacgaagaggacgccaggatgtcccttcttggggggaggcggcgggttgcccttcacgatgaggcggatgcccatgagcttgtaggtgtagaagacgatccgctccgggagtggcaggttgacgtacacgcggaggagcgcgagcgcgaagccgaacggcatccacaggaaggtgacgagcgccaccagcggcgtcggacgctgcacgaggcggccgtcgtggaggatgagtgggctcagcagctggttcttgggcaccgcgctgtacttccttgatgtcacgaggtaggcctcctgcacagacacgcagcatgcatgttacaaacacttcactgatgcaaaaatcacagcatcaccatcacttcttattttatcgaatatataaatgcttgttcatctcgccatgtacgccaaacctacatcctaccacgattacaattcagtacagtccactactgatggttccacagatgacagatcttcacatgcttaatcaaaattatgttttttcggagttaaactgttggatttaagttgacgtgtatcagccaatcaataggcgagagtagaccagagcagtggtaaagaagtacagcgattactgtaccgcaacaactgcaagactggcgcccataaatgggtgatttcccctccacgagagaaattcgttatacccccggggcagtgacagaaagacgggtcccatggagaagggaaagaaggggcaagaccatgaatggcagtatttatttcagtggttctctgcattaccggctggaagaaaggaagaaagaaagggaaagcaagggcagccgtggatctggcaggcacagccagcaccagctctgatgtctcacgcgccagccggccgatctccttcaatgcggccgggacaaggcttgaattctcaccaaacaaccgtaaataatggagccagccagccggccggacggactgactcgaccgtggcatactggcatgagtgaatccacgcattcaatccggcgggccacgggcgagtaaaaaccatcggcttccttccatgctctggctctgcccgcctccagattccttttctgatcatttgctcgagctttcgagttgttaagcttcaggtgaggatctagtatgtgcgacgtagacgttttgtgagttctgataatgaccttgatccttattattagtttactgattaaggatgttggtggaacagagcgaccggtcagtgcaggaagcttaaactgggtttcgcataatgggctgagcaacatctacagatcagtgtcataaatggcctgacaatgactatacacccctgctgttcgcgtgctcgaccactgtggcatactctactctgatctgaaaccactctactctgatctgaaacctctgcatgtttgtacagattgcagaatttatagtaggcggtgttcatagcttcgtcatagcaaaaatcaattgtaactgatgtgctaattccacgttatgaaagtaatatgtgtgatggagactatacttaattccaattttcatgtttcttgtttggaatgcagtaattccgaaataaacagagcattctatacggaatttatgtacaagatggtctaaccagttcgtagttgccagtaattggcagtgctactactaattcgtcgcaggacttgatcactgcaattaacaatcaacacgacagtactattactatgagcaaaaaatgagtttgagggggcgtcaaatttaccttgcatatggacatgaagtcgaaatccgtctccctgtcgcccaagccgacgtcgggcaccgcgtcgcgtagctccttgacgacggcctgcctcttgtggtcgcccacgagcactccgggcttcaccatgaaccccgtggccttgccgttcttgccgacctccagctccgtcccgaccaccttgtcggcgccgaggaacgtcttggcgaagtgctccaccatgatcctggggctcgccgtgatgatgtaccgcttgccgaaggagttgaacaccctccagctctccgggtgcacgtcctccgcgtagaacttgggcagcaccgaccgcgccaccatctcgatgttcctcaccttgagccccgccacggagatgtacaccagcgtgctgatggccagcgactcggagaagaaaatgtaggtcacgtagacgaacggcacggacagcagcagcacgacggcgcggagcacgctgccggcctcgagcgcgacgaggaggtagtacgggaaggcgctccgcgacctgaccagcgtgccgtcgaagtcggcggccaccgtctgctccgacctcccatccgagctgcactcctccacgggcttgaacctccgcgacaccatcgtcgtcgtgccgggcgtctcgatggatctcaccaggagatggcagctagcgatgcgaccgctaggtgctcgctgatggtgtgggagtggagtggagcagcgggagagggagttaatatatccaaggttggttgtgacatgggaaggggaggcggagacggtgtataattgcaggcttagctcgcagctaacttaagaggctattacttccagagagcgacactagtgcgatcgatgctgctagcttcacgtaacgtagtgggttttcttgactggtgcagtctaacacgcaggaggtaatccctgcggtaagctacgtaaacaacagcaaaaacatgttttctcacccaaaatgttgaattcatacatgggacggacaagttgcagcatcacattttcacgtgatagataccggcaatgtctctgcctttctggcgtgtctgcaattcccttttccccgtgcatcgcatcccaactgttctatccaccaaaggaaaacgctcacagttttacaagggtaaagtgcagcatgcagcgttgggcgattaccattggctttaataaccgagttggaatagttggttgggagttagcttcttcacagagctcgcccattgattagcacggccacggcgtacgtagccactcgttaccttcgtcatggagcaggtgcaagagtcaaccaagtaccagacagctgaaacagcaggctcatcacaaccacaatagaatcacatgctcaatactcctcacggtatgatttcaagatctcctataggccggacgccagagtggacaggaaaagaagatggtattcttttttcgtttctgctgcatccagtgtgtataagtagtgtagcagtgaatgctgaatttttactgaatgctggggatgtaaccggatggtgatagaaatggatatcaggggtatactaccttattagttgcatatagtaggtactcccccgatcctaaaatataagggattttagggattttcatgtagcctaaccatctaattattagggatcgaaactaaattagttaccaatggcgacaacattttaggaacagaggcagtataaagtctacacaagtcatgatgttttatgatacatttgtaaaaccaacagagtaaagacgtggtcggttagacaaacactagtatttgcattgtttactccaaaattgtaatagtaatagtagtacagtaaaacgcaaaccaccatcaattttcctcaaaattaatcttcagtgtaaaaaaacattattgcatcccgaatttgaaacaattgagagaagcatgacagttagataacatgtttccttaaccataacaatggaacaagttataatgaatacaagttttagttttccaagcaacttaaaatcaagcgcagcgcattacagcaactgtatctgtactaggccatttctatatagatgatggatgaaactgagtttatgacaattatttggggcacaaacaaatgaatttaatattagaaagtggaaattttgttgcaaaaatttctcaaagaaattatgatgaagaaagtcttttgcaaaaaacataccatttaggatcttgggaatccgtcaacgattagctcaaaagaataggcctccataagctgaaataagtaaaacatacctgcagaaaataatagggaataattgaaaaataaaattcaaggaacactactacaatgctcaaaagagttcttttctctcataataccgtgatacttacaggtctcgcggctgaacagatcctttgcggcagaatgtgcacaaaggcaaacttcaacgtctcattcaacaaccgtcgttgtttctgatgttctggtggtgttttggcaactttcaactgtactgaaatctgaagaaccgcatgatagaaaatatggtatagttgaacctctgcaaaagtttactctccaccagaaagggaaactcttacaacttacctgcttgagttgcgtatttgtgtttattctgcaagatagagtattttttaacatacggcagaatgaagatagaaattttacagcagtacttggttcgatgtggcaaatttgcaatactgctcctattatcttcttagtaatatccaacatgtctgatacacgatggtgcgcctctatggatcccatcttcgaacattatcgaagccatgtagtcagttgagaagctgggagatgaatcgacgtctccattcaaacatgatcaaggccatctgttctgaacattgccccaattctcaatcaccgcagcaacagtattgtgaattctttgaaaagaaactaatagatatttttgtagttcttctaatggcatcgtttgctttagttccacatcagcacccattcaacaaccataataaatattgctgtttggatttatgctctgaattctgatatgtcactgtcaatttccaagtctacctttaactctgctccttggcagtgaagaaactggaaaaagagtgacgcccccaactttttgttgggaagaaaacaaaatttcgttatcatgctgacaaattaagcagttcataatggacactctttacatgtcacagttatgacatgattgttgggcaacatatataccaggtctaggttgcaccagcataacaattaaaacaagtcttagtaatcgtgcaaactgattactgaaaacttgcaggttcagggtgaatctgcaacacaaaaggatgcataattaaatgactcaaccctgagcaaggattaaattctgagtacatacaggagttacgcactcactgtaatttttcccatcatttctgctttgcttatcccttttgtatgttcatttgtccttaggagtaatgagtctatttggcgttatattggaggtcctaataatagtactttttgacccctccatagtgcctacgcatatctattagtattactccacccgacgcagagtcgcagatgaaaacgaactactgagcccttgttaatccatctaactttgctactcatttttccacattaatgagaggatctctaaatcttcagtcactctctagcaactttaaagaaaaacaacgcgacgatctattttcttttagtacagaatcacttatacattaccctccaaacagaaacttctcgtagccaaatgctttaccctttccttgagttgttagacagtttgttagatgttgatattgtgaaacaagtattcttcaatgccacgagaatgttgaaaggcacatgtcttctagtctaagaattgtagcatacttacaaatatgagcaggccagtaccatagaggaaaggaatagtggttctgcatcccccaatagaaatctacacgaactgtagtacattacaaatttctagtcagtcaactccttaggataactttagcattgtctcaatgagctggtagtttctgtagtataggagaatgaaattatagagaaacagtgatggaaaaactgcattgcaaaagcttatcaaaattaatgcttggtggtccaatgaaggaaatgtactcataaacatatgttatgaagattttaagatcagtggtcctaaatacaactatacaagcctgaagcctccacagaacacagaaaacaaaaggtcgttttaacgattttagctaaagattagaagtgatagtttgcttaagatgatgcatacagattagaggcgacagattggaggcaacctggatgttcatcgatacaatgttcatagaagaatcaacgtcaagacagatcagtatttcctacttgccatgctaacttcaggaaacatcttggtacaaaaagaaaattgaaggaacaacaaacgtgtgttcatgctgagccaacatttttttttcgtttacttacaagtagcggctttattatccacaaaagttgcaataatccaaaacaagcacacgactggaaaaaatcttgtctatcgtcacaaggaaatgaaaggcaaaagcagggaggaaaaggactttcactttttcgcaagcaaattctcacatggaaactaagcaagttgtgggccggtgtaactaacagggaaacgaggcgcaggcgccctgactaaaccttgcagttcatacgggcaattgcataagagttaggttgagaaaatcagaatgatcaacaaatttcaacatgtatttttttttccaaacacggaaaagcttcacaatcaagcggaagggcaaccacacattcaaatacgcatttcaaggactagagaggactaggggatgctaatacttggtgaaaaatgactgcttcacatatactaggcgtccccatcttaatgaaatttggtcgccgttcctttcggccgacccggcagaaaacatatactaggcgacaagtggagtacttgcaaacgaaacgggcgaccgtacaaaactttgccgtattggtgagagtatccggtgaagttactagtactccatcaaattgcctagactatttcagcagggaatcgagaattcgagatctgtaaataactttctctctgcttaaaacatcagcaaagtctggctcggtttcaaaaaaaataaaaatcgagatctggaaaacgcggctcgaacttgccgtgttagattgtaccgagagagggaagagcaactaggggttttagttacctcgccggactccgagtgtagattggtcggccgccgtcgtgttggcgtcatcatggcgtgttgccggccgaggaggagagaggcggaggcggactcgcggaggaagcctcttggcccttggggcggccggcggcgtgccgccctagttgggtccgcaggtcgcgggttcggggtccctcgctggctaacttttactccagtgggctttggcgtgcggctcttcccttcatggcccgtatggcgatatggaattatcgggccttagttgatgggccagcaaggcaaaacggaaagtaataagttcatttgaggtcccttaactttacaccgaatccgattttcgtccttcaacccaaaaccagatacaaccggtccctcaactgtccggtgcaaataagatccctcggcggtttggaaggcagttttggctaacgtggcacccacgtggctggtttgactatgtcttcgtccctgtaggatcaaggaggccgactagaggggggtgaataggcggttttaaaacttaatggcacttaaacaaaactaacctaagttgctaggcaaggtgaggtgcaaggttaactaagcaactaagttaagttttgtaaacctaggtgatatgggctcaaatatgtctctatgaaaataaattgcacaaatgtaaatgcaataaataaatgagacaagagacaacgaatttttcaccgaggttcggaaactcgccggtttcctaatccccgttgaggcgagcccaactccaccgctcaaccacgaagctatcgcacgcccccttcgtcaaggggtgggcaaggtgggagccggcccacggagaggactacccaagcctcgatcactagggtagttcttccttcactccgaaggtggtgaactccaaaccactcacaaacggcgccagacctcctccacaatctcctcggagaggtcaccggacaacacctccacaagccgtctaggaggcagcaacctccaagggtaacaagtctaggatgcttgccgagaatgatcaagtgccacactagcaatgaagcaatgcacttggattggcttaactcactctctaacacctcactagataaactaagtgcacaagggtgtgatagctcttgaaaggattcaagataatgcaatggagtgccaaaaccttacccttactgctggggagtgggtatatatgcccccaaccaccaaaactagccgttggaaccgaaatccccaactttatgctctgccggtcagaccaccgttgtgaggccggtcagactggactactttgtaacggctataaaagtagccgttacagggcaatcattgagcccactcaacctggccggtccgaccgcagtgtagtggccggtcagaccatccacggctcggtcagaccgccgtcggctcggtctgaccggttgcggctctggcggctctgtatcgccaccaaaaaccagatcagtgcaatagaccagtggggccggtcagaccggccttaccatgccggtcagaccggctaacagacctggtcagaccggcctaaggcccacggtcagaccgcatgtcacttttcagctcaaccgaccgttagtaaaacggcgatatctcttgactcgggtatcggaattcggcgttcttggactctatggaaagcttattcaaagggccatccaaaccatgaaaaatccatccaagaaacacaacttaagtcaaggataaagggctcacactccaaaggatatccaccggacatacccacaagatgtcactcactcctattggacatgcccacttatctcttggtttaggacttgagaaaactcatcacacttggttagacaagcccacaaaatacacctacatgcatataaactaatatggcacaagttcatccacaagctcgcttcatagacccctcttgatagtacggcgcctatctagcaaatccggtctacaccaaacaccaagaccgggaaaagactaagaaaatattcttagctacattatacctttgccttgcgccatccatcttggggtcaagcttgagccgagatcaacacttgtgaccatccggttgaaccatgtttatgccgaggtcttatccatcctttgtcaagactttattctcatcacaagtttgacttcattcttaccaacatgacgatgtccttggcttggtgaccactaacccatggtgtcattcattagcctcatcgtagtgggacctattccttttcacacctcaaaggagaacattagtctcaacaaatcggttgtcatccttcacttgatgaccaaccggttgcatatgaaagatatgtatatgcttgttgagtattcattaacattacaagtgtcatatactcgtatgcaagctcaagtgtaaagatccgatataaataataggtgaacaacatggatctggaacatgcacaataaatgtataggatttgctccccctaaatatatgcatacaaataaatatacaagagattcaagtgtatgcataattagagaatgaccaatgggggtttatcctatacatatagagaaggcatatgtactaatgatgtagaccaacataaaacatataccttcatgatctccatgttctcaatgtaaatgagactaaataatataacattcgagtaaacattagtctcacacttatatatcaataacatagaaatcatatatatgaacctatcaaaaagtaggagataagaagtggtacatatcgttttatctccatgcatttcattcttgtcatgattaagttccatcacaaaagaatgcatgtcttccacatctcattatcgggaaataacctagtagacaacttatgcaaaagagaggttaatcccataaacatcggtttatcatctatcaccaaagtaacaattacacaaattgtttaatcgaagatctttcaatattttctctctttggtgatggataataacccgatataaacaatatagagagatgagatgaaaaatgatttcaaatcaagatagaaatcttataataaacaaaatatagaataagctccccctcaagatgtgcatacatatggatatgaaggaacgcatatgcacataatcaataaagatcaaataggaagctcacactatattttggatctacaagagagaccaagttagaatatgtgaagtttaatacatacctctcatcatttttactttcatatccaaatgagactagtcaaagaaaggctcataaaaatgattagtctcatatagttagatttgtcattaatcaccaaaaccaaatttaaggcacttgaacttacagtcccatgtggcattgacgtggcgctgacgtgacaattctatccttgaaaataataaaaatcgttggccccaaatgtcagctacatagaaaaaatcatttacaaatagcaggggccacgcgggtcccacatgtcagctagagaaatggtggggcccacgcggcccccacatgtcattccttcttccatccctcttcttcctcatcacgctgtgtccgactgcttctcctcgctagcgccgtggcgccgcctcacggccatcgccgccgccgttgtcgtcattgcagtccccgtcgctgccgacggggcgttgtcgtcgttttagtctccgtcgccgccgacgggggatgagggagagggattggacccacggcgacgagaggagaggggagaagggagaatgaggtgtcgccgtctgtgggctagccactggttgcgcgcggaaatccacggcggtgaaaacatgcaacgtcaaacatagcttaacggcaaatcctgcgttgttccctcggttcagaataaattccgtccacttattctgtatctggacgcgttcccgttcacatgcattgcttgagccttgtgcgcgtgttcttggattcgagtcgctgcttcgacttaggtgtgtagacatttttaggcgacatacctcacatgttaatagttcaagttggttggattgtctgttatggtgctacgaacttcgtgtctttggcatattcttttgagtatgggtgaaaatggtgacgaaaatttccatggaagcaataatagaaagtgacaaaataagagaaggaaacgaatacgattttattgttctaccgactgtttccctcattttaccgtacttacatggaaaatggtgttgtcataatacgataattaacatattcctaaggagaccgtttcccttaattattgcgacggtacgaattacaatatcaattcaaaaatagacatcatttacactcaacttttaaaaccggatgagcccccatgactcactcgagaacggttttggtcatatatggcttatgcgtggtagtccaatcagcataaaaaaatcaaaacaatttgtgggagtccacatgtcaattatgcttcttcctctcttggtctcctcttccctgactcatctcggtcgctatcgatctctgcctgcctctcgcccaccatccgcagtccatcacctaaatcttgcccgcctctgaagaactacaatccgccaccgacatgtcaccctacccgcagcatcaaccttggcctggttccgtcgagctcatgcagcgccaaatggaagaggcagaggcgaacaaagaggcggagggagagaagaggtgatgaagatggcgacaaatggacccgagctctagttggatctgtcaccgccccaagctccacgtggatccggcgtcacctcaagctctgtttccaaccgtctccatgttgcagcaggtctcttccccgcaaggccatctgacttcgccatctcgttgaccccaacctcaaagccaagcccttgccgcttgttgtcatcatcatcgccgccattgagacccgtcacacccaaggttgaggacgacacatccgcccctccctgggtcagggccactgtatctttctaccgcatgagcatgttgccgtcactgagacctactgcacctgaggctaggggcatgctacctccccgacaattgggctagcgattttttttagaaaatactagactattgtcacgccccgaactagtcccgaccaggactagcccgtgacgctccaaattaacctgttaatcgataccagtcccaggaaacagtgctggtatcacaggaaaacagaatatcacagcaacagaggtctctttattatagagtaggagtacagtcatgttgggctgcggacagatcccgagctcacaactgcattacaaaagggaagcggaagccaagacttggaccaaacatcacaggcgcgacttggggactaggccgaaaccctaaaactcatcgtagccggcttgctcctggaagaactcctcgtcagcgggatccgcttcatcttcttcagcaactgggggggttatttatatagagcaagggtgagtacaggagtactcagcaagccatgggaaataagtgtttaatgcaggcttcaaagaaaggctgttgtttttgcaattgattttatttgaactcttttctgaaacaactaggtgagtgtttctcaaacgacacggatgagacagtgcgtctcgtccggtcggagtatgtgcaatgtatcagtcttttgaattgattaagattggcacccggccaacagctttcaaacggccacccgggcctggctgatctcatcagccgcagattttccaaacatcaaacccattccacaacagcaaatttcacaaggcagtagtcaaacaaaactacgctaggaatcacctcacatccgcccatgaccgtgggcacggctgttcgaacagttttaataacctctgcagaggaggtacactttacccacacgacattactaacccggatcatccagtccgtgcagaacggccacgactagagaccttaaggctttcatgacaaggcatttcgaaagccgacacaggttcaccatatgccaacgagaggggtcccagaccaacaccagattaggtccagaccatattgtgccaggaagcccaggggtcctccccgacacaccccggcgaatccacatgtctcttagcatcatggctcccccaataagctagttactcagccaggggtgtcccattccacccatgtggtcgtacttgtcttatgttcggatgaaattctaaggaaatggtccttaagtgcaagagcgggaaaccgtacacccggtacgttccccggtccacggttttggaaaatcatttagttcgcaagcaccgacccaggtgtcgggttttccaagtcttttgtaaaacccaagttttacccaagatgttttttagattttaagtttgaaggcgaccgtcgatactcgtgcagagtgcacgattaccgaggcgcaactgggtggttacaagggaacatggtataacaattaacaaaggaaggatcaaatgcaacaaattaggtaggtccgccgatctgccttgcagacgggacaagcagattaagtgcgatcctatcaatgcataatatttttcaagcaacataattaagttcaaatataggctcaagatgttcaaaggtggcttgccttgctcgagatcttgaccttgatcctcgaaatcctcgcactgcgggtcttcgggctccgaaactacatgcaaaacgggacaactcaacaaacggcgaaaataaagccctattattgacctctaagcgtgccattagatagatctcgagatttgaggaattttggaagtttggacggagtcaaacggatttacggttgggaagatattgaatttctaagattattggatttttggtctaaaggaaaaggatttatttaaatcctttttgaaaaataaaagaaaagaaaagaaggagggagggaaattagacttccctcgggcggctagggcgcggcccgagagaatggggcggctcggccgagcttaatgggccggccggcccaagaaggcggcccaaggcgcgcgcgcgggcggggaggggagagagagccggggggctgggtccaccccgcgtggtcccgggtgggacccgcttgtcggcgactcggctcaccgtgagcgaggtgcacgcggggcgtgctagggttcagggagagagacgcggtgcacgcgcgcggttcgcggaggacgcggatgcggcgggcccacgcgcagcctcacggctagcggtggaccgcgcccgcgagcggggccggagggagcggctgaccggggtcggctcgacccggtcttggccgagctggcaccgacgtggcgcctacatggctgccacgcgggccggcgggaggtagacgacgacgtcggccggaacggacggcggacggcggctgcgaaaggcggggcgaaccacggcgatacaggcgaaagcgagcacaccggatggttgcatgagacgaggggagacgagccaacggctcggattcgccggagggagctcgacggcggcggattgcggcggtggcaaccggcggcgagggaagggggaaacggcgatgaggtcacaaggggccgattcccggcggtgagagcatctacgcggctacgggaatccgttgctagcgtcagattaggcggagctacgccgagcgaggccggcgacggtcgggcgctacggagcacgggcggtgacggcggcgagcacacagcgagcggcggcaacggtcggggtggcgccggctagctacggggaggctacacatgctactaccgaaaactaaggggaggagatggattgaggagggagaacggggagatgcgctaccgtgcggacggggcgcagtgacgatgggccgacggcacgggagtgatctctccggcctcaggccggggaagaggaagaaggcgagcgcccggagttcccttccgcgtccacgaacgcaccggctctcccggtgcttggcgatgaacggcggaggcgagtcagaggggcggcaatggcgcggtggcggcaagcgaacgggaggaggaatcgatgggagggcgccttggtttataggacgacgatgtcggtttggaaaccgaccttgggcggtcaaggcacgagctggcgctcggcgctcgcggccaaaacggcaacagagacggatgacgccggcggggaggggaaaaggaaaaaggaagggagaaagggagcttgccccttgcctctttggggaaaaggaggagggagcgggggcgacgcagcagagggaggaggagctctgcctccgtcccttggaggctagcgcgtggagtggcgggggccgggtcgtgacgacggcgatgacggccgggcggtttggagcggagcgacgacacgagcggcaggcgcgggcaggcgctgacggcggcggcgactggccggtcggccaccatggcgcgcgcgcgggaagcaacgggcggcgcggcgatttgggcgacgtcggcaggaaacagcagcgagggcgggggggcgctcggctcggcgcggctcacgagcacgcgtgcgcagcgtacgggcagtgcgggggagagggagagagagagagagagagagagccggggagggagggggagatgggccgagagggattcggcccatcgaacccgagggaggcgaaatagacttttgcggagggatttgatttaggaaggatttggattcgggatgaactcgacgatagatcggggatttgagatctgagatggcacggacactagacaacaagcaaagaaacagatttcgcaattaggatttttaagagatagtttttccgctaggtgccacgacggaacgggcgctacaactatcagttatgataaatgtcgacgagtgatactcgtagaccggatgattagggtattggggtacgttggaacgaggatctacgtaatacgacatcaagcgaacagaagacaaggattttactggttcagaccccttatcaggtaatagccctagtcaagttttacatgggattaatatggaaaagccacaaaatacaataggagtagatggatccgatgataccgacgagatcgtaatcgatagactcgacgaaatcccccggtgacttggctccgtatgctctggctttgtaggctgtggtggtgtgttggcgatgagattcgatgccttgcacccctcccaggggtcccttttataccgttgatcatcttgatctctaagtaagactcggagacattggatctcatatgatacaatgaaagctctatccataccgagtaggactttgtaaatcactcgacccgtagagatattttccataatccgtgacggattcctacgacgcatacggaaacaacccgtgttataccatactcgtatattccataagtcgtaaaataggaggtatgccttattcgtaacattgaccaaaatcactgtggacttacttagggttgtcatttgttccgtttgaatagtcgatggtgtgaaatgactggtatttgagtttagggggtaattcgatcaaccccgctaattcaggggtgtcattcggactttttttttctatatataaatactgtaatatctatgatccatatatataaataccgtaatatgtgcttttatagctatatatatctatatataaatactcttcaaccaaatatcacaagcccgaatataattgatgatattatatagtaatgttaagctaaatatgtgcttctatagctcaatgttttcgatatttattaatggtattcatttgatattgaattgtttctgttcatacaatttcatttccgactttctgatattttggacactgttttcgttttgggtcttttcattttcgattttgtcttcgaagaaatatggttatattaccaatatagtgaaggttgtttgcatccctacttccaaacgagaggaaatgaaaacgcatatgtgcagatattattgtcgtgagggtgtgtggacactggaagccattcaaatgaaacatgatatgcagattgaacagccatcgatcgaggataggtgccgctgggcgagatgtaacaggtacggtgactggatcgtttggagactagtcagatagggtgtttaacagcatggaagataagaagggcaggagtgcaggacgtgagacaagaggaggacggccgggaaggcgatagcgaagagggccagtgagaaggtccggcagacttggagataagaggggtggcgttggaatgttggatcgctggcacgattacacacctacggcgtccctgtcagctgtcaagaaaaaaaaaatggccagtgatgttcataagatctccacctttttttttttgggaaaactataagatctccacttattcggtgtaagtgtagattgtaggacatgtttcatcgtctcatgggtaagttttctgatgattttgtctacttcaggctcgtatactaaacagatcttaaacctttccgtgcaatgtttggtaagctagctacagcaagcagacagtgcttctacagttctactgcacatcaggacaactgtagcggtactgcgcgtggaaacttgcaacgtggaagacaagggatgtgttgttggctagtgtgaccattgcctgctgtttagaaaatatctgacgtgctaaccttcgtatgctgactgctgactaccgaataaaatttctatgtgaatttcagctgtgagaaagcgaaaaatctagacttgagagtaaaagcttgaaggtgaacatgtcatatatttcttctggatctgtgtctatgagcataaacttggtttctcatctgtatattcc

SEQ ID NO: 43860 - DNA, 2326 bp, Oryza sativa
aaatatcagtagtcaacagcatcatcggtgacaccatgctttaccatcgcaagattgaacgtcgcaagtcgcaactaaggtttgttccttgggcgaattgcctttaaatccacgccgatctggaactcattggcaccatctcactgtcatttcttcctctagctggtcgcgttgaacatatgctggatagccgaccgactgtggagtcggggattgccgcatcccgaccgctacattctctgtgatcagcaggatgagagcattaatcatatcctagtcggctgcccagattcaaggcagctttggtggtggactttgagagcaatcggccaccccaactgcctgccggtgaatgaagcttcttttcaccaatggatgtgcgataacagaatggtgctaagtgagtcacatcgtcgaggcttcgacacggtggtgacattggtagcatggacaatatggaaggaacggaacggttggatcttcaatcagcagtgtagatcttgggtggatgtggccagagggatggtggacgaagcctctctttgcgtaaagcaaacccggcgatccctgcactgcaattcaggagggagtttggtcgccaaaatcagcgcgagagatagacctaggattgtctgttattgtcctgtatcagtcccgtgctgtttttctctttcaaatgtaaataacttttatttctcttaatggaaacaaatgtgctccttgcgtattcccgaaaaaagtcgcaaccaaggtagaagaaggggttgacaatgtgggtgcctgcgggttgtgacactgcaggatacctagtcagctagccaaccgctaaacccacattatcctcatccaatgcgtcacagttatctagttaattatagagataaattaatttcctctgtccataactataagtatttataggttgtttatagtacaaattaagattgagaagaaaagcactttgacacctcatataaaataagtgtacctgcactatagtgtgattgtattataactatatttataattataatagatgtacgcgaaatcgggattgttcacttggctaggagcagatgcccgaaaaaccgaggttgagatatctgcccccggcctcggcacacttttgaaaattttcaaaccttgctcgcacgtatcttgatgtacatccgatggtccacaaattggcacttctaaagattttccaaacttgctcacacgtagatacaaatctgatgatctgcaaatacctcatggtaaattttggatcggtactattggtagaaaactagaaatctggatcaaatagtactcccggtgtttggaacgaactactacagctacggagtaatactttttgcggtcctagttattttcaaactaatccctctgttcccgctgtaatttcgtcgattggttagcctttgttatgttgatgaaagctttcgcgccctcttcagggctcggtcgtttaatccccaagataaaggaattggagtagattgaagggaaataaataccctctaaatccttctcaatcctcttgtgggagggataaccgaacatggcctcaggaggatagcgagggaatccatgtcttcatcgctcgtcatcacgttcaggcggatgtacaagatcatcagcgacctcttcgcagagaccagcttgagcggttcgcccagagccggtgcaccaccgcagctgctagatctgctattcatgttgttctgtgtaacgctgccaagctcaggcgagccggtcatgcacctatcacgcttttttttagaattagggccagagagcccccatttctcttactagaaatgaacatatccttacaaagtcagggaagcaaaaaacaaatacgaggaaagaaagctaaagagcttatccagatgcctcatagggctggatggctgaacacgaatacatcattcggtcatcaaaaggataaaacagatcacaaaaaactaataacatcttcatccttctatcctcctgattccaggtctccatccatgtctcgagcagaagatgtcacttgccacctgtcttataagtctggctcccaactgcagtcttcttcgatttgcttccaacttctgcaaagatgcccatgaatccacccaggaacaagccataaagaccaaatcagtaggatctcttggaaatttattttcaaaacaagctttattcctggacttccaaattgtccaaatgattgcagctaaaccaatcacaatcaagtgtttcatgtttttatcatgtctatccagccaatgtccaaaaatatcctgacgattcaaagtaggcagtgggctgcagg

SEQ ID NO: 43861 - DNA, 1113 bp, Oryza sativa
ccgacgtttgacgggacttctagaaaataaaaaatgaattccaacgatagttatgttcgatttttagaatcacaatgacaataaaaaagtaggcggcgaacatgctgtagaggggcatagtggcatcgtttgataggacttctaaaaattttaaaaaatgaaactacaagttatgttcgattttaaaatctcaatgacaataaagaatgaattacaatgatagttatgttcgattttaaaatctcaatgacaataaagaaggtaggcagcgggcgagccgtagaggagtacaatggcaaagctattgacggtttggcaggacttctagaaagtaaaaatgaacctaaacgataattatgttcgatttttaaaatctcaataacaataaagagtagagacaatggatggcccgcagaggagtataatggcaacgtttgacgggatatctagaaattataaaaatgaaacccaacatgacaataaactctaaaaactacaaaatccaatttttaaaggttccaagaagaatgaataaaaatagtggtagatcgagcaagcaaataaagaaggagatgacataagggggtagcaactggtgtgacttttaaaaactatataattagaaacacgaggatgataaggtttggtctttcaaagtcttaagacaatgagatagctattaataaattttaagtaaaatcatactaaaaaaatatatgattttgtttgggtgctagccgcgcaattgcgcgggccacccagctagttatattattaaaggaatagaaaaagaagcctccacattcgctctcatggtctagaaattctcacattaatcggagaaaaagaaaaggcagagtccatataaaaatacaatttagaaatagctgaaattcggaattaaaaaataaggaatattagaagaggagactagagtccatatagaaatacaatttagaaatagttgaaattcggaattaaaaaataaggaatattagaagaggagactagagtccatatagaaatacaattaggaaataactgaaattcggaattaaaaataaggaatattagaagtagactataaagtccatatagaaatacaattaggaa

SEQ ID NO: 43862 - DNA, 12054 bp, Oryza sativa
ccgggggttctccccggcaccaccccgttgaatccacatgtctcttgtcatcatggttcccccgattagctagttactcagccaggggtgtcccattctacccatgtggtcgcacttgccttatgttcggatgaaattccaaggaaacggtccttaagtgcaagagcgataaaccgtactcccggtacgtcccctggtctgcgattttggaaattcattttagttcgcaagcaccgacctaggtgtcgggttttccaagtcttttgtaaaaccccaagttttacccatcgttggatgttttaaatttgaggggaggtgctccgatgcgcgtgcctgtaggcccgtgcatcgaagcacaacagttgacaaaggtggtttaagtgttcaataattcaaggagggtaattgcagcaattaggattggggccggcaggctatctcgcaagcgcggccgaaatacttgtgttaaacttattcatgcaatatttgcggaaaagaagtacttagatttaaattataggtgcaagatgatcaaaggtgacttgccttgctcgagagcttgatccttgaaatcctcgcactgcgggtcttcgggctccgaaactacacgcgaaacgggacaactcaacaaatggcgaaaataaagccctattattgacctctaaacgtgccattaaatagatctcaagatttgagaaattttggaagttgaacggagtcaaacggacatacggttgagaagatattgaatttctaagattattggatttttggtctaaaggaaaaaggatttaattaaaccctttcgaaaaagaaaagaaagagggaggggaaacagacttccctcgggcggctagggcgcggcccgagagaaaggggcggctcggccgagcataatgggccggccggcctgagaaggcggcccaaggcacgcgcgggaggggaggagagagggagccggagggtcgggtccatctcgtgtggtcctgagtgggacctgcttgtcggcggctcggctcaccgtgaggaggagcacgtgacgcggcgctagggtttggagcggggcgcggtgcacgcgcgcggctcgcggtgggtgcggatgcggcgggcccacgcgcagcctcacggctcgcggtggaccgcgcgtgcgagcggggcagaggggagcggcggaccggggtcggcttgacccggtcttggccgagctggcgccgacgtggcacctatgtggctgccacacgggccggcggaaggttgaagaaggcgccggccggaacggacggcggacggcggctgcgaacggcggggcgaaccacggcgatacaggcgaaatcgagcacaccgggtggttgcacgagatgaggggagacgagccaacggctcggattcgccggagggagttcgacggcggcggattgcggcggcggcaaccggctgcgagaaaagaaggaaacggcaacgacgcgactagggttcaattcctccggactagagcatctacgcggccaccggtgtccgtttctaccgtcggattagacggagacactacgagagaggccggcgacgtgcgggcgctacgaagcacgggcggcgacggcggcgagcacacagcgagcggcggcagcagtcagggcggcgccagctagctacggggaggctttacaagcttctaccgaaagctaaggggaagaggaggaacgaggagggggaacggggaggaggcactaccgtgcggggtgaaggggcgcagtgacgatggccgacggcgcggggcgtgatcgctctggcctcgggccggggaagaggaaggagagggtgcgcccggagtccacgtcacgcgtcctcgctcgtgccggctcctccgacacgcgcgacgacgaacggcgacggcgaacagggcagggcgcggcaatggcgagggcgaaaatgggaaagattggtttggggaggggctcgggtttatagggcggcaatgtcggttcggaaaccgaccttgggcggcactagggggcgagggaacttcgaggggatgggataggcttcacgggcgcggtcaaacggcgtggaggacgggctggcgcggcgcggccgctcctctgccctggcgctagctccgagcggagggagagcagaggtcgggccgagagaggaaagcgggaaacggagggggagaaagaaggctcgcgctatgctggtttggggaggaagagggatgggagcgggaggcgctgcctccgatttttggacggatgcaggcggcgcggctcggggacgcgcgctggctcgcagggcagggcgcggcgcaggcggcgcagcgcggcagggcgcggggccagacggcgcaggcacgggcagcaagctgctgacgacggcgacgactgcgcgggcgagcgcgcgcgcgaggtaacggcacgcggggagcttgccggggatggagcgggcagagagagcgggagaacgagagagagagggagagctcggctcggcgtcggctcacgcgcatgcgcacatgcacgcggcgcacgggcaaagcgaggggagagctgggggagagagagagatgggccgaggaaatcggcccaccgaacctgagggaggcaaaatagacttttgcggaggaatttgatttgggaaggatttggattcgggatttgaatttgacgatagatcgggaattcgagattagggattggcacggagactgacaacaagaaaaaaaaacagatttcgcaattagggttcttagaatttaaatttttccgctaggcgccacgatggaacgggcgctacaagttaagagtccgtataaaaatacaatttacaaataactaaaatttgagattaagaaaaacatgggaagaagagtcaatataggaatacaatttagaagtaactgaaattcgaaattaaaaatgaaataatattgaaagatgagtttagagtccacgtagaaatacaattagaaataataaaaattcagaaataaaataaataatattgaaagaagagcctagagtctatatagaaatacaatttactgaaaattcggaatttaaaaaaagaaatattaaaagacgagtctagagtccatataggaatatatataatttacaaataactaaaatttaatattaaaaattattaataactaacacgtatataaaatacaatatgaatattacaagttattgcaaaatttaaaattatgttgttattttaatatatttgaataatatattgaaaaaacatatatgctattatatgagagaaaatataatgatgctagccgcacaatctgcgcgtgctaccatgctagttgaagagaaaattaagtgcaagccgcagttggtgcggaaaaaaagagcctcttattcgtctgcacaattacaggttgcaaattggattgctgctatgcactgtattacagtattcactccactggtaaacacagcaaactctcatctctctccatgacgccgcaaagcatccgtgccaataggacgggtccctcgggcaaacgcaactggcaaacccgtagggccgcgagcagcgaactcgatcgatcacaccagctttagcgcggctcccgccgtttccggccaagtgccccgctcgccggatttccagaacgggaagcagcagcacgtacgccgcggatcaccccaatattactcaccggctcaccgcgagacgagcaaccacaagaagaaaaaatctgtactactagcgcgtagtagtgtagtgtagtgtagcggcgtggtcggccaagcacgtgcagggtggagaagtgcgtcttgttcttggagtgtggtaaaaaaatatcctttgcttctttttgtgtgtgttgagttttgttgggggagggaggtgttggatcgcggaggcatggctcatgcacgcgcatcagtcgagggggtagcatgtgtcatcgccgcccgtgttccagaggaagtgcgcgtaggctgccgcgtggtgcgagttgctgggttcggcggcgatggcctcctggtacgtctcctccgcggccgcgaggtcattgcgcgctttccacaggaaagtcgcgtaccgacccatcgcctccgcgtccgccggctccgcgcgcaccgcccgcttgaagtagtgctccgccctgcatccgcgcaaaaccaccacctcggtcagcgcccgtaaaaccccaagaggccccggcggccatttcgtcgaacggctggcgacgtggcgcgcagcaactcaccgatcgtggtcgcgctgcaccgtgtacaggaactgggcaaagttggacagcagcagcgagttgtctggctcctcggacacggctcgctcgtaccgctcctccgtcgccgcgaactccgccgtgtcctccgtgtccagcttggcctccaccggcgccacgagctgccccagtgtgtccgggtccatcagcgcctcggcgcgaacgctcgcctgcatcctggtagcctcatcggctatccttttccagatgaccagttcgtcctctgtctcctccacggccattgcttctgacacgggcacggcctcctccgcgccagctcccggcgtaccctgtgacgcatcctgcggcaacaccgcgccgctttgccgatttgaccactcgtccgagcgaccgtcgccggttgccccggcgaccggccgcaccttgccgccgccgccgctgttgccacccaccgaggccgttcggccgatggacaacgtcttgagcgaggcatggtcgaaccgctggtgggaatgagactgctccgcgtgctgggtgtcgaccatcgccacagtcgccgcggggggctggggaggcgggagcgtggcggcggccgcgacgctgtcgcccatggagtagacggtgaagttggcgagcagaagcatcacggagaccatgagggcgggggtgccggagaagatgtgctggaagagccacacgaaggaggcgtgcatctcggcgtggacgcgcgcgagcacgcgctgcaggtcctcgtagaagagcgcctgccgcatctgcagcgtgaagctctgcagctcccggatgatgagcaccatcgacgagaacgcgcgccccaccgcgccgcgcgcggactcgccggcgcagtcgatcagccgctcgtcccaccggccctgctgctgctgctgctgcttcttccgcttgagcatccgcagcgacagcggcaaccccacgctgctcgcgctccgctccacgctcgccggccacccgcagccagcggcgccagggtgcagccccaccgccagctcctgaatcctccgcaagaactcctcgtcgtccccgccgtcgctcccgatgctgtcaatgctagcgctgagagcgcgccttgccatctggtgcccgccggcgcgccggcgggtcataccgacgctccagctagccagcgacgactgccctctcgacagcctgacacctccaagaacgccatgccgccgcgacgtcgtcgcggcggcagacgacgaaggcgacagcgacgacgacgacgacgtcgtgacggcgcatggcgacgacgtcacggccgcgacctggatgcccatgggtcgcagcgaccaccctcccggccacccaccggagcgacggttgggaaatggcccacacagctccacaaccgtgggaggctggctaaatgcgagggggtggcaaaggaagaggaagaggaagagggggagggggaaacgagcggtggccttatttcaggatccgggaggcgtgtcctggtcaaccacccccacgcagctcgtgaaggatctagcactcctgctactgccgctaccggtgacaccagtttcacgaaacaaaatagaaacgatacggtacgcccctccttaatataggcttgagccaaaattaggcgctcacacactcgagatacgaatggcaagcagtatatactttggaggggggggggagagaaaaaaaaatcaagaacaaaaatatgagatggtgttcagtagcgagtgaagagggaagaagagtgatgggagaagacgaagagcgtgtagggaggccttgcctatttatttcgtgcgtgccacccggatgcattgcatgagtgtgcggccgaagaatccgtagaccgcctcactctcctgtacggctcccctctctcatcatcaacgtgtgtgctgggtatggccaccccgaatttctgtgacttttttcttattgtctcctacttattattcataagtgtgcaaaaaagccaaatatactttccagaaagacatctcagaattattttaggaaaaaacttgtttatttgggccattccttttatattagaaaattcaagaaacctttaaccgctatacattgccattgtacaataaaatttatttcccttcagaagaaaatgcaatacttacttttgacatttaggctttctacagtctttaatatacgactttaaccatagttttttattataataaatctataatagtctaataagtttatgaaattatgaatgtatcgtgctttagcattcaagttcgttttcaaaggaggatggcgtatcataatatctttggttttgtcaaattatagcttaggctttggtttaatagttatgcatgttgaaaatccggtatattctgtactttcaagtactatttttattttttggaaccaaagcatagaattccatttcaaggaaggatgatgcaccgtagtgcctctggttttctcaagccttgctttttggcctatgctttgatggttgtgcatgctaaaaggctagcacgtttcatatttttcaagaaaaatctgtacgtgctattttaaaaatatttttaaactaagcatttaaaaatttatttatggataactaaaagaactgctactgcatattgtatccaaaacatcaatatagccatttaagttgctgatcgtttgacacgaagtacataatcggctaaagcttgaccagagcagctagtacagtgtacagtatgtagtaaagaacgacatttcagctcatttcacgtggtttaacttgaaagaacaagaaaaaaaaaagagaccagaagcaactctcaaacgtgtccacctctgttcacgtgccaacagctgcggcggtggcgctgcaactgtgaagcctcgaggcttttgttgctccctccgcggctcccgtcccacacgtgtccgccattaagccgcggtgtcaatcggtcaccacactgcgctaggcaagtcatgcccgcccccatggtcgcccatggactcatctgtacagtgaagtcgcgcatgggcttcactccactctggcctcacgcttgcacatctcctccccaccggtgctgctctcgtgcaacacggtggtggtgctgatgcggctcactactcgacgcctgagctgacattttttggagatacctccagttagcgtctcttattccgtgtcctagtagttcaccggttgtagaaatgattgagttaaaattctacctctaccaatactgtctttctccttgcaaatcgcgacactgacgctgaactgatgatagcgcctagcaagcggacctcgtacgttcatcacggcaccaaccaccagcacggttcggaacgcacgcgcgtttcggcaattttttttcccgaaaggcacccatccgattcggacctttccgctcgctggcgagtggcgacacggcgcgcctagctagacgccgagacggtaacggaaaatatctcgggcctggggggtggggggtgtttacgagcggacggacggttgggagggcgtcgagaggggggccccgatgggcgccacgttcccatcgagccggtgttgggatcgacccggccaaacgggccggaggagatttcgatcgccccggtggaatcggttggtggtttgcccccgaattggacggtcgagacgggggcggcgttgtggcgagcggccgcgaggaccagtcctaggtcgcgcctgggccacccccgcggcccggccccgcctcgcctcggcgtcgcgcgagcgacagcggaaacgtgagccacggctagccgccaagcgagggtgtgcaagttgcatcgccatcactgtacgagtataacttggatttcctctccttgttgatgacggagacgcctggtggttgtttttcttctcccctcctcccaattatactcttcagttttttttttcatatttacagtggtatgtcgggaacatggtgcctattaatgacaccagaatgcatatattcatattactcttcttttttctggagagaggcagagacgaattaaggatcgaagtgctacttgtaatggaatgaaagggagagaaagaaacagaaagtagatgtgcacacccttgcagcaagttgattttgattgtttctgtacaagtaactttccttcctcagtgattttgattgtttcgctctcttcctcctgatgggccctggagcaacgatttgatgttggctcgattgcgttgttctgattcacgacagtatcagttggatggcccagattttgaactcgaaggtagatacgcatggttggattcatgcgtctttcaatctagatcagtgagtgcttccgattaaccaggtttaaaacgccgagcttaccatgtatctgttctgaactttcagcaagggtgtcttctcgtctagatgcgctgtcctactcttctaccaacatttttggtagtactgctcaagccctccaatcattttgggatggagtgaatctacttggggaaagtttacggacaaacagtagatatcaaagagagatccagcattttgtgtggttgcagagaaattccgtctcccttcctgatcgatcaacctatggccagtagaaggttttgttttgatccttgcctgcatgtcatgttcttttccgcggcctggtagatatgaacaatattttagatggaactatcatcagaatggccaattctcagttagatcaatgtacttagccttaattaataatggttacattgacagaaataagttaatttggaaactcaagatgccgcttaagatcaagatctttatgtggtatttgcttaagggagttatgttaaccaaggataatttagcaagacggaattggactggtaatttaagatgttgcttttgtacgaaaaatgagactatccaacatctgttcattgattgtcattttacaaagtttatttggagggcagttcagttttcttttggtttatatattcctattagcatatctcatatttttgatgattggcttcaaggagtcataaacaaaaagagcaaactgatacttgttggagcttctgccttgtgttgggcactgtggctgagtaggaatgatagggtttttgacaaatcacctactattacttatatgcaggtcattttcaaggcaacatattggcttcgtctgtgggcacagttacaaaagtgtgatgaagatgcagatttcttaattgttgcatgtcgtaaggttgaaacgatggttatgcaactgtttgccaatcatggatggagatttaccaataaactggaataatgttattttgtctagtttggttggtgtgtttgcttctatttgaacttcactcttacagagtgctagtttgtaataattggctgtaactctttcgaataaaggtcgggatgctatttcattccattatctaaaaagatatgaacgatatctccaacgaagcatatatatgcccacagaaccaaaattgggtgattggtgcaactcccgtagcctttgctagtttgaatactccccacttctcaatccactttctaccgcatgaacactgaaatgcagaaccagaaatgcttgattacctcaacttgatctgagcctgtcataaattagtatagttctacaagagtttgttacctgcaagaactacctcaacttgatctgaacttgtcataaattagtatagttctgcaagagttgttacctgcaagattttatttcttgcaaagagaaaaaaaaaacacacaaagaataagacgtatgatggcacttcaaaatgattgcttttgattagtagctgcgtattagccgcacactgacatagatcaggcgacctttaacagttggcgacatgagtaggctttgtcatcttcagattacatgtatccctcgcgatgtggacggcagtcgttccgtatttgtgctccttgctcagaattcttctttctggctatcatgacgttaaaagcgtgataggtgccgattgaaaatgacgattgaaatttgcaggaagtggcgattgaaaggaaggaagcgcaaaatgcattcatcaacaaaggtcaggacttgattccttcttttgttcaagattctaatgtggcccttatggatatggctagtattttaggagttaacttaggctgtgctattgataatattgattcaaacttgtctttgattaaagacttagaatgtgctagaattagtttatttttaaaagaacaagaggttatgaagaataagaattgtgaatctaaaactgagatagaattccctgtggaaaatttgcttgatgaattgtgctcttctgagggatatgactctgatttggagcacattgactctttacttaaaggctctcatttttctggtagtaagcataaaaacaaaagaggaaaccttgagattttcaaggtcactccaaagatgagtaggaaaaaatataataaaaaaaccaggaaaaaaatgaaaggacttttttggaatattagaggaatgggtcaggttgaaaaaactagtcatttacaagatttgattaaggaaaaaaacattgattttgttgggattatggagtccataaagcaggatttctctgctggtctattgagaggtctaagtggtaacaaaaatatgaaatgggagtggttgccggctatgggtcactcaagaggatttttggtaggaattaacattgacaaactgagtatgttggctgtttcaaaaggagattttcatgttaaaattgaattgcaagatatgtgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcatacacaaagacaaacgagaaacagtggaagactagggcgacgaccacaggcgcttgacggcaggcacgagctagacaccaaagccttcttcttccaggggctcctcttcttggtttgggaaaaaattgagcaagactgagtacaaccaccgtactcaacaagacacacccacaagtgcaggataaatgcaagggagtacaagggggttataatataaagggttagggtttgtagtaaacagcattaaaagacacttagttgctcaaagctattttgtaaacatgattccagagctatacaatattattaatcaaggccgtgaacccacacgaacatgccttaatccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagatgtgacatagtttccaacccatcctagccatagacaagagtaccgacccaaccccacctacggccggaacccccgggacaggtatgcaggactgcgcccctagcagcaggacaccggccctgtgccatgacatctcgactaccgggccgcagcttgtgtagccttcatttgtcctagagatgtccatcgacccccgacttcgtccatctccatccgtgtacttttgttataaccagactgagccacaaactaagccgcaccgtgggtcccacgcgtcagccg

SEQ ID NO: 43863 - DNA, 2888 bp, Oryza sativa
cgggtgggccccacccgtcagcgagggtggcgggcgggcccgcccgtcagcggcgcgcgcgcgggaagaggccggatgggccgcggggagaggagagggagggggagggagatgggccgagccggcccaagagggagagggagggaaaggggactttttagagcttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacaatatgcaaaccaatttctgctgggatttgatagctgtatatggagcagcccaaaatgcacacaaggataggtttttgactgaactggctaacattattcagaaacaaatgaaacctttagtcatgggtggtgattttaatattattagaaaggaaagtgataaaaacaaagctggagggtataataggtggagtttcatttttaatgctgtcatagagcaagctaatttgagagaaatctttctaggtgggagaaagtttacttggtgtaacaatcaagagaatcccactttagaaaaattggacagaatttttgtgaacacagattgggaaaaggaatatcccctcacaatggcaaaaactttaactagaagcatttcagatcataatcctttgcgcatagatactggagtcttaaagattactcataagagcttcaaatttgaactcagttggtttcttagagaagatttaaaagaaattgtggagagtgtttggaaaattaattattatggatctagtattgagagatggcagaaaagatttagagctttgaggaaaaaacttaatggttggaataataattgggaggggagatataggagggaaaaagaaagcattcttgagaaaattgaaaatttggatgcgaaggttgaaagatgtgggatgagcaaggaagatagagaagaaaggaaggagttggaggataaactgaattttgtgattagagaagaaaagattaaatggtttcaaaggagtaaagaaaatgagttgttagagggagattgtaatacaaaatactaccatgccaaggccaatgggagaaaaaggaaaagctatattcattccttaactcaggaggaaggtgaaatagaagggcaagagaagttgttaacctatattactagcttttacaaagatttgtttggtcatcctaaacagaacacactttttctagatatgagaggggttacaacaataatggaagaacacaaggtgatgttgaccaaacctttcagtgaggaagaggtcagaatagttgttttcgagcttaagaaaaacaaagctccaggcccagacggttttattggtgagttttatactcagttttgggatctgatcaagggagatcttctaaaattggtgaatgactatcacaaagggttggttgacattgatagattaaattttggtgttattaccttgattccgaaaattaaggatgcagctcaaattcaaaaatataggcctatttgtctcctgaatgtcagttttaagattataaccaaagtgctcatgaataggattacagaaattatgacatatatcatctcaaaaaatcagacagcgtttctgaaaaatagattcataatggaaggtgtgctgatcctgcatgaaattcttaactccttacatcagaaaaaacaaagtggtgtcctttttaaggtggattttgaaaaagcatacgacaaagttgattgggtctttatttatagaatgttgaaagcaaaagagtttcctgatcaatggtgtgattgggtaatgaaagtgataatgggtggtaaggttgctgtccaagtaaatgatcaagtggggccttattttaagacacataaaggtttgaggcagggagatcctctatcccctcttctattcaatttggcagcagaagcactaactttactagtgcaaagagctgaagataatctgttgatagaaggattgggggaaaatgataacaacaaagtggtcattttacaatacgctgatgatactatatttcttcttcctgataatgagacatatgcaaaaaatctgaaatacatcttatgtttgtttgagcaattatctggtctcaaaatcaacttcaataaaagtgaggtgttctgcattggtgaggttgctgataaggcagaggttttcagtcagatttttgcttgtagtgtgggtgttttgcctatgaagtatttggggatcccaatagatcagaagcgcattacaaaaaaagattggagaaatgctgaaaacaaaatggaaagcaagctgggatgctggcaagggaaacttcagtcaatagggggaagattaattttgatcaattctagtttaagcagtgttcccatgtatatgatctcctttttcaagttacccaaaggagtgaaagaaaaaatggacttcttcaggaggaggtttttgtggcaggaggaccaaggcatcagaaaatatcatttagtgcaatggcccattatttgttcacctagagatcaaggaggtttaggtgttctggacctggacattatgaataaggccttgttggggaaatggatttggaatttggaaaacaaagaaggttggtggcaggagattcttagggggaaatatttgaaaaataaaactatgtctgaggtaaactttaaacagggtaactctcatttctggcatgggttgatggaagtaaatgatgattttttttaaattttgttca

SEQ ID NO: 43864 - DNA, 35671 bp, Oryza sativa
  unsure (1)..(35671): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctaaaatacgaagacttctcaatgtacttgctcattccaagccattacaaccatccgtacctcaattttaatctcctaataaaaactttagatgtacatatcatatcctttatattctaaatcaatctattatccttatcctctatattatatttctctctccttcttgttacctatcccaagtctattttaatctccttcttgctatagtgttagaggatgccctaattggcctaccgagtctaggacaaatcgatacgtgttcaccctgactgggtccctcggagtgctcgttcggcatcatcttccttctcgtggcagcgcgtctctgggtgctgctgtagtttgcacataacgtgctcaaggtgtggcggcgtgattcagcatcaatagtacttatattcttgatcttggacggaggaagtattgttttgtgttatgaaatttgagaattttgcatgtgccacttaaaaaacctagcttcattagaatgccatcatttaaataggcttcgccagaaatgccacaattaaacaggtggttgtttgcttcgtgaacggaattacccttaaatattcttcttcctctctccaacgctagaagaggccaccaccggccgcatcatgctctggttgcgtcgacggcagcgacactcgatcttgctagcccatagctcgtgttcttctaggtcgtgttcatgttgttctccttgccttgcgtacttctcgcgtttgtatgaatagcggaagagctcgtcagaggtcaccatgctccatcgccgccgttaactgctcgccactgcgcacactgattcttggaccacgagaaatttcaaaaaccctacttcctcctcccgatctcctccattccaccaaacagatcgcctactcctgaaccctagccaccttttttaccagatcatcatggtggcgagaatggaggtggcatcggagacgcttgacacccttgtaaaatggtttacgcagttgctctctcccgacgcatcgcacgctgtgtgcctgtgtcactgagtagagcatcgagtcccccaagtgctccccaggtttgtgctccgccgccattggctaagttctccccggaggcccgaacggtgacggtgccaaccacatcccgacctctaactatgtagggatgaccggagggaagtatggtcctccaggcacagggaaatgggagaccaccccgcccctcgtccaagagtagctctctgaggcccttggcaccgccatggcctggagtgagcatggccaaaggccagagctaggatcttccgatgttatagtaagggtgaaaacggggcggtatttctcgtcgcccgtccggccacattatttcgggacaaattcgggtacccgagacttttcagggacatcggatccgagtacgggtctttttggcggatataggattgggttcgggaacgtagtatctgacggatacgaattatccggtaaaaaaaatcctggtattacccggataaatatacggatactacccgtattatgtttttgcaaggcaccttttggtactatgtattggttctactatgaggtactattgttatgatgaattggtgataacttaaatgatgtttattagtctatgcccctgtggtcctgaatgatgcctactgatagcttgtatgggatgatatactgatattgtgactcaactgtgagatatattgtgcttaatgacctaatattctcaactgtatgtcatatataaaatgattttcaattgtgaggtattgcaccctatttatttcctaaggtcctaatggcataatataatcgtatcgtggatatatgaaattattgaatggttattgtctatgtgatatataagattgttgcttcaacttgatatctgaataaatattcataaccgatagtgtacatatccattttggtacgtattcgttccgtatttttgcccgacattatccgagtttgtatctgtactcagcactatccgtgtctgaatcgattccgattataaaatgtgggttaggatatgggaagggtgagatccgaccgaactcgacccgttttcactcctatgttatagggaggatgaagaagatccaaagataatgtcgtccacgttggtattctagcaaacaacctctgtttgaccatgatattttatcaaaactaagtgatggtattctagtgaaacaatttttttactcatatatgcaaatttctctctgaaattcattgggacattttctagaaaaaaaaatctgtggaagaactcttgctgactgagtttggtacagtgattcgtcttgtgaggagaggagggggggccatgccatcctactcttgtaatagcccatcaactgtaattgcgatcgtactataacattgtcgtatatagtacagcattgtccaaaactcacccgtcccttggatgcctacatctacatcgtcaatgtccaggtaaaatcgatcacaaaaacccaaacttgcacacatcacgtatagcccggtcgacattcgccagctctgtcctcttctctagttctcaccccaccaccgttctatcacagtacgtcatcgttggcctgtagacagcgccggtgctgacgtctccactacaagggctctggcaaagctacgaacagctatagatcatgggcgaatatactccaatgatatttatttctttataattttttcttcattaatatggtaagaattggggttatagcaataaataaggcatcagctacacaatctgttcaccacctattcacccaactttgacatccttgtatgcttgtgttgttttggctattggattaattgttttgttagtttcatgtacggtaatcttgcaagcactaacatcccacatcaaacgtacgggggcgtgatcttaagtacttctacatacgtgttactatccactgataatatttcacagttgtatttaccagatggtataatatgttttgctataaatacacgaatgaataaatgtatgataaatatcataaaaatgatagataaatatatgttaaaatattatgaaatgatggggctgttcagattgataatattttcaaccatacccttttttttacaaagttaaataaaaatgtctacatttagtttgttgccaaatttggtaaatacataagaatgccaaattttggtaaggtttattttggttacaatctgaacagacctgatgatttaatatgcttatatgttgagccctataacatactgttgatagaaaacacgatgcctgggagatctgcttaactccagtgcaggtccaaagctcgccttcgaatgtatgagcgtgccagttgatttgatcatgtaatcaacaagaaatagagacagaattcgtggttaaatctataaatgatagccgatcggctaggtaccgatgacatatcatttatctttgagccgatgtcatatatgaatcgatcggcggttataaataggtggtaaggaactaaatctattcgatcggctgtagatattaatgatatatagttcttatattaatatatacttaaatcaagtgattgggatagatcggtcaccatgccaagacagtataaatcacttagatcgaaatatatattaataacaggattatatatgtttatagcatagccgatcagatagatctagcgtgtatcggctaatactccgatactactctatatcaagatattaaaacaggtataatgtattaaacagaagcttaatatatttagattgcgacgatatcttgacacaaaggacggatttaacatgtcattgaagcatatagatcgaatatggttaaatcaaataagatcggctgaaactccgatactaccctaatcggcaaccagagtacaggctagagattgatattctaagcacgacttaatagatcaaactcaactgatgcagcattaagtatgaaaagaagagcaatatctagacaatcaagccgctggatgttttataaagtggtagatatcttatataatctaagacaacgtcgctatttaacctaatcggctgccttctatcaacagatgttaaccgattgtaggttagatgacgatattgccaaagattatataagatatataataacttgacgaattatacagacaagattagtgtcataaagatggaagcactaatcccgagaacacaagccgtcataacaagttttacctcttgttgaagatcgaaaccgatgcagctcaacccgaaagcaaaaactcgtcgaagtaaaactaaagcaaaaaggtggcgatgcgccgaaattgtattgaacgtgtatgttaaaaattacatagggctcggggtctatttatacccgagaattacaagatatgtctataccgaacacgaccactatctctaacaaactctaagataccataagtcattgcggcagacttttgcccaaacatatctctaaggaagttacataaaacatcctaattaatagatacaattgccttctcatgactctatccatatgcggcaatcatcttgaagcacctcaattcaacccaatgtcatacaccagattatactgtcagaatcggctgcatcagctcacctagtccgactcagacccagccgatcctaatcgtagccgatctggatttcagccgattcttgctctgttctcagatcaatctccgccttcgactccaccttgatctaatctccgtttccgataatgatattaccaaatttggtcgttaacacatactaacacagcatctatgacgtgttatgtgtataaactttaaaatacaataattgctagttaatgatcatgtgagtttatattataagctttagaatataatgggtctatcttatatatataatggagtatagattaatactcacgcttagccacatcaagagaattgttttagctgattgaggagcctatcaaatatcagccttgtctttgtagtattaggccctgaacaacattgtctttctgttgcagtgttgttcttctatttgtctatttgataatgtttctaaaccgccatcaaacctaagctactatttagattgcatttgcttattactattattagcatgacataatttccttctgaaatagcaacgaaatccaatttttaatgtttatagttgctcagaaacaacacacgaggtgtcatctattgctttatttcatctcgatgaaaaaaaactcaactttttagagttatattgaattttaaatgacatgcacaacataatttatttttaataatatgttgcaacacatgggtacttggctagtatctactcgatccgtcactgtcgaagaaaaacataggtgcattttaactcggtccgatacaaatgtgtgcatatccttgcaacctccttgcccaggtaagccaacctatagtttttgcagggaaaaggagagaagaaaatgtgcccaagaaagagcccacagaagcccaattgtcaatagcacttccaggcccatttatatagccagcctaagtaacagaattattttttccaggtctgagataaaactgcatacagaacaaataaagtgcttcgagccttgtagcttgattataaataaagtgaaattatacataacctttggtaaagtaaaagagagagagagagagagaggtctgcattacagatctcaaccgtcataaattatcttttatgtcaatggattaaatcataatcaatgtagactgtgttgaaggaaaataagactagggggaaaaatcagaactacaatcaactaccttttagaattacaaatacagttaggaatctttcagaagaactgtaagaaaaacaatcataactcatcccgcatgtacagttttctcagcaaagggtttcgccataaatcataaatattgataaacattgaggacggggtcaaaatttacgttggtttgatccaatagaatgcaaaatcctgaaacaaggaaaaagatctaagtatagttcataaagttgtagtagtctcgatgctgagaaagtgactggtacagtatgaaatgtttttttggataacatgctgcagtatgaaagtgactggtacagtaatagagatagaatttcacctgaacttttgggcattattgcttttgatttgctggcacttggtataagatacaatgcaaactgtgtatagacgtcgttgatgaattgagtgactaactaaaatttttgttgctccaaacatttctgaaagaaccggttaccctgtagtatgaattaggctaatgagtacatctggaaacaaaacatacaatgatgcgaagaatttacaatagtcagaaccactttatccataccttaaatgcaaaagtgatatctgaactgtcaatttgaagcatcactctcctgagcttatcttctttggattgcccaagcttcatgaatccctacaatgtaaattccataaatacttgatatgttttgaatttctttccatttctttggattggccttacttcatgtttgcatacctgatcactcaaaaccatgcacatgtttgaaaattcaagcattccaactgctgggacttgggttgatctacaaatttctatgtatgatttattgagctgcaaaagggcattaaaatagattggttagaatattacaacatgtggctaacgagcgtgatctatcagaatgtctgtgaataaatattgaatattacctctcctagagtcgttgcctttttcttgcaatgatgaaaagtatttgccaatgcacacaataccatctgcggaatgtcattcgaggaaaatgaatacagcaaatttggaaaaagaatcgaggggaacaggagatggtaaatctgaatttacctgctgatgttggggaagacagagaatgctatctactacaggtgacttgaaagcctttgacaaagcaatgtccatgtggtcaaatgtcacctgtaatacttatattagacaacaggacactggaacaggaaagtaaattactgatcttgtgaaagaaatacaatgtggcaatgtttcatcatccaaacaaaagataaatttattttggcgaccagcgttagatccaggcaactaaaagcatgaaatacactgtcaatcgcttgtttagtagtacaacagtcatgcacatacaaatttctgtttggtggtaagtactacactagaatcatgttctagtggtctaccgactaccggccagaagaagtcaggcaaagagacacagatggacccaaccgcaaggaagctttacagttgaagcaactactgtgaacttgacttacatcaatgtagacatgaacaaaggtgatttcctttacaggaaccactttgttggttatacatgttacctatcaaaagatgatttccctcaaaagaaaaaaaaaagctatcaaaagacggcatgacttacaagtccaaattcttgatcagaagactcttgtaaccttgcttcaaaaacctctacagcgctcctggaataaataaaaattaagttatggactggcttaccttatgatggaacaacatgttagtgcaaaaacgtaatagttgtcactgcaagagaagtgggttacctgcaaacaccaagagcttttctcatgtctccagaggctgcagcgactttctggtataagaatattaagcaaacattgttaataagtgaacacgtcaatttcatgctaactgcaccatgatgttctccttaacaaaaaaaatacctatgctgccttgtgaactgacatatttcaaaatgaactagctacaaatgagtacttgggtagtaattggacttaccctagcacaaaattcaagggccagtggttcaaaaacatcatactcgagaacctatgtgtagtatcacaaaaggtaagcaacctatttaagtcaagtaattgaacacagatgtgcacgagccacagttggtcacatgataaacgaattaccttcagcctatgcttaattatgtcagatatttgatccttggaataagcacggaaagtcacaacaagtggtttgcctgtaaattagtgttataatgccaaagacatgttaatttctttcatacaatttatgttaacacttttcttgctagtatttggtaaatgcttacaatttaaggactcaagctttggaagaaaccgatccgctaggtctatagcatttgcaatacctgaaaaaatagcaccaattgtcgattggcaaaacagtattttgatattaacataattacaaaagtacaagaagcatcctttgacatctaacctatcagtatgcatcttgagaattggtaagtcgtaagcatgaaaagatcatgtagcacagcccggtctcttgttattaagtagtccatctcatccacaacgaccaacctacagaggagcagtaatatgaaaattgtgatgccaggaactaaatggcacgaaaaaggccaggttgtgaggatgggtactgggctcaagcagtccttacaacatccttcttggggctgattccttgtgggaaaacatggtttgaagttgctgaagtggtgacagtttgcaggttgccttcttccgagtctgaaacttcgcaagtatctgcatcaagaacttgtcagtgcctgtcagcattgcatagatatatcgagtcaataattaggcaacagtaaataccttactaaaaatttcatgcgtctttgctaggcttgtacaattgatcgataaggcatcaggtgtctccattccggtctacgaggacaaacaaccatatcaacaactacacactcctatttcaggaatcttacagaaccatgagaaattgaatttacctcgtctgcccaacgcgccacgctctccttaaccttgttaatcgacaaggtcttccctgtaccagggcacccgcacacatacaggctccctgaacgctcctgctccacgcaacccttgcagaactcaagcacgcgactctgctcatcatctcggcagaccaatccgcaagagggcaccgtagccacgtgaagcgcctccttgaccacctgcatctgagcgggatctgcagaacagatgaattctttcgtcagatcccaatcagaactctgagccctactgaaatgggattctggagacttgcctcgaggattccacttgggcttctcggccgcgacgaagtcgccgtaaagccgcttcctagatgacctgggcgacgccgagagcagcttcggggtgccaacctgcaagatcgagcaattgctcctcattgcaacagaataccaggtaatatgcagcagcagcagcagcacgccagcatctgcatagtcctgcactagagatcgaggggaggtgggggacttacgattccgacattgggggatttgtggggggatgtgaactgagacgcgtcgggtgaccctgcggctcggcgagggctcgtgaggcgccgcttggcgcttcgtggggtggcgattgccgtcggcgaggccgtgcccgccgttgacgcgctcgctgtggcgctgcgaagcgtcggcatcgagagagagagagagagagagagagagagactgtgggatcggaggcgggagagatttgggagggaaattggggaggaattgtttgtgggggatggggcgagaggtgggcgacaagaaaaagggcgcggtggtggagagtggcgcgagagccaagcccgccaaagggtttcccaccctcgcgcgggaacgacacgaaagtgtgaaagggcgcgttgaaaattttggggaccgcttaatgcttcgcgggtatgggtcccccggaagcgcatcgtctgccgtcgtaactataacggcacgtctgccgtcgtaactataacggcacggccatgccgttggcaaatcctgatcgttccttttctttggacgattaggatttagaaggatccaaataccaggcctgcaagtccatttcagcccactaaccaatcggctggtgtggcaatataggcgttgcaaccttctgacgcgagagaaatggcgcgcggcaagcagataacttggcgccaatttcacccattcattttagaggatagaaacctatagaaatcagttttcacctttctctccaaagggtctgatgccatctcttgatcgagagtttcaagaggccaaagtatatgcaagcaagatctgagttaaagaaatgtcttcactggataattctgaagatcgaggtaccccaacaacaacagagactccaaataagtaagtcatattatcatcttcatctgtaatacatataattagttctcctatgattaaaacaatattacaattgattgaagcaatgagattgagggagatcagacgctagtacgaaagcaatcgctgcaagaaaaacctgctccttctgagtcatcaaacttgtgagtgccatatcaggatctgattcatagttccatatgtaccatctaaatccagtccgaccatttcatttcatatcttacattaatcatgtttggtaaaataagaagcgatgccatgttttgcagcacaaataacacaccttcttggatacctcgaataggcatgaattttagttgtgctgatgaggcttggaacttttgggtattctatggaggtcaagtaggattcaatgctaggaagaagtatgagaacacaagtaaaattgacaaggtagttacatcatgtagatttgtatgttccaatcagggctaccgagcacaggacaagagagatcacttgacaaaacttccccgagctgagacaagaacaggttgtgatgcccgaatgggaattaccttagatagggattctggtctttacaccttgcatgatttatctattgaacacaaccacatgctccaactaccagagacaagtcatctaatgtcttcacaacggaagatttctaaagcacaagctactgaaattgaattggccgatgattctggaatcagtcccaaaccctctagcttcgtctcttccattttctgctcatgcatgcgtgcttgacttctctgattacagcaaccatagctgcgtactgttgccaatgcttccaggactgattgctgctagcaacaggagccaaattaattgacaaaaatgatgggaagcaaacctgggtaatatcagggagcttattgctgttattggcagcaaaaatttatggttgaagccactgaatcggcgctcctgctttgcagtgattgagagatgcgtggagagagagacagaggtgagagatgaagatggggaaagtgaaatcgataaaaaaaagcatcgggacttctctcgcgtcagaaggttgcggcgcctatattgccgcaccagccgattggttagtgggcttgaatgaacttgcaggcctggtatttggatccttctaaatcctaatcgtccaaagaaaaggaacgatcaggatttgccaacggcatgaccgtgccgttatagttacgacggcagacgatgcgctccctcctctcagtgagacggttacagtgtacgggttcatacctgtacccattcgcccgctcatcaaagagcggctactcccttcgaaatggcgagttgtgccgcacgcgccgccgccgccgcggatagcagcctggggatcagccgcctgcgcccctgtggctgggagtcggaggccggagatggagtaggagcgctggagcgggcgtcgggcaatcggaggagaggtcagccccggcggtcggcggcgacgtctcctcgaggctcggtcaggaccgagcgaggccaggccagcgtcgacgtcaagcaagcacgaacaggaggtgaggagcgcaggaggctggagcgtcgtcggacatcggcctggcggccggcggcgggcgagtcgggggctcgcgggcccgagtgtcaactgtcaagttggctatgtgacctaggttacaaagatgagcatcagatgtgctgctagtgggccgtgggccgtgggccagttggctagggaagaccgttgggccagttggaatcgtgtttttataggcctggcaactctgtcaactacatctctactatttaaaaaattaaaaggtgtttccatcgtctaaaaattaaaaggtgtttccgtcgtccgtccgtgaaaaagggcaaaaaaaaaaaaaaggtgaaaaaaaatcaaatccggttgcatcataataaggcaaaaaaaaagcaaaaaaaaaattcatacaaaattcaatcggacaacaagcgattgagaaaaaaaaagggaagaaaaataaaaacatcaccgagaagccaccaacgccgtcgtcgccaccgaatccgaccacggggcgtcgtcggatcccctcggccgtcgccactactgccggattcatccacgaccaccgccgacgccaccaccgtcgccagaggaagaagagaggcgacggagggagctgtcgctgccaaatccgcaagcggtagccgccaccaccgacagatccacccgcggaggctgacgacatcgtcgtcgccgtcgacgtcgccggatcttgagggtggagaaggcgtcatcaccgagagggagggacgggcattgaggcaatgaggagagggaaagggagagggggagggacgagtgtcaccgtgcgttatcaccgccgtaccccgctgtcgccgcgccttgccagcgagacaggagggagagggggagagggagtggcgccgccggagtggagaagggaggggaagggaagcggcgccgctggaggggtgaagggagagtcggcgccggtgaggggagggggagaggccgcgtcgtgcggggaggcggccggcggtgggaggggggatgggggatggctgagccgatcggggagggggagagggagggttagggttagggttttgattgattggaactgatctgagccatccatcaaaacaaacggctcggattgatcgagcgttgggctggcctacatcaccggaccgcaccatttgggccacacgtgggccgatggtccaacacatttttggttacggcccgcacggcaagtgaggagtgtggggatattatgtagactttggtcgcttgcaggctgaagaaaaaaataggctgaaaatggctcatagagaaagaatgatttttatttaaataaatgcttaaatgatgtttgtattatcaaaattagcaattaagctcagtaaattccaagaaaatttcaaaaagtgtaattaatatggagaatttaatgaaaattaaatccaaccatatcattttatttctcacacttattttacttgtaaattaatttaattatatacctacctacttaaaaaatacccaaaatattccagaaaatttgtatttcatttaattataatttaatatgttgtaattcaattttctcttttttttctttccgtggcaatgcacgggcagttttgctagttattcatagaaggaaataatagttaattttactctcttgaactatttgatttgagaaattatctatttataaactgttttttcctcattaccagtaaactataaaatatgatccattttactgcttagtagattttttactctttgtatcttcttttcatgttgatttttgagttgtatttttttaagccaacgatgacactattactaaagctcaaaaatattttcaaacattttcatgactatttgtttggacttagaaatctcgatgtttaaattaatcttagatgcttccaacctatataaacaggtttagaaaaaaaaagttcttagaaaaatgtttagaggcagggtgtattgcacgtcccaaactttgtcatttaggtgcaaacacaacgccttagtcacgtgagcatgtggcatacaacatcaaaggtaatcaccttttactgacgtggcgactatatggcggtgttgacttggtcctcgtcatacgtagcgccatgtggtgaccacataagcgtcatgtcaacaccacgtaggacgaagatcatgtcaacaccacgtcagcgaaaccaccctccaaaatcgtcgagggagtcaagttacaccggttttaatagttggaggtcaagatattgtggtttaaggatacgaattagatttgatcactagttaagggactcaaagtgaacttattaaaaaaaaaggtgtttggacttagcttcggcttggtcttttaggttgggactaggctcaaacctgactttttagcttgagctagggtgcacaattctatttgaatttcttccgtaattcgaagctcccggaaccacttggttttataaaatcctttatcgaaattcttcatatcaatgggcttgtattttgaccctaaacgaaattgtgaaccttggtgtagtaaaaatggcttcagtgatgtctgaaactaagggtagatactcgacgtaatgtctgcttggaagcataaaccaatgattttcatagtaccctacgcaatacagtaccgtgcgaattggactagtcttcaaatcaaaccagataagatcatgagctgccatgtacggtgaaacggttgccagctcgtcggcttggtcatctcagccggcgcgcaccgatgaccgatgccccctcgcagcatatggccgagctgggcatcgcacatgatgggcctcgtctaatcccgtagtgcgccgcggcccgtgcggcacgccatgtgcgacgaggcctccccttatctggaacgccgaaaactgaaagcccttgtgccccacacacacaccgccgaacttctgtcgttagccttctttccttcgtccgacccagatcccgcatcacgagaaggcgcgtcggctaggggacggaacggagaaaacgaatgtcgcgtttgcaccggcgcaatccaatcccaaccccagttgccgccgtcgccagcacaagtacgccagtcggtcacaccgcaccactacgctgcgctgtgcagccgacgcgcatcggctcatgcacagcacgcaccctcggagtcgcggaccggggtaaactcgtgagaacgctcgccaaccgctagctgtcacccgcgtgtgccggcgtgcgtcgcgtccggcaacagcgggttaaccggcgaggcgcgcgcctcctcgctcgtggcggggcgtccctgtctcccctcagcctagacacgtcgccctcgatcggtgatcgagtgatcgacgtacgggacaccggggccgcgatcggatcggttttcttgggagatcgagagctctttttcacgacagcgacggacgtgcgtttgcgtgaaagtcttgtccgcctagaaacttaacgagctaatcctggtgacggattggtcagatactcggatcgggtcgtggacgtttaccggccggtcgtccttgtccattcgttattcgtactagcgcgcaggcggcaaggaagggaggcgtcggaggccggctggtcagctactactaccttcgtaagctcttatccggaaatcatgatgagatgttattggtggccataatcttggccccgtatcggcatggacccggcctcccttcccagacgtcacgactcacgcgccggagcccagccgttgatgcacgaattatggccctcgacgaaacgaccgtgacgggttttaatggcgggttcatgcacatgcacgagcacgctcgttgccagttgggatcatgcaccaccctcggtataaagaggggtcaatgttatccacaatgcagttgtagcggctgttcgcggttcatgggttgagaggcgagtactctcggagtcagagagaaaccgatctgaatttttcgcatgcccgtttccttcattgagtaaactaatcccttgaaaacaaataccatatgatgtctctatacgtttgaggtaatcatttgaactcgcatgcacagttatgtatactgaaacgttgcgtaactgaacaaaatcagtcggtgcacgtcatatgctctgtcgcacagggtaacttaggcaggtaatctgccgaccttacatgcttttcatctcgcgtacgagcacgtcttcttcagctaaaaagcctcaacccgtccccagctagcctgtatcgatctccatctctcctggatatgcacaaaaacctattctcaacctcccattcctccggtcaacttaaaaaaaaaaacgcattcgtacttatcgcgaaaataccaatcctccaaaattgaattaatttacgccactaactaaacagcacaggtcgtcgtggaatatactaggtcaaccaatatgaaaatccactcgagcgataagcaccgcgaatagcaaggcgacacatggcaaaacacggcgcttccctcccaaatcaacgcattacgcatatccacccaaccttcttggttgcttcggctactgccggttctgactagtaggaggctggggagcagggccgcgcggtgtctcggcgcgtacgccgtcaaagttcggcagcgctcgcggacggccgggcgggcggtcgtccggcaaatccacgccacgaccgctgaattttcggtcgcggcggcgatcgacccgctggtggaatttgagcgtgggtgacggtggaatttgagcgtgggtgatgggctaggtgcacgtcgtatcagcattgcattgcgacgccctactgaaattgatccggttgtttcgcactagccaatagacacacgactacacgagctgctgcctacttgggcttggtttagtgcgttacgacaagacaacttttttgctgagataattaggagagagatacttaggcgtcagtataaccgaaagttcacagtaagtgaagtagtaattgtgtagtgcatatgggattatttccaccgaccgtgcttaatttatggtttagaactgtcgaccccgtctataagtggtatcacacagtcgttttgagtatagtgtaaagaaggccatagcatgcagtctagattggttgtatttgtattcttacgtgctcaacaacccgagaagataaggagaaagctcagaaagacaactttaaacgctcactacatattacaaaattggttgacaagaacgtttggtgctaaataaaccgaagagggaaaactcagttgaggtcaactgcctatcctagatatctatcactaccgaaagccgggcggggcgaaactgcaaaagcctttcgatgaaagttacgtacgctcacgatatggaataacatataggaaaataacagagctacgacgtcgttcattgacgatattgccgacccaaaatcatcatacatgctgcgccgttcgcttcgggaactagtattccaatatagaatcatccacaagtataaaccacaagcaaagtagggcaagcgaacgaagttttcatttgatagtattcttttacgagactagcgagagaaacagagacgccgtttatccattcagcgaacctcgttcgtgccggcctacctagggtgggcaacgcaagtgcgcaacggatagagatgtccgcgttaagcattacatcgaatacaacgtcggcgtgagctgccccaacgcaagagaacatcgcgattcacgacgacctggacatcacgaggccacgagcgcatccgccgttcacagttcacacaactagaggtcacctctccttcatccggataagctcaagatctctttcttttctcactttgcacgattatttattgcctttctctgcgaacgccagccacaggcacagggcccggcccacccgcggtttccaaaattgaatttcgaatcacgctgcagcagcgtggcccacacgccatgctggcacgctccccttgtacagctgtaatactccacttccacctagcgcagcagtatataaagacgactcatctgctaattctcgaggccaaactcaaagacaagcgaggattagcgatcgataactggagggagtatacagttggaaaattcaaactagacgctgatcatatcgagggagagttcaactcaactggagcgcggagatggcaacgcccaagctgtcccctgtatcgccggtgcggccggaagataagcagcgcgcgtcctcctcgtcgtcgtcgggggcggtggctgcgcctctgagggtgcaggacgatacggcggtcgaggagtacgagcagtacctgcggcttccggagctcgcaaggctgtggaaggataggtgctgtccggagtgggccgacgagggcctcgtcaagccggcgctgcaggcgctggagatcaccttccgcttcatctccgtcgcgctctccgacccgcggggctacgccagccgccgcgagctcgcgcggcggctggaggcgctcgcggcaagggaggtggagctggtggccgcgctctgcgagggcgagcagtgcccgccgctggccgagctgagcgcgtccaaaggcgtgctcccgcgggagcggagcgcgtctgaggtgtggaagattcccggtagcgccgccgcggtggtgtgccaggtcagcgaggccagcctgctcccgcggctcgccgcttgggacaagtccgagaccgtggcggccaggatcaagtacgccatcgagagccagatgcagggctgcgtgttcaccctcggcctcggcgagcccaacctcgccggcaagccggtgctcgagtacgaccgcgtcgtgaggccgcacgagctgcacgccctcaaggcgaagatcgcgccggagcccaagaccggctaccgcaacaaggagaacgaggcgctgttcactatccaccagatactcgagtcctggctgtgcgcggcctcacagcttctcacccgcctaaacaaccggatcgaagcaagaaactgggaggccgcggcgagcgactgctggatcctggaacgcgtctggaagctgctcgccgacgtcgaggacctgcacctgctgatggacccggacgacttcctgcggctcaagagccagctcgcaatacgggcggcaccgggctccgacgcgtcctcctgcttccgctccagggcgctgctgcacgtcgctaacgccacgagggacctcaagaagcgtgtgccatgtgtgcttggcgtcgaggtggaccccaacggcgggccgagggtgcaggaggcagccatgaggctgttccacagccggcggcgcggcgagggcgaggaggccggcaaggtggagctgctgcaggcgttccaggccgtggaggcggcggtgaggaggttcttcttcgcgtaccggcagctcgtggcggcggtgatgggcaccgcggagtcgtcgaccaaccgcgcgctgttctcgccggcggaggagatggaccccctggcgcagatgttcctcgagccgccctacttccccagcctcgacgccgccaagacgttcttggccgactactgggtacggcggatggccggtgacggtgactctgcttcgtccaggcgaagctgagcggcggaaatagtggcggatggatgccgccggaccctgaattttgcagtctttcaaggttgatgatacatttaatacatttatgatttatttctgtagggtagtggtcgcgttcatctttcagttcgagtaaatgttttattgggagacattttggtttagatttgattactagatggtaacgggaaaatgatctaggatcatatatttcaattagagtactgatgatgtatataatgctctgtaaatatgtttcaatggattatgtgtccgatattgataatgtttgatgtactacgaattgtttcaaaggaaaaattatttcctaatcagatagtagtattttttatatatgtttatatacctagttacagcaatgctctataaatgtaatcctggtgatgaatcaaatcaagaggatgtggctcaggccatcttttgagacttaagctgaccatgtcctaatagaagatttgagcggacttggtatatatggacatgagttagagtatgcaactaaaagtaacgaccgagctgtttatgtaatacttgcacatgacagatttggaagaacaatcaattaccccctcatcaacagagaaaaaaaaaggaagaaattccagcgactaatccggacatcacaaaaccgataaggtagaccatagaggaaaaaaacagcattcagccaaagatcattgtactgaagctatacaaccgcatttttacagcttatctaactgactaacatgccaactactacaggaagggttaaggaaggttcaaattaagtaggctgcttctagaatctagacgtgttagacacaatttcgccgttccttacgttcaaagaaccggtccaagtccaactagatatgaactagctagaccaccattttgtccagatcatcccggcaggtgcactgggcaacatgtattcgtcgagaccgcgtcaccagcacatgcctcccagtcagaggcagtctgagttcctcggtaggacgacccaaatggctaaaccagtgggcgattgcacgcaaatccattgtatctgcgcagctgggtataattcctcggattgcactagccggaaagggagatgaacaccatcagcatgcaaatgggcatacaaatacaacatgagttgtctattcatgtagtggtcgtaaaaaaaaaagaaaaagcaaaacactatatcaacattcaaaggattataaccttttcttttctcaattactgcataaaaggcacacttgcaaacacaccatcaacatgcgcccattcatttcaaggtactcccaaaaactctccgcaagcgtcgtcgccaaccttaaacgtatctacgtgtgtagaacgaagcacctttcatccctctgtcatatagtattacttttagaaatctccctgccatctttgatgaaccaaaaaggcctagtacgaaggaaaggagatcaaaagggcatatgggccatttctgacggtaaggcctaatttattgggcctacatgccagcatgtccaacagcaacatcatgactcacgatgccgacgaaattgaaggaataagttcatctgaagtcccttaacttgtcaatgaatccgattttcatccttcaaccagaaaaccagatataacagatcctcaactatcaaaaccggtgcaaatgagatccctcggtggtttacagcggttttggctgacgtggctagtttgactcggtcttcatctaaagtggcgttgacgtgacacttacgtggcagtttgatccgaaaaaataataaaaccaatgggactcacatgccagtttcacacacaaactaataaaaaatgatggggaccacatggaccccacatgctagtctactcacccctcatcttcttcctcctctcccctctcttcgtctcccttacgctgggaatgggccccagatagagaagagcggccacaagacatctctctcttacgcgcgctcgctggtaggccaaggagctcgaggagggaggaaggatgtcgggaggggacacgaggtcgcctagctccttcctgtcgatcatcgcccttctctccgatggccgccacgagaaacccgctcttgccgccggcgcttagcatggcgcgcggatgcatgctgtccagcctcggcgctgctgcagaaggcggtaactaggcaacatgataaatcagtaactaggcaagctacaacaatgcaatcaagaccttcatcccagctcagttgccccaattgcatctaatttcaatccaaacaaatcaaggcatccacaagcgtagcatcttcgatctaaggataatgaataggaaccaaaaaaaagggcgaaccccttcttctgctcgggattactcgagcgcgacggcggcgccgacggccttgagcttggcggtgagcgccgggaggcctctccgccacactcgtcggcctccccgcatcctccctctccgctatctcatctccatcctcgtcatctcctgatgaggtggcggtgcgcggctctcgtagtcgtcatcgttgggcaaggagggagagggggccttcttgccgccggcttgctccgaccacaacggcaccaccgcccctgctctgccggccgaagaagggagaaacagataagtagggagaaacagagaggatagagatgatatgtggggtcacatgggatccactatattttattattttgtgtgaaactgacatgtgggccccatggttttattattatatttggatcacattgccacgtaagcgccacgccagcgcacgtcggacgaagacctggtcaaacgatccacataggcaccacgtcagtcaaaaccggagataaatactatcgagggacctcgattgcacggtttgataagttgaaggatgtgttgtatccggttttcaagactaaggatcatatttggcgacaaattgaggtatctagaatgaacttgtttcgaaattgaagcatctgatctaaaggatcgggcttcggcccagttaagatacatttagggccgattcaggaggcccgtttcccgtgaaaccaactttccggcaaggattgggccgtccccacgtggtttgggcctcccacataggacattgcactgaactcaggaaaaatctgtcatatcagtcagagttcggaatcagacggtgtcatggactatggagtggctggctactgcctactggttactaccatggtgtattggtgtgaaagatgctgaatgacacatttggcacttgaagttaatacgacaaatgttacaacttaactccagtagcagagtagtaataatagttaattaaggtactacaattattcgcctttattcccgggctacttccagcagtgaagtacgccgaggcagctagctgcatgcaatgcatgcatccttggctggcgcatcacgcgcgcaggcagccgtttgagtggttcggggagaggaactgaacagctttgctgcacgtcaaactcttgcgctctttttgtctgcgagccaacatttaaagcccagatagctgcgcaccatccgcggaagcaagcaaagactgtagtacatggagtagacgtaccaggtgctaccactttccacgctccaatacctcaacagtagtaaactacaaaattaaaagcatcttttcgaggaataggagtactaattttagggggaaaactatgaaatccacacattgatccatgcataaaaggtactagtacaacaagttaaagttcccacaccagtacaccacatggacaatgcaaagctcgaatgatcaccgaatgtaccaaacagaaatacaagaaaagcttaaacgcgcactgcagtcatacagtcaggtatgcattgtacttggagaaaggtaacaggagctgctaaaacaaaagataaatttattaaccgagcggtgatatggcattggcactggcactgcgaacctcacttgaacctggtcaggtcgagagtgacctcagcctcggacggcatcaggaactgcctggaggccatctggatgacgtcgacgtcgtcagggtcgccgctgccactgccgctgcttgggccagcttcactgtagtagccacctgcgttggcatggttgctggattggcaaccgaaatccaggctaaccgggtgggttcccgggaacgggtggtacaggctcaggcaagaagaatgcaggccctgatcaacgctaatcccttgctgctgctgctgctgcaccggcggtgccggcacatgcatcccatagtgcaggttgccctgcgggacgaacgggaggtagtacccctctcgctgatcgttgtaggcgttgaggtccggcgccagtgacatgttcaggttcatcgccgctagctgctgggtggtcggtccagccgggttacccaggccaaggtagatccccatttccgatgggttggtgccggtgggctcctgtgtggcaacggttggacctgcgctgaccgatccggcaccgtgcacaatgacgtcggaaggcggtgcaggcacggccggtggcggcggtgtggtctcaacggccgacgggtactggctgcggatgtactcttcaaggggggagagctgccccggcggtgaattcaccacttgcacgctcttcttcttcatccgacgcttcgacttcaggctccgcttagtcgcgttccaatggttcttgacagcattctccgaccggccagggaggcatcttgcgattactgaccaacggttcccataagtcttgtgtgcttcgatcagcatcctgtcgtcctcctcagtccagacgtccttctgcagtataaattgtacagtttttgaatactaatttcatccacgcaatcggcgacacaacacaagaaaatatgccctcgaaccttctaagatcggtagatagttggaataatttaaatctaagcagtacatttattaaggatagaaaaatatatctatatatgatcattaacggctaccatattcatgcagggtgttgtataacactgttgttgtttactccgtagttataaatcaagaagagatttaaccttataaaatgtaatacgcattaattgaagtaggtacaattttggacagatttgcctttgtttttttttcctgcagggacatgatgagtctgaatctttgatcttgtagcccaagatctactgattttctagtcctaaaaacatcatataaaacggaggctttggattactcggtgcctagaacattaagattagcatacacaacaaccgcaacaaaatgaattatttcgataatccctatgctagaatactgcttagcatgattttaatgtaaatctaaaaagaaatcacccctcaaaatcacatggatgaagaaacccccttagatctacataataatataggaatcaagaagttaagagtaaaaccttgatgtctgggcgcaaatgattggtccatctttcgcgacactgcttcccgatccgacctgggaggctctttgcaatcgttgcccacttacgatctccatggagtatcaccatttgtttgagaactctgaaaacaagttaacacatagatataaaaaatcttgttagtgagaaaaataaaatctcactagaagtcgattgatctattacttactcatcttcttgccttgtccatgctcctttgaacgacccagggttaccattgttgcccccaaatcgtgacgactgctgttgaggaacaacaacccctactggaacggtagccatggcgctatagctagctgctagggccccctctggcatcacaaagctagatggagctatgcctatccctgcaacaagaaaccccatgtccgggactgccatggtgatgggagcaccaccaggactttggtagtgggcaccggtgccatggctagagcttgcaaagtacatatgcggcatcccagatcccatcatcgtcggatcttggttgaggaaggagttacctgcagccgccatcaacttgttctttgaggttggaagcatagatttttgattgtgggtggaggattttctaggaaagacagaatgaggtcgattgagagaaagtcaataaggggatagaatagtgtgatggagacctgagtcctctctttatataggagaagagggaatgcatcagccgttcatctgtgaagtgatccaatggtcacaaatagagctagattataaccttccaggtctcttttaagctgtccgtatagcccaggaggttgtgtacaccaagtgcatgcaacgtttgaagaggtgagctggcagacaaaagggtgttgtcaatataaaattcatatcagtagtggcaatgagctgccagtaggataggcattgagcaaaggtatatggctgtatctgcatgccatgcaaagcactctagtgtacatcccatgccaggcatgaatatgaacgttgagtgtgtgtctaccaccatggttgatttggctacagtccttgagcatttaatccagtagtactgatcaagataccataagcaatgctgtaatgcatcaataggatggacggctgtttcaagagtccggccaatgttcaccaaagtatttaaacaggttaatcttattgtcatcacaaatttagaatttgttatcttcagaagtatcaagaattaaactataaaaatactgaatgttaactacccgcggatttaagcttttagaaatctggcgttttgatttcacatacgacaaagatttgtcgtattagtgaaactgcatactaaaaccgacatgtctaaatagggatatatattcaatgccgttacatatctagcagaataaccggtaattagtcgaggtaccgaagaaaaaacaaatgataaatggtgcatgataactactatctatgggataatacatcatatatatgctctaaagtaacgggtttatccttaaatttttggcattttgatgtcgattgtcccattctctctaagtgaaacgccaacaccaattcgtactagctaggttcatccatgtaagcaattgagcggcagccatctgataccaaaaagacaaaatagagataaaggaaccatagccattggatgaagaatgaccaatggagctaattggtcctcatgagtcatatccaaatgggagcggttgttcaaagactgattgataagtatataagaaaactagacgttggggcgccgtaatggcacgcctcctgattacttcatccaattacttcatttgctccttgtactttccaaggagaatgcttaaacgtatatgattaactacttaccacaaatgattagtacagtagcagcttgagccgtgacatctttaacttactaactaccattaaccctaggtaatcagtgttacacaacataacgttttacacaagctttcttagggcctgttttgtagagctccaactcccaaaatttagcttcaggagttgagtatggagtggagttgtggagctgcctaaacccaactacacctctctagttcattctatgagagcgcttcacctagctccgctcccattttaggtggagcagaaactatttggctgggctttagctccaaaaaagctggagctggagctgtgccaaacaggcccttagtacacggaagccttttagaagggccaaaacgtgtacaagattaaacaatttcagctagaaagctttcaccacataggctaacaatcatttggaaccacaaataaggaagaagtcaatatttattaaagaggattgtcttctagtttatgcaattgtgctaatcttgtgtaggtacataaacgggattctcagctgagaagtgaggaccaaactgagatgaacaagctcatttgttgtaaaggtcacttggagtatttggtcaccataatcatacattcattcatgggtgtccaatttgaaaaagtttcaatgtttgtgcagattttatttcttcatggatgccaactagtcagcgagtaactttatatgtgtggcatttgtagttgatgattgtactattgatgtactcgtagcaggtagcaacaaatatgatcaaaatggattcttttcatcataaggtaatggaaaacgattttctttatggaaaggatcagggaatcaatttgctggataaaaagagccttgaaattaatcgggtattagcacaactacagatttgatttttccatacgaggcctcccccaggctataaatggaccataactgaccccgcatgcaaaaaatcgctcccctggggggcggttcaaggccagtctgcggtaatgtattatcgcaagtggacctcttattgtgcaatgacccgcaccgagccactgacaccctctctccacctccctctctctagctatcccgtcctctctctctctctctctctctctctctctctcagcgtgcaatggcagagggcggcgaaggtcagccttccttctcctgctctcccatcacctttccccctccgctccgatggtgactgagcatggaggcaacggatcgacgacgatttctttgcctctcttgtagacccaccgctgactggccttgagaggggtggatccggcgatggcatggcaaagaggaggcggcagggaggttgagcgcagccacatgaggatggatgatgaggacattactcctttggatacgcaaaatacttctcatgttttcgtacaaggtccaatcactagagctcacacccgacaattgcatttataggtgagcttgttcctaagtacttcttcatgtgatttttaggaaagattgttacctaataattttattatgattaggaactatggagaagaacaaggagagaagctagaagatggacaagatcatcaagggcattcaagtcaatatggaggcccaaatcataccatgttcgagtctacctcgggctccctgagcagtctgtgcaaaaaatgtcgcacaagtcacattcggactccatcttcgacgttctacctatgtatggaaaggtaacaagaccgcctttccaatggacctggtctcacatcattccttcaaagtcaaatggaattgttgaaacacgtggcgtctagaatatgtacgggtgttgcatcaccgtcttttgggctgttgggccgtgtatcgtgttggaatcaaataaggatgcatccaggtgtccttgcctccttggtcgaccttagaacctatatatattgtagccactatcaagttagggttgggtttacttagattatttataccattccagtttcgtcgttcattgatttgtggaaccccaacttcgagttattaatcaatcatctgcatttgtgttgcaacctttcttgttcttgcttatgttttcaatttgcagcaacaaggtcaatcggtttcgacatggttgataaccagagaagacgtggtgctgcaattatagggttcggatagtgttgatcagaagcacgataatgtgtcaagtttccaccaaattgatagttttctctacttgacggaagatcaggcaccccgttgccatcaacagatctagtgcggtgaccttgggaggggcggggagtagtgaagagggtcgcatcgtgcctctctcttcagcctgtctcggtggcggcgatggcagtggaggtggcgcatccgcacgatggtggtggcgtcggccggatccggcggcgaagaagacggtggaggtggccagatcttcatttgttttatgtttgtttgtggatggagttcatgtttgtggatgtggatgaagtttatgtttgttcgcatttggtttttggttctgtttcaatttcaatttcaagtaatggattaatggattctgttgttgtcgtgatgaacttttggatctggatctagagctagggtttgtgagaggagaagggatttggggatattttgattttattttttcacccaaaaaacattatcgcagttggccgtcttaaccggtcatgttggataatcgattcacccatgcggctggatggacctacgataatctctattttcgtagacacttgtgggaaggcgggctgccattcgactgcgaaaataggttttggccgagaatgtaaaaacactttatgtagtagttgttaatagtgaaatttggtaagctccaaagtcatcatcggcctagagtcagtatcgacttcagagccatggaatcggccgatgggaattatcaagtcgccaatagtcggattcttagtagattcggttatgaaaattaatctactaaatgaagtttatctagaagtgaccgagttcaaggaggatgcggcatgtcaatttatctattaattaagaatagtctattagtttccttttatctttagggaagtatgtttagtgttcgataaggactttatgttttccttttatctttaggaaagtttctttcttatcctacaaggattagtatctacccatgggtatacatatatacacccggggttattgtaattgatctctcgatcaatactactctcggcgcatcgctaccttcttttctgaggttttacttatcaaccggcggaatttggcacttgacgcgggcctgcatcgattcagttcgatctccgacgaaggggtaagtcttacgttccatcggccctggtgaatctatcagctacattggtgttgttcaaagctgtatcgcttcgatctcttggatcactctagtttggttgatatatttgcctaccttatatctcaattctatctctaattgcattgtgtttagaaaagcatcagtttagttgggactgtcttggttatgtctgatcttctgtcttagccgatatatctctacaatcacaatgctgttataaatagacttgttatatccatcacattagacagatctatcggctcatcaagtattagattatcatatataatctcatgctgcatcggttaggtccgacctagtgttttatcgcggtactagccgataagttatctggacgttgcatcggcttacaaagattacatacaagttggatttagccgattgcaacaaaggtctcactgtttatctaaatcgattggattttatggcatcggacttttagccgatgtatatgctttaaccatcggatcagtacttatcctatcatattattattagccgattgatttctattggattatattatttttatatcttattatcatcagacgattgtctttatatcattgtctacattgaacatatagctgattgcttaaaaccctatcgacatcggctagaatcagcatcgactaatatcggctatcggctgatattactccattggcttgtcagccgatctgctgtttacatatcttgtcagctgcatgatcaaactgactggcacgcccgcatctcattaaaatcttggacatgcactggagctaagcagatctcctaggccagtgtgttttttttgcatcaatagtagtgtagataaatgggtgtcacgccctgattttcttttagaactttaaaaatcatttaataatttatttatataatttatttaatatgtaaatcaattaacaagtgaagtaaatgggaaaccatatatctgtcaagaccaaatttccatataattatgattaatcggtattccattgattgtttgtatcctctcagtccgacaactgtatttcattatccacaacactgactttatttagttttaagggaaaccaaagctaaaaactaaagagtcattggtatttccaaaggcatgttttaattaacatatattcttagtatgatcgatcgtcatgacaataagatccatttaattaattgttatatctttttgaagtgggaacttaatttatcagagcgacttattgggatagaatacggagtggaaggtattgatggatagattcctcattcctagcacagcatatgacattgcgtttttacattgcaaaatggggatggttagggtgataaaattgatggcccggtaagcccattagttgcgtaggactatgtggttggccagctttgggaataagtccagttcaactccttcaatatatgtctaatatgattcatctccctccaactattaaaacaggtacaatttgattctctcgacagtattgacggtggctttcattgatgtggctaattagcttggtctatccaactgagtcagcatgtgagacccgcatatcattctcactccccttccgttcttccccattcctctctttcccccttctctctctctctctcttccccctttggcccttcctcccatggctgtctcctcttgtccctcttctccacagcggcggcggtcgcggtgggactacaagcgggagcagtgacgggacgacgagaaggatcaacggcgggacgaagaacgggagcagcggcggctggcagtgagcgctcctcttctctctcccaccctggcatgcaacacgtaggctccctttcacaccagcttttgccgtggggaaggtacttttgtctcctctccttagcgatgacgtcagagagggacgattgcaatgagcaccgatcgggctctccccgtggcgccatctcatgctcccacgcacgccgccgcgacatgctcgatgaagaggctctcctgggcgtcgtcatcatccaggatttggctcccagggcgttcagggtgtgcttgccaagctgcgctcatggccaccacgtggtgtcacacctcctgactcccaggtggctccaggtctcgactcaccgccaccgcctagagctatgcatgggtcggccactgcctaggaacgcatgagtcgggagggcaagagaggagggaaaatgggaagttggaggtggcaaaggggactcccttcgcccttagccggcgcaccatgccacacctccctggagttcctccgtcaccgccgctctattgccaatgccccgcctccccgctaacgcattgctactgctgagaagacgatatggggagagagagtgggtagagaagggatagagtgttgggatgacatgtgggccctactcttttaaaagtgtatttgataattgggttgccatgtgggtgtcttggtcatcgaaaattgccgttaatattgttgagagagtcaaattatactagttttaatagttagggtcaagatatatggtattacggttgagggataagaaacacattaaacctatattttagggagtgaaagtgaacttatacccagctttgtaatatgggactattgttttaaggccttggtgtgagcatatgggctgcttaggtgttgggttcaacgggctttttaactgctatgggctttctcttaaaaagttgatacaagtttttctttaatcagcttttatgtacgcagaagtcttaattggaccatgtcgaaaaaaaaaaaagagagtctgaattggacgcaatgtagtccagaaccgccagagcctcgaccaaatctattggatgtggactgccccaaagttcactgaatcagacatggcaaaagagtcagtcgaagctgctcacatgtgggtcgggtcctcattcttcagctatacagtacacgatacaaagcgtgattctgtgattctgtcaagaatggctgaactatcctggaattttcaaatcccttctcaaccagcttgtgctactcgcgtgaaaatatctgttacatatattcctgatcaagtaccgaagatgtgatcggtaatcatgcgtagcgtagcaaaggatgtcaggatgatgataatacatgcacaattcgtagctaatcagcttcaaaagacggaaatcccaaagcaaataggcttattctgccacgtgcctctatcaatctcgataaagcaagcaactactaagctgcagaatgaaatcatggagcacccctctccctcctccggcgcttgtcatcatcccattgctgcgtactaagctacactaatattctgaacccccacacttcgccatggatttttcctcttggaaataactcaaaactctggaccctagctccgtcagaggggccatgcgagatcgagcaacacggcgaggctcatgtcgaggcctgatcaagaacagcagtttagaataagttcaggcacaatcttacactctgcaggtggcccagagcatgtgcccggttgaattgattgatagctcgcgtcgatcgatcgtgctacataaccggcaactcgatcggtgggcgtacatttgacgagctaggttgcatccaccgtacatgtcatgatcggaaccatctctttctctgatctagttgcttgctgaagcgacatgagttagtagattcgagcagatgtagttttcatggagctgtgagcatggccatgtcgggtttggctactcatcccttgcagattcagaagcttcggatataatgtggtcttctgaagttctgatcgatcagcaaacaggaaaacatatcgatgatcgaatatgagtaagcagttcggtggaagattgcgatggttaagtttctcttcaaactctgtagtccttagcaccgcgtttcccatggaattctggcaacttcaattcattatcggccggtgatgctctggtagagtaattccactatggcaaaaaaagtactgaaaagactcggcttaatttgtggggtattagtgcccatcattgcatcgcattgtagatcatacccactgatgactagttagcatccatgctgattaatttatcagagattaagccatttattcggtggctcgaatgctctacatcatcaggcatcgacggatggagtgtggacagaaggcagacgacaaggaattatttcttgcattgggcacacgccgatgacgatgatttactgaattcttaagaagttctactgcatttacagttacatttctaggaagctcctctagtcctctgtgtccccctgtgaccgtcattccgttatgcatttcttcctgtagaaacagcaccacagctcagctcaacaggggcttcgatgaagacaatagtctttgttagaccccatgcagtccggattgcagacggcactgtatattgcatttcttcatttttgacgcctagtttcttggcatgtttactgctctaattatactacctctagttcagaatatggcttacacagttacactacaagcggacatcaaaatggaggatcttttacacggaaaaaagggactcagaaatatatgggcgtgcaatatgatcacattttttctttctttatactcctaattatagtagtgcagtttatttttttagaatatactttttttaataattcatgtttatatacatgcatggaaaataatagtagaaatatacacttgaagtggagacgctcacaccgcggtgcggatttgtgagcgcacccgcgtgatcgatctatgacacacgtatatttatacaattcctccccatatataagcgtaaattattaaaaaaaagtgtattctaaattttgttcgtttagcttaattgatcctccaatgcgcattattgcacctttgaattatttggtaccttctgctaagaaacatgaagagtttttatcatgaaatctacttccttcagaacgcctagcttgggttcaatctattatttatgcaaatcctcaacaaccctgccttgcaataaagccaccaatgggctgtatgcgcagaacttctgcacccatgcacaagttcaccagggggctcagatcatatcagatattactaatccctttttacatgtgcaacacggccgctaagcgctaattatcaactgctggcacccccgttcacatcctttaactaaagtaactttacagagcacgggatactttcctgactttccagaatgttctacgtgagtagtactaaatatcattagcacatcgttttaatttagcagtataggagtacacgtatctattatattattaaaggaatagaaaaagaagcctccaccttcgctctcatggtctagaaattctcacattaatcggagaaaaagaaaaggcagagtccatatagaaatacaatttagaaatagctgaatctatctattatatgattaaaacaactttaaaaggaggcaccacgttcgctgtgggggttagaaattccctca

SEQ ID NO: 43865 - DNA, 1823 bp, Oryza sativa
gcctctcgtcacagcgcccctcctcatctcggtgatgcctccctccgttcttcctcctcgccccatctcctccccctagcttacggtagtagctcgagtagactccccgtagctagccggcgccgccccgaccgttgccgtcgctcgccgcgtgctcgccgccatcgccgctcgagctccgtagcacccgcacgtcgccagcctcgctcggcgtagctccgtccaatccgacgctagtatcggattcccgtggtcgcgtggatgctctcaccgccgggaatcggtctctcgtgacctcgtcgccgtttccctcttctctcgccgccggttgccgccgccgcaatccgccgccgtcgagcaacctccgacgaatccgagccgttggctcgtctccccttgtcacgtgcaaccgcccggtgtgcacgcttttgcccgtatcaccgtggttcgcaccgccgctcgccaccgccgcccgccgtccattcgcagccgggtcgtcgtctacctcccgccggcccgcgtggcagccacgtaggcaccacgtcggcgccagctcagcctagaccggatcgagccgaccccggtcaatccctccccgtgcgcgcgttccaccgcgagccgtgaggctgcgcgtgggcccgccgcacctgcgtccaccgcggaccgcgcgcatgcaccgcgtcccttccccgcccgcgcgcgtgcgtcgcgtgctccctccgcccggtgagccgagccactgacaagcgggtcccacccgggaccgcgcatggtgagcccggtccaccggctctctctctcctccctcccgcgcgcgcgagtttgggccgccttgggccggccggcccatttagctcggccagaccgctccatttctcttaggccgcgccctagccgtccgagaaaagtctatattccctccctcccttcttttctttttcttttccaaaaaaggatttaaataaatcctttttcctttagaccaaaaatccaataatcttagaaattcaatatcttcccaccgtaaatccgattgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgagaatttcgaggatcaagctccggatctcgagcaaggccagccacctttgaacatcttgagcctctatttagaatttaattatattgcttccgaaatattatgcattgataggatcacacttaatctgttgtcccgtctgcaaggcagattggcagacctacctaatttgttacatttgatccttcctttgttaactgttataccatgtccccttgtaaccacccagttgcgcctcgatattcgtgcactctgtgcgagtatcgacggtcgccttcaaacttaaaatctgagtaacaacttgggtaaaactggagttttacaacagacttggaaaacccgacacctgggtcggtgcttgcgaactaaatgaatttccaaaaccgcggaccggcgaacataccgggtgtacggtttcccgctctcgcacttaaggaccgattcccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcg

SEQ ID NO: 43866 - DNA, 3845 bp, Oryza sativa
ggcgctacagaccaacccccctaacaagaatctcgaccccgagattcagcacctaagggagcagctccggaaactcggcgcggagatgatcttatcgttcccaggttgcttcatctttggaatggttgctccactgaaccttgtagaacttgatggtctttcgtcgagtctgacgttctgcctcttcaagaactctgatcggtatttctttgtaggtcagattcttttccagctcgatattgcccaggggaacttgttcttctggaacacgaagacatttcttcaactgagacacgtgaaacacgttgtgcacatctgcgagaccttcaggtaactcaagctgataagccacttcgccacgtctggcggttatgaggtaggggccgatgtagcggggtgctaacttgctggacatcccaaacctcctcataccacggagaggtgatacccgcaggtacacatgatctcctttttcaaactcgagatcacgtctccgattgtcggtgtaacttttctggcggttctgagctgtcttcaaatgttctcggatcagcttaacttgctcttctgctgccttgagtatgtcggggccaaacactagtgcttccccgacctcattccagcacaagggggtgcagcactttcttccgaacattgcctcattcagcgacatctgaatgctggcctgataactattgttgtaggagaactcggcatacggcaaacaacgatcccaagtgccttcgaaatccagggcacacgcacgaagcatgtcttctaggatctgatttactctttctgtctgaccatcggtctgcggatggtaagctatactaaaatttaaatcggttccgagagcttcatgcaactgcttccagaaccttgaggtgaactaagtgcctcgatctgacacaatcttcttgggacaaccaaatctacatacgacatgggtcatgtagagttctgccagtttatttccatcaaaggtagttttcactggcacgaaatgagccgatttcgtgagtcgatccacgattacccagatggagtcgtacccgctaggggttcttggcaaaccggtgatgaaatccattccgatctcttcccatttccattcggggatcggtagctggcctttgatgctttgctttaactctttggcaaatatcacacagagccacatattccgtgacatctcgcttcattccagcccaccagaaatatcccttaatgtcctggtacatttttgtacttcctggatgaatggagtaggcggactcatgggcttcttttaaaatgatatcttttaattctttcttggctggtacacagatgcgtgatccgtaccacactatgccttggtcatctatggtgaaactggtgtctttcttctcgtgtattctttttattaactcttttataccttcatcatctttctgagcttcttggatttgcgattccagtgtaggttgcacggtcaggttagcagggacgcctgactgtaccactgtcagccttaacttctctagttctctgcatagacaatcttggtctggccatacttgaactgcattgcaataggtcttgcgacttagcgtatcagcgaccacattagctttactgggatggtaatgaattccaagatcgtaatccttgattagttccaaccatcttctctgcctcatatttaactcggtgtgagtgaagatatacttaagactcttatgatcggtgtatacttcacatctgttcccgattaggtagtgtcggcagatcttaagagcatgaaccacggctgccaactcaagatcatgggtgggatagttgacttcatgaggcctaagctgcctggatgcataggccataacctttcgctcttgcattaggacacatcccaagccttgccttgatgcatcacagaagatttcgaaatcctttcgtatatctggcaaggtgagaaccggggcagtggtcaaccttttcttcatttcttgaaagctatcttcacaggttgttgaccattccaactccttttccttttttaacaactcggtcataggtctggctagcttagagaacccttcgatgaatcttcgataatatccagctaggccaaggaaactgcggatctctgacacattcttgggcggattccaagcaagtacggcttcaaacttgctggggtctacttcgacaccgttggaggagatcacgtgtccaagaaatgctactcggtccaaccaaaattcgcatttcgagaacttagcgaatagttgatgatccctgagcttttccattatcagcctcaggtgttcaacatgttcttcctcattcttggagtatatcaggatgtcatcgatgaataccacaacaaactggtccaggtattccatgaagattttgttcatcaggttcatgaagaatgctagagcattggtgagtccgaaagacatcactgtgaactcatacagaccatagcgcgttgagaaagcggtcctcgggatatcttcagatctgattttcaactggtggtaacctgatcttaggtcaattttagagaaaacttttgctccttcaagttgatcgaacagatcgtcaatccgtggcaacgggtacttgttctttatagttacttcattcagggctctatagtcaattaccattctctcagagccatcctttttcttaaccaggagcactggggctccccaaggggatgagctaggtcgcacataacctttactctccagttcttcgatctgccttttgacttctgctaactcgttagctgccattcggtagggtcttttcgcaatcggtgcggtacctggtgctaattctatggagaacttgatctctcggtctggtggcatactcgataactcttctggaaatatgtcgtgatattcacagactatgggcaccgattccaaaggagtggcttgcaaactggttaggatagaccgacttgcgataagggtgttaggggtaaagcagacttgctttcctccaggtccttgcaaggtgatagacctttcggcacaatctatctgtcctttgtgcttagccaaccaatccatccctaggatgatgtccaagctttgcgagtctaggactatcggtttggctaggaagtcaacttcctcaattctaaggttaacttctgggcatattttagttgcccttatatcccttctaggggtgacggagcgtggggctcctcaccaggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgagtgaaggaatacagagagccggagagccagagagagttcaggctctagaacccattcgccagagtcccaacccctttctcttttttctcctctcctaggcctgggcctcctttttatctggtcaggggtcaccacaagggcctccagctacctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatgaatctgaccgggactgacataccaactccaggagttagcacgccggctccggctagggacgagagccaggaagctctcatcattccgacgggacggggcgaggcgtgtgacaggcc

SEQ ID NO: 43867 - DNA, 17632 bp, Oryza sativa
ggggagacagagggaggggtggccacgtcaccctcgggcccgaccgccccgagggggtcaggccacgtgggtgaccgcggctacccaagcctctagtcacgatacccccggccccatgtcaccgacaaggggaatgtactatcattggtactcgcaaattttgggttttccggggcacacctggccgttgggtcatatcgacctcccgttcaccttcggtggttccgccaacttccgcacggagcgggtggacttcgatgtgacctctgacatgcccggggtccccagggaggtgattgagcaccgtctcgccgtgcggccgggcgcaaggccggtccgacagaaagtgcggcggcaggccccggaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtattttctagatgcatactctggttatcatcagattcgcatggctagggaggatgaggaaaaactgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcatgcctgcgggcaagcttctcgggttcttggtctctgcccgaggcatcgaggccaaccccgagaagatacgagctatagagcggatgcgcccccccagtaagcttagggatgtgcagtgcgtcaccggctgcatggccgccctaagtcggttcatatcgaggctgggagagaaggcactacccctatttaagctcctcaaatgctccgggccgtttacctggacggaggaggctgagcgggccttcactcagttgaaggcgtacctcagttctcccccagtcttggtcgccccggagccagatgagccgttgctactcagagtggcagctggactggggatccgccgcctcctggtgttaggcgactcccagttggtcgttaaccaggtctgtcaggagtaccagtgctctgacccgcagatggacgcttacgtgcgccaggtgcggcgtatggagcgccatttcgacgggatagagcttcggcacgtgcccagacgggataacgcggtcgccaacgaactctcaaggctcgcttcctcgcgagcccagaccccaccgggcgcctttgaagaaaggcttgcccagccgtcggcgcgacccgaccccgtaggggagacggacgcgcctgaacggcccccgaggcccgtcggagcccaggcctcgggacccgaggggagcgctcccagctcccctagattgattgcttggatcactgagatccaggcgtacctcgcagataagactctactcgaggaccgcgaagggagtgaacgcgtccggcgcatctccaagcgctacgtgctggtggaagggaccctctatcggcgcgcggctaacggagtcctcctgaagtgcattcctcgggaacaaagcgtcgagcttctcgccgatgtccatgaaggcgagtgtggagcccactccgcctcacgcaccttggttggcaaggcctttcgccagggtttctattggccgacggctctcaacgatgcggtcgacctggtccggcggtgcagggcgtgccagtttcacgccaggcaaacccatcagccggcccaggctctgcaaaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctctcccgcccacccaagaagcaatggccaaatggagcgcgccaacgcggaaatcctcaagggcctcaaaactaagaccttcaacatcctcaagaagcatggcgactcgtggatcgaggagcttccagcggtgctctgggcgaaccgaaccacgccaagccgagcaaccggggaaatgcctttcttcctcgtctacggcgcggaggtggtcctcccatctgagctcaccctgaggtcccctcgggtcaccatgtattgcgaggctgatcaagatcagcttcgccgagacgacctcgactacttggaagagcgaaggcggcgcgcggccctccgagccgcgcgctaccagcagagcctgcggcgctaccatcagcgccacgtccgggcctgatcactctgcgtcgacgacctcgtcctacgccgcgtccaaacgcgtgctggactaagcaagctctcaccaatgtgggagggtccgtatcgagtgatcggcgtccctcggccgggctccgttcggctggccacgggcgacggcacagagttgcctaacccgtggaacatcgaacaccttcgtcgcttctacccctagtgggggtcgggtgtcatgtctcgggctcgggccaaccccgcaccccccgggcgtgcagggttggccgggggctaccatatgcacatacttaccttttttctcttctgtatttcaataaaagcattttcgatttcctgacgaccgtgtctgtgccatcgtttccttttgaagaatcttggcttgaattagcacgctcgtgctcgaccctgccctcggtggcccgggccggctaaaatcgccaaacggggcccagaaccgagccgtgccccggggcgtggtgaactctgggggggaatcggcaaaggcccacaatcgggtcatccataaccctcggtcaccacgctcccggcctggccagtctcgacacgaggatctccccaggcactagccccgacacgcgccgtttgaggctggggcctgggcacgagcccttgttcaagccaagacacagaaggaccgcggcacagaccgtcctcgtctcatacacacaacaaacagaaccgacgcagaaatttcctctttacttgattgcagattaaatcagtctatacaagaagggggcccgaaggcctcggaagaagaaggagaagttattaagattggcgggggcctgggggctcactccaacgcgcccgggtcgtcggcctcgtcgtcactgtcgtccgcaccgtcgtcaccgccctcctcgtcggagtcgagcgcgaacgcgagccgaggggccgtaccctcgaagctgtggacgatgtggtcggcggcgtcccggacctgcgcgcgcgcgccgtccttggttccgggagggaactcttccagcgctgcccacggggagaagtcagggtccctggcctggtagcttgccagtacgagctccaccgccccccgggcgaggtccctcgaggatgacttgatcgtctcctcgagctcctctgggagccgctcgagggccccggccatctctgagagacgctgggcgaggcccccctggttggcggcgtacttcgcgtaccgcccgccccagaggcccgcctgccgcccgacgcggtctagacgggagacggcgtcccgaagcatgccgggccctacctcgctcgccaagcggagggcctcgacctccccggcggacgagtccagcgcgccctgcagctcggcgatggtgtgttcggcggctgcgaggcgggcggctaggtcgccgtggcccgcggccgccccgtcgctgtgcgctctcgcgtccagctccttcgcccgcgcctcgagctcagcggcccgctgatccagtgcggccttctcggcgcaggcgccttccagattgcggcgcgcctgctcctcccgcgctgcctcgcggaggaacaggctgtccgccagccgctgcgccgcggcctcggcctcctcgagagctcgcccccgctcggtgagcgcgtcctcgcggaggcggagtgcggactcctcttcggcgcaggcggcctcgtgcgccaccagtgttgcctcccggttggcgacggcggcctcgcggtcggccaggtctctctccttcgcgtccagggcgcgggcgcgctcctctagcgccgtggcgcgagcctcaaggccctcttcacgctgacgggacgccgcctcgttctccgccgcccaccgttcccgggcagcggcggcgtcaaggactccccgggcggcgtcgagcttctcctctagctccgccgcccggctcccgtattagaggcggaggtcgtcccgcgcctcgtcgagcacggcggtggcgatgagggcagtctcccgctcctcctccacctccctggcgatctccgccaggtccctacgacgggcctcgagctgtgaggtgtgccagcggtgcgccttgcggcccgcctccaccatggcctccaccgagcgccgccccttgtcgacgcgcgcccacgccgcgtcgagctccgcccgctccgcctgtagggcctccatctgggcacttaaccagtccagcaccgtgctgttcgcggcggccaaggcctgcaggaagggcttcgcgctcagtggggcagcggaagacagaggggagagccgcctcggtgtgggtgccgcgcggctcggcccgccgatcgacgtgccggactcgggggcgtcccccgaagctggctcgtcccaagcgtcgcccgaggggtcgggcccgagcggcgcgcccgcggcctcgtcgtgggtggcctcggaagtcgtcgtcgcctcgggcggagtcgggtcgggggtttggcaggccgtctggcgtgcgcgcgccgcctctgcctcccggacggactcctcggcccggtggagtctggcctcctcccgagcggcctcctcagcctggcgaacccggacggcctcctgggcagcctcctcggcttcccggaggcggtccgcggcttctcgccggtcagcttcccgcctccgggcctccgcggtcgccgtctcctcggcctcagaccggccggacttggaatggcgggggggcgcgacgggatctcgctgaggcagaagaaaaaccagaagacaaaaagaaacgggtgagtgaaaactcgccttgggagatgggagaatgaatacggccgcggtgggcgcggggacgaacctgcggggaggtcggctaaacgaccacctcgggggcgagatgaggttcccccggcatggcacgatcccccccatcttgcggagccgtttcttctttcgctccccctcgggctgcggcgtcggcacggcaccctccgggcgcctgctgctggcacgcaccgccccgccccctcggggaggagatgggggaggggtaccctcctgcttcctcttcccccgggcgtcggcagggcggctgccccccgggcccccgtcgcagggcccagaagcacgaccccctcccggggtagattattcccccctgcggctcccgcccgcgccatcgtggcctcggggggcccgctccccggacgccccgaccacctgcatgatggccaggatcttggcgcgctctggatcacagcagagggggaggaccccttgggggatgagggatgcctccacggagctgagattcagcacccgttggaccaccatcctgaagtcctcagggtcccagtcccatttgcgcccctggtgggtcctaatgtagtcctcgggcccggtgtactcccaggcgccctgggcgcgccgctggaacggcgcgatccggcgacgaaggtagtcgccgaacaccatggcccccgtgagtccctgggatcgcagacccgccaggcggtcaagaacggcgtcgtagccgtctcccagatctaccgccgcccgccagctggaggcctgcgccgggggctggctcggaagtcggaagcgcgcttcatcggcgaggggggtgtagaaccaatcgctcttccagtcgtcccactttttgcggaggatgcagggaatgtagcggtttagcacctgcccccgcggctggaagtagcagccaccgactaccgtcggcggcgacaccggctgtacggtgaagaaccaccggaatagccggagagatggacgcaccccgataaacatctcacacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcaccgggcgtccctcacccagcgcgaccacctcccggccggtggcagattccggcatgaatcggcgcggcagcccggcctgcctctcgctcacgatgcgggaaggcggcagcacgctaccatcgagcggtgcggagccccgtgccatgacaccggcggaggagaagcttgagagcgagcgagtgcggcaagggtagggcacaggaaacgaagagttagagcacaagtggcgaaggcaaggggaagagtggcgagaggaaagaaacgaatcccttgctcggcgtctttacacccttgccaatgctatgcccggctcctcgcttcccgcgcccgctacctcgccccctcgtttctcgcgcccacgcctccactaaccccactcgcccgtttgcggcgcacgcggcagatgtgcggccgtagcggttgagatggggcagattgtgcgcgcattaactacgcccgccaaccgtgaaaagcgccatcatcatgtctccaggcgaaacgaaccggctcgtcccgattcgcgcgctgctcgagtaatgtagcggtcttaaagaggccgctcattattgtcggtcggttttcctttgccgatgcgcgcgatttgcgaccgctgggtttctgcccgcctgtagggaccggccccacctgtcaccgggcctaaggagtggcgtcacgcccgagcgcttccctcgaggggggcgattgccctggcgtgacgccgggggctactgtcggtgacatggggccgggggtatcgtgactagaggcttgggtagccgcggtcacccacgtggcctaaccccctcgggggggtcgagcccgagggtgacgtggccacccctccctctgtctccccgaggggtcgggccgctcccgtttcggccccgagggctggggcgccccgaccccctgtggttttggcgccacgtgtgtgggttaggtgagcacagcgggctcacctaaccgcatttatagcaagttggacgagcgcgccacgccgcatttaatgcggcgcagcgcacgcttatccggtccgtgaccggtcgcggtgtgtgaccggtcacagatcggtcagatcgcgggttaggtggcaacaggcggcctgtcacacgcctcgccccatcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcctttcttaggtagttggaggcccttgtggtgacccctgaccagataaaaaggaggcccaggcctaggagagaaagggggaggagaaaaaagagaaaggggttgggactctagcgaatgggttctagagcctgaactctctctggctctccggctctctgtattccttcactcacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcacaaccgtttcttttcacaaaagcttgcgatatgaaaaaatgtgaagctccagaatcaaacagaactattgcgggtacggagttgacagagaacatacccatcacaacgtctggagcatcctaagcggtctcagcttgaatgtggttcacccggcctcgaccaaagttgttggaagcacgggaaccttgtccacttgcctgcgagctaggactggactgagctgctgctggagtaggagttctggcagtgctgccattagcatgccctgagttcaagttggtaggattctgagggcactgtctggcatagtgacccatcaggttgcaccggaaacactgaactgctgacagtcctggcggtgacttgaaagaggtaacactatttgctgcagtattgccatttggggcacgctgctgcggctgaggtgccggatggttcatctgaggacgaggggcatagcctggctggcggttagcctgagtgaccgactggtgatattgcatgggttgtccaaagcgagggcgaggtgcgcctcaggaagaattcccccgatggttagacttgcgtttcttatattcttcggttgcctcttttctggcatcctcaagtataagtgccttgttgatcatgtgctgaaaagtggggaagtcatgagcaagcaactggagcctcattccaactgtgactcctttcaagaacttcctgatcttcttcttgtctgtgtccacttcctcaggagagtaccgagccaacttgttgaactgacttaggtactcattgacacgactattgccttgcttaagcctgttaaattcttctttcttcatgtcaatagtactttcaggcacatgagctacacggaaagctgtagcgaactcattccatggaatgttagtgggttcgaggtgtgctgtcacgtcctgataaattcatcccgaattaaaaatcattcgctaaaaggaataatagaattaattaaaattcgaaaagaaattggcaaacactaaaatacgtacaagaaaaattcaaatgcggcccggagaatttttgttaaattctccttggtctaaaaggagccctcaaattttacttgaattttcagagcacaaataataattattaagaaataaacaaagttaaaaaggttttatgaaaagaaaaaccctaaaaagtccttttttcccccttccccacttgggccggctcggcccatctccctccctctctctcctcctccccgcggcccactcggcctctccccgcgcgcgcgccgctgacgggcgggcccgcccgccaccctcgctgacgggtggggcccacctgtcatccctatcctcccgccgctcccgccgcctcgcccgtgccctagcgccgccgccgctgcgaatcccgccgcctcccgccgtccccgcgcgcaataaagagggggaaatcactccccgtgattccctctctttccccccatttttccctccctctctccctcggattcggttggaaaccgctcccctaatcccgccggcgccattgatggcggccgacctcccgcgccggtttcctcccttccccggccaccctctctcgccccggctctatttaaaccctccccgcaccccctgtgtccggttccgcctctcgccgctctctctctccgccggaatcgagctcgcgccgtcgctctctctctccgccgtcgccgccgagctccggtccgccgccgtcgtcgccccggacctcctcccgtttcggcgtcaccttcttcgggttcgccgcaacctcgccgacctcgtccacccctccgttttgcccgccgaccgccggaacgccgccgtcctcgtcgacccgagccgcgccgccgccttcctccgctccggtcgccgttcccgtcgccgccgtcgacccggggtgagccgtggaccgccgtttcgcttcccccttccctcccctctctcgggcgccgctccgccgcgccagtggtcaccggcggcgaccatcggggcgcgggtgcgccgcctcccgtcggctgtgccggcgtggccgccttcgggcgcgccccgcggctgccatgtggggcccggccgtcagccgcccgtgccctcgggtgcggctgacgcgtgggacccacggcgccgaccggtgtgagccgggtgcacccggtccaccgtggaccgagaggctgccgcgtgggccccactcccgtggacccggtccgcgcgctcctctctcccggctgacgcaataaatctattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaaaccgtttcttttccgttggtcgtgtagacgctgcagcttcggaagatccgctcttcgtggaagttgaagccgacgtttgggaaagcgagcaaggcaagtcacatcatccttgagcatattgaatcccagtttataaaattattttgatttaaattaatgcattatcgctttatttaaattcccgcgttatcactgttttatttagccttgcctatttacctttgttatggccttattattattgctattgttattattaccttgtttaccctagaataaacaaaaccccaactagtgggtactctattcatggttccactagtataaatttaggtagatgcttcgctgattaattaggcaacattaggtgattttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcaccctcggttatgggcaagccgagcaatgtacccaagtcagtgttttaattcttaaaacttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtatagctctaggatcgtgtttacaaaatagctttgggcaactaagtgacttttaaatgctgtttactgcaaaacttaacccctattattatccccttgtacccccttgcattaatcatgcatctgccggtgtgacttgctgagtactgtggttgtactcactcttgctcaatctttcccctcttcagtaagagaggctttggagaagatgtcttaggtggagtcctggcttataccccggttgagcgcctgtgaagatggagccgtaggcccgctagtccgctgctgtttatttttgattgccaggcctgaagtgcctttgtaataatgtaaatattatcgatataataaagatgtgtcttttatatcatgtttgtgtggtgtaccccggcttttcctgggatggggattaatacactagcgttcgggaaaatgcaaattttctcggtcgcgacagccagaagaaaatcatgaatcagctaatgagtagtctcaccacagcaaccgttcgcatcgtactgtttcccgcaacgcagaggttgagcaaccccgccgcagcagccgctcgcattgcacagtttcccgtgatgcagagatggaacagtctcaccgctctcaccgcactgccagtcacaattctagagaagaacgcctcccttccccacctcatgtggaaaccaacatgcaacacttaatggcagttcagacacaaatcttgcaaggactaaccacagccatagccagtttttagcataatgcgcatggaaatggccaccctcacatgggcaacaacagatccaagctgacagactttctgaggtctcgtccgccagagttctctcagaccgtcgagcccgtcgaggctgacgattggttgaaagatgttgatagaaaactcaacttagtgcagtgtactcctgttgagaagacgctctacgcctctcaccaactaagtggacctgccgcagattggtgggagaattactgcaatgcacaccctgaacccactaacattgcttgggatgagttcgctacggctttccgtgcagctcatgtgcctgaaatcactattgacatgaagaaagaagaattcaacagacttaagcaaggcaacagcagtgtcaatgagtacctaagtcagttcaacaagttggctcggtacgcccctgaggaagtagacacagataagaagaagatcaggaaattcttgaaaggaatcgcagttggaatgagactccagttgcttgctcatgacttccccacttttcaacatatgatcaacaaggcacttctacttgaggatgccagaaaagaggctaccgaagaatacaagaaacgcaagtctaaccatcagggaaattcttcccgaggcgcacctcgccctcgctacggtcaacccatgcaataccaccagtcggtcacccaggctaaccgccagccaggctacgcccctcgtcctcagataaaccgtccggcacctcagccacagcagcgtgcccctagtagcgatactgcgcctaacagtgttacctctttcaagtcaccgcagggaccgtcagcagttcagtgtttccggtgcaaccagatgggtcactatgctagacagtgtcctcagaatcctaccaacaccaactcagggcatgctaatggtagcactgccagaactcctactccagcggcagctcagtctcgtcctagctctcaggcaagtggacaaggttcacgtgcttccaacaactttggtcgaggccgtgtgaatcacattcaagcagaaaccgctcaggatgctccagacgttgtgatgggtatgttctctgtcaactccgtacccgcaatagttctgttcgattcgggagcttcccattctttcatatcgcaagcttttgtgaaaagaaatggttggaaaacccaaaatttgcgtgtaccaatgatagtacattcccctggaaggaatataagggcaactcaaatatgcccggaagttaaccttagaattgaggaagttgacttcctagccaaaccgatagtcctagactcgcaaagcttggacatcattctagggatggattggttggctaagcacaaaggacagatagattgtgccgaaagtccatcaccttgcaaggacctggaggaaagcaagtccgctttacccctaacacccctaccgcaagtcggtctatcctaacctgtttacaagtcacctccttggagtcggtgcccatagtctgtgaatatcccgacgtatttccggaagaattaacaagaatgccaccagaccgagagatcgagttcgccatagaactggcaccaggcacagctccaattgcaaaaagaccctaccaaatggcagctaatgagttagcagaagttaaaagacaaatcgaagaactggaaagtaaaggttatgtgcgacctagctcatccccttggggagccccagtacttctggttaagaaaaaggatggctcggagagaatggtaatcgactatagagccctgaatgaagtaactataaagaacaagtacccgttgccacggattgacgatttattcgatcaacttaaaggagcaagagttttctcaaaaattgacttgaggtcaggttaccaccaactgaaaatcagatctgaagatatcccgaagaccactttctcaacgcgttatggtctatatgagttcacagttatgtccttcggactcactaatgctccagcattcttcatgaacttaatgaacaaaatcttcatggaatacctagaccagtttgtcgtggtgttcatcgatgacatcctgatatactccaagaacgaggaagaacatgctgaacacctgaggctgataatggaaaagctcagagatcatcaactattcgctaaattctcgaaatgcgaattctggttggaccgagtagcatttcttggacacgtgatttcctccaacggtgtcgaagtagatcccagcaaggttgaagctgtacttgcttggaacccgcccaagaacgtgtcagagatccgcagcttccttggcttagctagatattatcgaagattcattgaaggattctctaagctagccagacctatgaccgagctgttaaagaaggaaaagaaattttaatggtctgcagcctgtgaagacagcttccaagaattgaagaaaaagttgaccactgccccagttctcaccttgccagatatccgaaaatatttcgagatcttctgtgacgcatcaagacaaggcttaggatgtgtcctaatgcaagaacaaaaggttgtggcctatgcatccaggcagctcaggcctcatgaagccaattatcccacccatgatctcgagttggcagccgtggttcatgctcttaagatctggaggcactatttaatcgggaacagatgtgaagtatacaccgatcacaaaagtcttaagtatatcttcactcagaccgagttaaatatgagacagagaagatggttggaactaatcaaggattacgatcttggaatccactatcatcctggtaaagccaacgtggtcgctgatgcgctaagtcgcaaggcctattgcaatgtagctcaaatacggcctgaccaagatcacctgtgcagagaattggagaagttaagactgaccgtgatacagtcaggtgtccctgccagcttgacagtacagcctaccctagagtcgcaaatccgggaggctcagaaagacgacgaagggataaaagaattaataaaaagaatacaggaaaagaaagacacaaatttctccatagacgatcaaggcacagtttggtgcggaccacgcatctgtgtaccggccaagaaggagttaagagatctcatcctaaaggaagctcatgagtccgcctactccattcacccaggaagtacgaagatgtaccaagatatcaaggcatacttctggtgggctggaatgaagcgagacgtcgcagaatacgtagccctgtgtgacatttgccaaagagtcaaggcggaacatcagaggccagctggtctgctgcaacccctaccgattcccgagtggaaatgggaagagatcggaatggatttcatcaccggtttgccaagaacccccaacgggtacgactccatttgggtaatcgtggaccgactcacgaaatcagctcatttcgtgccagtgaaaaccacctatgatggaaagaaactagcagaactctacatgacccatgtcgtatgtagatttggctgtcccaagaaaattgtgtcagaccgaggcactcagttcacctcaaggttctgaattttagtacagcctaccatccgcagaccgatggtcagaccgaaagggtaaaccaaatcctagaagacatgctacgtgcgtgtgccttggatttcgaaggcacttgggatcgttgtttgccgtatgccgagttctcatacaacaacagttatcaggccagcattcagatgtcgccgaatgaggcaatgttcggaagaaagtgccgcaccccattgtgctggaatgaggtgggcaaagcattggtattcggtcctgacatactcaagtcagcagaagaacaagttaagctgatacgggaacgtttgaagacagcacagaaccgtcagaagaattacgctgacaatcggaggcgtgaccttgagttcgaaaaaggagatcatgtgtacctgcgggtatcacccctccgtggtatgagaaggtttgggatgtccggcaagttagcaccccgctacatcggcccctacctcataaccgccagacggtgcgaagtggcttatcagcttgagctacctgaaggtctcgcaaacgtgcacaacgtgttccacgtatcccagttaaagaaatgtcttcgagttccagaagagcaagttcccctgggtaatatcgagctggaaaagaatctgacctacaaggaaagaccgatcaaggttcttgaagaggcagaacgtcagactcgaaggaagaccatcaagctctacaaagtctaatggagcaatcattccgaagacgaggcaacctgggagcgagaagatcttctccgcaccgagttcccggacctgctcccttaggtgctgaatctcgaggtcgagattcttgttaggggggttggtctgtagcgcccattccgtcgtggcgcctagcgggaaaattatctcttaaaaaccctaattgcgaaatttgtttctttgcttgttgtctagtgtccgtgccatctcaagatctcaatccccaatctatcgtcgagttcaattccgaatccaaatccttccaatcaaattcctccgcaaaagtctattttgtctcccccgaggtcgatgggccgaatctcgctcggcccatcttcccctcttccccggccccctctctccccgggcgctctctctctctctctctctctctctctctctctctcgctctcccatctctccctccccccgctcggcctcgcccgtacgctgctcgcgcgtgcgagagccgccccgagcgcctctctccccgctcccccgctcagcctcgcccgcacgccgcgcgcgcgtgcgcgtaagccgccgcgccgagcgccccctccctttcccctcgctctgccgcgcctgcagccgcgcagccgctcgtcctcgcgagccagcgtgtgcgagcccgcgcggacgccgctcgttgcttcccgcgcgcgcgtgccgtggtggccaaccgccc

SEQ ID NO: 43868 - DNA, 4721 bp, Oryza sativa
ccgtaggcccgctagtccgctgctgtttatttttgattgccaggccttaagtgcctttgtaataatgtaaatattatcgatataataaagatgtgtcttttatatcatgtttgtgtggtgtaccccggcttttcctgggacggggattaatacactagcgttcgggaaaatgcaaattttctcggtcgcgacatgtgcattgcaataattctcccaccaatctgcagcaggtcctcttagctggtgagaggcgtagaacgtcttctcaacaggagtacactgcactaagttgagttttctctctacatccttcagccaatcgtcagcctcaacgggctcgacggtctgagagaactctggcggacgagacctcagaaagtctgtctgcttggatctgttgttgcccatgtgggggtggccatttccatgcgcgttgtgctgaataccggctatggctgtggctaaaccttgcaagatttgagtctgaactgccatcaagtgctgcatgttattttgaatatggggtggcgaaggaatgcgttcttcaccagaattgtgactggcagtgcagtgagagcggtgagactgttccacttctgcattactgtcacgtcccaaaacgaccctaaaatatatcctctaaattgtgcctagaataattaaaatccgtgtgaaagcctccaacaattaaaatgtgcaaagttaaaagtcaaacaaggcttagagggtttttgtatatttcctaaaagcctaaaatgcgtaaataaattttagtggaattttcagagcacaaataataattattaagaaataaacaaagttgaaaaggttttataaaaagaaaaactctaaaaagacccctttccctccctctccctctcgggccggctcggcccatctccctccccctccctctcctctccccgcggcccatccggcctctccccgcgcgcgcgccactgacgggcgggcccgcccgccaccctcgctgacgggtggggcccacccgtcatccccttcctcccgccgctcccgctgcctcgcccacgccctagcgccgccgccgccgcgaatcccgccgcccccgtcctccccgcgtgcaatcaataggggggaattattccccgtgattccctctccctttccccccattttcccctccctctctcgcgttcaaacgggcggatttgcccccgcaaatctcgacggcgccattgatggagcccgagagcgccgcgccggtttccttcccctccggccgccctctcccccttctaactctatttaaaccctccccgcacctcctcagtggttgtactcagtcttgctcaatttttcccaaacccagaagaggagcccctggaagatgaaggctttggtgtctagctcgtgcctgccgtcaagcgcctgtggtcgtcgccctagtcttccgctgtttctcatttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacaattacgggaaactgtgtgatgcgagcgattgctgcggtgggattgctcgacttctgcattgcggggagcggtacggtgcgaacggttgctgtggtgagactgctcattagctgactcatgatctgcttctggctcaactctaccttcctcaaagccgaagcgggctggtgcacgagcagcgcgacgggggcggctagccatctaaactcccagaaaaggggcgagataagaaccagataagcacttaaggaagacaagaagcaaaataaataacaactcagatagcacacactaggcataaactggttttctcaaatcataaagacatctgatacaacgggtgtggacaagtcacagagctacgccgagcttgactgtacgcacaccacctaggagaaccagactaccaaacaacacccacatcaaacacacgcacgcattacctcgccacgactccaagagaggtggcggtggcacaaaaggggcctaacacacggacaactgctgaagacggcctcctctactcctcgcctgcctggctgcctcctgtagtcggctcctcagtcgaagagacgtcgatcggctgacgcgaagagaccggcggaacctgtcgagggccggcagcagcacgagctgctggcggtgggggagctgggtagtcaaagcggaacatagtggaagaaccaacaacacgcttccgcgcagtgcagataaagcgtgggccacggcgggaggaagcgactggggtgtgaccaggagtgtaggaagggctaactgggtgagggtagggagagtacactggagagtacggcgcacgcgagctgggggagcgtgggccactgggagtgcgaaaggagccgcgggagctgtgggaagacaggtggctggcgtggcagaggcggcctgagtcccaagacgcagtgtcaactgaggtgacaccctcctcggccagacgggcctccagagcggtaagcctcaaggagtaggtcgtgctgggtggcttgagcctcagaaagctcaaccatgcgagtcagcacaggctgaggctcgcggtacggacaagggtacctagtgtcagtgcggccagaaggaaggcgtgggagctgccggaaggcagagcccccgaggcggtggctgtagtcgtggaccaagcgacgaagtgctgtccaggagaggtcctggtacacgatctggagagtgggcctggccacattgaagtggtgtgggcaaaggccagccccgtgtatacctccacgagggtaaaggtacaccgaaagctcacaacgagggggaacacggtccacagagtaccccgtgtactcgggacacgagaagccaaggaagcgggcgaggtcacgaagctgagcgacgtggtgaccctcaccaaaactatgggaactgaagctggcgttcactaccatctacaattttgaaagagggagaaaagatcagtaaccattttagcaataaactactgaaaataaagaaagcaaaaagaagcctttgagcaagtagtttttgaacttagtatccttagggtcatcctaaacgtcgggtttcgccctagggccaagcctgtgctctgataccatcttttgtcacgccccgaactagccctgaacggaactagcccgtgacgctccaaattaacatgttaatcgataccagtcccaggaaacagtgctggtatcacaggaagacagaatatcacagcagcagaggtctctttattacagagtaggagtacaatcatgttgggctgcggatagatgctgagctcacaactgcattacaaaagggaaagcggaagccaagacttggaccattcatcacaggcgtgacttgggaactaggccaaaaccctaaaactcatcgtagccgacttgctcctggaagaactcctcatcagcaggatccacatcattttcttcagcaactggggggggggattatttatatagagcaagggtgagtacaggagtactcagcaagccatgggaattaagtgtttaatgcaggcttcaaaggaaatgctgttgtttttgcaattggttttatttaaactccttgttgaaacaactaagtgagtgcttctcaaacgacacggatgagacagtgcgtctcgtctggtcggagtatgtgcaatgtatcaatctttgaactgattcaaggttggcacccggccaacggctttcaaacggccacccgggcctggctgatcccatcagccgcagattttccaaacattgaacccattccataaaagtaatttcacaagcagtagtcaaactacgctaggaatcacctcacatccgcccatgaccgtgggcacggctgttcgaacagtttaataacctctgcagagggggtacactttacccacatgacattactaacccggatcaccccgcccgtgcagaacggccacgtctggagaccttgaggctttcatgacaaggcatttcgaaagccgacacaggttcaccatatgccaacgagaggggtcccagaccgatatcaggttaggtcccacaccatactgtgccaggaagcccgggggttccccccggcaccaccccgttgaatcgacatgtctcttgccatcatggttcccccgattagctagttactcagccaggggtgtcccattccacccatgtggtcgcacttgccttatgttcggatgaaattccaaggaaacggtccttaagtgcaagagcgggaaaccgtactcccggtacgtcccccggtccgcgattttggaaatttaattttagttcgcaagcaccgacccaggtgtcgggttttccaagtcttttgtaaaaccccaagttttacccatcgttggatgttttaaatttgaggggaggtgttccgatgcgcgtgcctgtaggcccgtgcatcgaagcacaacagttgacaaaggtggttcaagtgttcaataattcaaggagggtaattgcaacaattaggattggggccggtaggctatctcgcaagccgcggccgaaatacttgtgttaaacttattcatgcaatatttgcggaaaagaagtacttagatttaaattataggtgcaagatgatcaaaggtgacgggctgcaggaat

SEQ ID NO: 43869 - DNA, 1018 bp, Oryza sativa
  unsure (1)..(1018): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgacaaggcatttcgaaagccgacacaggtttaccatatgccgacgagaggggtcccagaccgacaacaggttaggtcccagaccatactgtgctaggaagcccaggggtcctccccgacaccaccccgacgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaccgtacacccggtacgttccctggtccgcggttttggaaaattcatttagttcgcaagcaccgacccaggtgtcgggttttccaagtcttttgtaaaacccatgttttacccaagatgtttttcagattttaagtttgaagacgaccgttgatactcgtgcagagtgcacgatttccgaggcgcaactgggtggttacaagggaacatggtataacaattaacagaggaaggatcaaatgcaacaagctaggtaggtgtagcgcccgttccgtcgtggcgcctagcgggaaaactatctcttaaaaaccctatttgcgaaatttgtttccttgcttgttgtctagtgtccgtgccatctcggatctcaaatccccgatctatcgtcgagttcaatcccgaatccaaatccttccaaatcaaattcctccgcaaaagtctattttgcctccccggggtcgatgggccgaatccctctcggcccatctcccccg

SEQ ID NO: 43870 - DNA, 17799 bp, Oryza sativa
tccacaccgccccgccgtcatcgccgtcgtcatcgcctcggcctcgccactccgcgcgcaagccgccaagggacggaggcagagcccctcctccctctgccgcgtcgcccccgctcccctcctccttttctcaaagaagcaaggggcgagccccctttctctccctcctttttccccttttcctcccgctggcgttatcctccctccgccctgtcgccgattggacgcgagcgccgagcgccagctcgcgccttgaccgcccaagtcggttccaaaccgacattgccgcccttaaagcccaggcgccctccctctcttctcctcccatcgccattgttgccaccgccttccgagctctgtctcgcctccgccgttcatcgccaagcgccgggagagccggtgcgttcgaggacgcggaaggggactccgggcgctcgtcttcctcctcttccccggcccgaggccggagagattactcccgcgccgtcggcctctcgtcacagcgcccctcctcatctcggtagtgcctccctccgttcttcctcctcgctccatctcccccccttagttttcggtggtagcacgagtagcctccccgtagctagccggcgccgccccgaccattgctgtcgctcgccgtgtgctcgccgccgtcgccgcccgagctccgtagcacccgctcgtcgccagcctcgctcggcgtagctctgcccaatccgacgctagcaacggattcccgtagccgcgtagatgctctcaccgccgggaattggcccctcgtgacctcgtcgccgtttcccccttttctctccgccggttaccgccgccgaaatccgccgccgatgggctccctccggcgaatccaagccgttggctcgctccctctcattctccctcgtcatcccggtgtacgccccgtcgcccctcatcgtcgcaaggcgtcccggagaaaccgccgccgcccgccgtccattcgtggccgacgccttcgtcttcctccggccagcccgcgtggcagccacgtaggcgccacgtaggtgccacgtcggcgccagctcggtcgagatcgggtcgggccgaccccggtcagcccctcccgtgcgcgcgttccaccgcgagccgtgaggctgcgcgtgggcccgccgcatcctttccactgcgaaccgcgcgcgtgcaccgcgtccctcccccacctacgcgcgtgcgccgtgtgctcgctccgcacggtgaaccgtgtcaccgacaagcgggtcccacccgggaccgcgcgcggtgagcccggtccactggctctctctctcctccctcccgcgcgcgcgcccgacttgggctggccggcccatttagctcggccggaccgctccaattctcttgggccgcgccctagccgcccgagaaaagtctattttccctccctcttttcttttcttttcttttctttttcaaaaaggatttaattaaatcctttttcctttagaccaaaaatccaataatcttagaaattcaatatcttcccaacctaaatccgtttgactccgttcaacttccaaaactcctcaaatctcgagatctatctaatggcacgcttaggggtcattaatagggctttattttcgccgtttgttgagttgtcccgtttcgcgtgtagcttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcggacctacctaatttgttgcatttgatccttcatttgataattgttatatcatgtccccttgtaaccatctagttgcgtctcgatattcgtgcaccctgtgcgagtatcgacggacgccttcaaacttaaaatctgaaaaacttcttgggtaaaacatgggttttacaaaagtcttggaaaacccgacacctgggtcggtgcttgtgaactaaatgaatttccaaaaccgtggaccggggaacgtaccgggtgtacggtttcccgctctcgcacttaaggaccgtttccttggaatttcatccgaacataagacaagtacgaccacatgggtggaatgggacacccctggctgagtaactagcttatcagggaagccttgatgccgagagacatgtggattcgccggggtggtgtcggggaggacccttgggcttcctggcacagtatggtctgggacctaacctgttgttggtctgggacccctctcgttggcatatggtaaacctgtgtcggctttggaaatgccttgtcatgaaagcttggaggtctcccgacgtggctgattcccacgggctgggtgatccgggttagtaatgtcgtgtgggtaaagtgtaccccctctgcagaggttattaaactgttcgaacagccgtgcccacagtcatgggcggatgtgaggtgattcctagcgtagttttgtttgactactgcttgtgaaattgctgttgtggaaaggggttcgatgtttgaaaaatctgcagctgacgggatcagctaggcccgggtggccgtttgaaagttgttggcccgggtggccgtttgagagttgttggccgggtgccaatcttgatcaattctaaagactgatacattgcacaaactccgactggacgagacgcactgtctcatccgtgtcgtttgagaagcactcacttagttgttttcagaaaggagttcaaataaaatcaattgtaaaaacaacagcctttctttgaagcctgcattaaacacttatttcccatggcttgctgagtactcccgtactcacccttgctctatataaataatcccccccagttgctgaagaagttgaagcggaacctgctgatgaggagttcttccaggagcaagccggctacgatgagttttagggtttcggcctagttcccaagtcgcgcctgtattggttggtccaagtcctggcttccgtttcccttttgtaatgcagttgtgagctcgggatctgtccgcagtccaacatgactgtacctctactctataataaagagacctctgttgctgtgatattccgtctccctgtgataccagcactgtttccagggactggtatcgattaacaggttaatttagagcgtcacgggctagttccggtcgggactagttcggggcgtgacagtaggtccgccaatctgccttgcagacgggacaaagagattaagtgcgatcctatcaatgcataatatttttcaagcaacataattaaattcaaatataggctcaaggtgttcaaaggtggcttgccttgcttgagatcttgagcttgatcctcgaaatcctcgcactgcgggtcttcgggctccgaaactacacgcaaaacgggacaactcaacaaacggagaaaataaagccctattaatgacctctaagcgtgccattagatagatctcgagatttgaggaattttggaagttgatcggagtcaaacggatttacggttgggaagatattgaatttctaagattattggatttttggtctaaaggaaaaaggatttatttaaatcctttttgaaaaagaaaagaaaagaaagaaggagggggaaaattagacttccctcgggcggcgagggcgcggcccgagagaaaagaggcggctcggccgagctaaatgggccggccggcccaaaaggcggcccaaagcgcgcgcgcgggcggggaggggagagagagccggtgggccgggtccatcccgcgtggtcccgggtgggacccgcttgtcggcgactcggctcaccgtgcggagcgagcacgcggcgcgcgctagggttcggggagggagacgcggtgcacgcgcgcggttcgcggaggatgcggtgcggcgggcccccgcgcagcctcacggctcaccgcggaccatgcgcacggggggggggggggggggaaacggagggagcggctggccgggtcagccgatctggtcgcggccgaggtggcgcctacgtggcagccacgtgggccggcgggaggtagacgacgacgccggccagaacggacggcggacgacagcggcgagcggcggagcgaaccacggcgatacaggcgaaagcgagcacaccgggtggttgcgcgagacgaggggagacgagccaacggctcggattcgccggagggagtgcgtcggcggcggattgcggcggcggcaaccggcggggagggaagaggggaacggcgacgaggtcacgaggggccgattcccggcggcgagagcatccacgcggctacgggaatccgtcccttgtgccggattaggaggaaacgcatcgagggaggccggcgacgagaggcgcttccgagctcgggcggcgacggcggcgagcacacggcgagcgacggcagcagtcggggcggcgccggctagctacggggaggctactcgtgctactacccgagtctaaggggaggagatggaacgaggagggagaacggggagatgcgctaccgtgcgggacggggcgtagtgacgatgggccgacggcacgggagtgatctctccggcctcgggccggggaagaggaagaagagggcgcgcccggagtccccttccgcgcccttgctcgtgcgggctcctccgacacgcgcgacggcgaaaggcggcagcgaacagagcacgggaggcggcgacaatggagtggaggcgagagacgaaaacgagggagattggaggagggaggagcttgggtttataggggcggcaatgtcggtttgggagaggggaaccgacattggacggtcaagcctgcgagctggcgcccggctagcggccaatcacgacgacaggaggtgacgccggcgagagggaaaaagggagaaaaggaagggagaaagggagcttgtcccttgccactttgggaaaaggaggagggagcgggggcgacgtggcagagggaggaggggctctgcctccgtcccttggaagctagcgtgcagagtggcggggtcgggttgatgacgacggcgatgacggcggggtggtttggagcggggcgacgacacgggcggtaggcgcggcagaggctgacggcggcggcgaccaggcggtcggccaccacggcgcgcgcgcgcgggaagcaacgggcggcgcggcgatttgagcggcacggcttgggcacgcgtgctggctcgcggggccgagcagctgcgcggcagggcagcggggccgggcggcgcagacggcgcaggcgcggcacgggcgatgtccacgcgggcgcgcgcacgcgaacaacggcgcgcgggaagcggcagcgagggagcggagagggagggctcggctcggcgcggctcacgcgcacgcgcgcgcggcacgcggacagagcggagaagagggagagagagagaacagagagagagacagagccgccgaccgcggggtagatgggccgagagaaattcggcccatcgaacccgagggaggtaaaatagacttttgcggaggaattgatttgggaaggatttggattcgggattgaactcggcgatagatcggggatttgagatctgagatggcacggacactagacaacaagcaaagaaacaaatttcacaattaggatttttaagagataattttcccgctaggcgccacgacggaacgggcgctacaatttagcatgagcactagcttcactagatatccactatgtccaattaatgctcactgctattgaatccacctttccgaggcccaaccaccaacggagccgatgactctgagcacctctaccaaccattttgttgcctccaagcagtagcggacgcatatatcagttcaaaaccacagtgggtcgaatgatgctaaacaatcaatgagtgtaagactctgtttagatgggctaaaactttaagagcaatagaacaaaacacatatcatatttatatttcaatcgcatactgtctcaatcattgtttgcgacatgcatacgttgtgaagagacggactaatatgttatacgttcacaccttgttatacctaattttgatggtccatgactactgtaagggggtagggggtctcgagggtgtggcgacacaggtcgtagctgtgttggtcgacccaccctgactaatgggtagattggtccctgcctctaagatcctcctccctacatgtgctgcatgtgaggctccaaatatggaccactggctcctgtacaacacacaacatcgctccgccttcatcacaaggacaaaggcgttgaattccagctatccctcaagctatacaaatggaaataatcctactagggcatggtttagttcccaacttgttctttaaacttacaactttttcatcacatcaaaacttttctacacacacaaacttccaacttttccgtcacatcgttccaatttcaatcaaacttctaattttggcgtgaattaaacacaccctaggaagagatccaaccatgggagggacccaactaaactaaaactagcctattagataagtttttttttgaggtggggggatttgatagtgaggtcaataaaagtatatacatgtttggtggaacgatttcatttataattttgtactgggacggatttcattccgtacacgatctcaattagtaaaaaaagaatcttcaaaaggcctcatgatataaattagaaattaaattatgatctcgtctataaataaatcactccacaaatatatatacaacgccaacttttagaaaaaaaaactggttggaatatgattacatattttaggccttcttgaaacataattttttatacaatgtttataggaaatagtttagttcccatagtccaaaggacgtctcacatgcaaatgcatcccccccccctttcatgtgctgagcaagctcctcgcacgcattaaacacaataatttattttgtaattctcttataatttttcatggctattttaaaagcatgcagaaatgattaataatggttgaagcagcagagatttaaattgctgaagcttgccagcaaatctcccaagtcatcccaaacttcctggagatccaacgtaagcaacgtgtcagaaaactcaaacatatgcatggtctaaaatattacttcaacatcggtattgttgagaagcatgtgcaaattcagtaaaacacggccaccaacatgatatacttgtcaattcaactaaggtttattttcgccatattctccagtcaaatggtcgaatgcctgctctaagcatgagtgttacactcatgcaactggtcaaagtgttcgcactagcactcaacgtacatatactctgtacgccacctgcacgacacggccaacacagtcatgtgcgcttaggctgaagatttgtacaaatgcatgtatagacgataaatgcagaaatggaattcaatcaaagtgtaattaggatatcagcaacgacatcgcccaagaaatttctctataagtatatatatcaccatatttatgtggttgggttcttcctgggagatggattttcaaaaaaaaaaaaaaatcataactggcatacaagagaaaccagtggacatcctcttgaggaacaaaattacttttccgtgctggttcttaaggggccatcatcgtttccgtttctacccagagaagtacgttcttccggcaacaactataacacattgtcatcaaatttcattcaaaacaattcgtcgatttccttgaattggaagtgagattaatggagatgctagctcgacacgaatcaccttttggtccttattgaagttgaagtgctcgcctccaagagctataggtgcatcacataaagtcatgaactgcgtacatacgcagggagtctgagtggctgaacaagacaacaagcatgagcatttcctgacagaagatcttcgagtggatgataagttttgactgtaaagttcagatggagctagctagctagctactctagctgcttgcactcacaatctcacatggtactggtaggaggaggcaatagcgatatgataatacgaatgcctctttgactaccagttggaccagcaacaggctacgacccttttctttttctcatcaggcaccatggatctccatcggttaaagttacttggagactgagcgatgcaagtctcgcaaaactcaccagagagacaagcaacaatatgcacaagatggattctaatcgatctctcgggtgcatgatgactagtagttgtacgaactggaactgctcaactgcatcgaccacctaaaagcaacacgattgtcgttaaaccaggctgggctattaggctactccaacagagcgcgacagcgcatgacatactgagctgtcaagttttggaacttacggcttcaagagcgacaggtgtttcctgcatcaagctttgatgcttggtagatatagagcaacatgcctgtagacctgcagatgttgcaactcatgtgacatggacaagtagctgggctctaggcagcatctgctctcctgtggattactactaccctacgtaccaccctattaggcgacactggatacattgccatcgatctctatgtatacgttgccgccgaatgcgacgaagctgccaggctacgcgtgcaactctcatcactgtgaagttgcattcattcaggcttgcaggaagctcgtgcagtggcaatatgcaggcataactgtatgtatggcagaaaaaaaagcttttactcagggaaatgagacatgctatgccagcagagactgtctgtgtaactagctacatcctcatggctgacagtgtgaaaacatttcgatgcgttattccggccaggttgtccaactatcaaaacacgcgacaagttgtgcaaatcgtggcgtatatagtacaatactattctctctgtgggacatccacctagccagataagtatcagtatgactgtatgtgcaggttggaggagtggccaatgcaccctcacgcacacgaagggacgttgtacactagctcgtttactgtacgagcaagttctcatgccacgctagacaagcacatgcatgctttcccctcgatcccgaacggcgggatacttgcttgggtctgctgcgagattcgtcaaagtaaacctcggatgcatgcgtgtacgagtacgatggaatctgattttgtacgtaccaaccgcagaaaacaaatgcaatctgtgggcgcccttgcatgccatggccccccggcctaagcaaaccgctggattttgagcagtagagaaagctgtgtgctcgttgcattcgagtttttcttggtctcccgtcgcaagatggatttagaactttttagacgatcaggcgagccgtgccgcctgaaactacctgggcttgactgtgccgagtgcccagaagatgtgtttcctgccctgtcccgctgcatcagccgtatcgcggtgcaaggtttcgccgggcgcgcgcggcgcggcgtcgactggtcgaggcgcatgcgcaaacccagcaaaatttgggcgggtggtggacacggcatccgcacaccgcgcggtcacacgcgcgacctgcaagtcagttggcccatgacaccctgtgcttccgcgacgcgctcgatcgggaggtcgggagcaggatggtgtgtcgcgcgagaaggtttgcttccacaattgagcccacgaggcacgcgggtagagttcttttcgtggggcgccgttcgcgtgtgacacgcacgcacggagtcccacagggagaggggtacaaactggaccgaaactcgcaaggggatgaacaaaaaaaaacagggcctagtaggcctggagcaaagaagaaaaaggttcaatgagcctggagctgttgtatgtcaactgcgaaaaagaaaaagggcctagtgcagttttattgtccaatgcacaaaaagaagtggatgttgctgcccaggatcgaactggagaccttcagtgtgtaagactgacgtgataaccactacaccacagcaaccgacttgtttgcaagtatcacaaacgactacaagtaattgaaggctactgtaacgtttcatctctcagatttcgcattattgaaggttactgtaggtgctttatgtttttataagaaagaatagtgtcctaggacgctttatctaagacgaagaaaagcatgcgaagcttaaatagaacaatattttgaatccaaacttgaaaatataaatagaaagagaaggaccatgatgaatatatgaaatattccctccgtttttttaatagatgacgccgttgactttttcgcacatgtttaaccattcgtcttattcaaaaaatttatgcaaatgtataagatataaatcacacttaaagtactatgagtgataaaacaactcataacacaataaattataattacataaattttttgaataaaacgaatgtttaaacatgtgcgaaaaagtcaacagcgtcatctattaaaaaacggaggtagtacattaataaccaagggctgcatagttgcatagggtccgaatgctagataaaggaggtgctctagcttcagatgccttagattttccaccctttgttccaataatactttttgacacagtctgaaactgaagacacacgagctgtttatttcatagttacaatatagatatcatacgcaacaagttattgggttcacaatttctttattattacaacagtggaatatccaataggtatattaagtctgaggaactagttggatgtgatagccttgagggaacatgatctctgatatgcgcagtacttcccctccttcaatctccgtccaactaaacggagagttcacccggcaaaagaaaagaaacagagttcaacatgtatgtcagtgagtttttctaagactatatcagtgagcatagcaggcaacaaacgaacatcaacatgcgtatgtacctatactcggtcaccaagatgtggaggaagagtgcaatgaaaagcttgctaaactctgccccgagacacagcctgacgcctcctccaaatggcatgtaatttttcagcatcgagcttctcttctcctcctgtatttgccatttgcttcagtgagtcagatagaaacattgtggtaaaacacaacacaagtgaagaccaatttaacaacaattcatccttgaatactaatagatcaatattgaaatgtgtcttccactaaccctccacctccatggatcaaatttaagtggatcctcgaacaattttgggtttaggtgaactgccatggggcttatcatgactaaccacccggatggaattgtatatcctgtgtaaaaaccaaatattataataaccatttgtatggcctgatgtgattctcatgagtaaatactatgctatatgcacaatatattatcttattgtttgtgttagaagtttacctttcacttgcacatctgttaatgttttcctgaaaactccaggtgtgacgttactaattcgagtaatttcattcataaccttcaggtaaaacaagctcaaatgagttaacaaaagcaattgccgaaatcatcactatggcaccaatgatgcttcaaacataagcggacaacaacgtgaaatcacctgagtactgaatttcaaggacctgtactcctcccatgtgaacccggaattcacaccttctcgcttctttagaattgtcccgtgctcctcctagaatgatgtgttaattttagaattcatccaatatttcattatttgtctcgaacataaactacccgcattaaaaaaaatacagaccttgagctcttcaacaacttttggattgtcggttaggtacttaaaagctacagtcaaggttgatgacagtgttgcaaagctcgtaaacaagagcgcagcaagtgcgtctatagcaaagttttcatcgatcattggcttttcgctctgtagctcttcaacaatgaggtctacaaggtcaccatacttctttccaggtgcacttagcctctctttcattatatcagtaagtgtgttccgcacatttctcctacccttcattagggaacaaaaaaatcaggacaactgaaacaagtaatctagaagaccagtgtcctagttaatattcaggacatgtatttctaatgaagtagatgagtataccctgattaagctatttggacaagtaggaaagaaacccgcgcagatacacaggaaacttatttattattcataaaaagaatgttaaagaagtcatatctcaccgtatttactataagaactttaaattatcttataacaataaaagaaaaaatatctctaccataaaatagaccataaacattgatatcttaaatgataataacatttcttatattcaaacattttgtcctggttatatgtaaactcacatattaccactacttattacttgttttcaaagcaggatgcatttttaatagatgaaactatatatgtaaaaaaaaaacacctagtacatcattaatatagaaaaaaatatctctcacctatgtctaaatctttgtgcaaatatttaaaaatacaacaactaccaattaatgggataaacccattaaaatgtgtataaataccgctctaacggatgaaaccgagggctttttttctctgatgccttgaaacatgagtctcgcatcaatggagttgtacccctcgagattagcgtggattataattttaacgcctaactcaccattggcacactgataaaagattgcattgttaagtaccctggttacatcttattggggccactcaacttaagcatatgcatgcccttactatacttacgtcggcgtagaaaatttcaatgcaatcccccctggcccccggcccccggcccccgcccacacacacacacataatgcatttgtcatccacctagtaaactctaatacattgattgttttaaaaatagaaaatgaagaaaaatgaaaaatgccttatatttgaaaagtgagggactacataaattcaaattgtgaatagctggttcttggatggttttgttggtattgattctgtaactataattttgtagatgagtttgctacctgggtctaaattcagtgcccgtttgattacacgcgtgttgtgtttcatccaaatcttcttgtgacttgtgagatgggtcgctgtaatggatcgactgcatgtgctgtcacgcttgatgtggagaatgctgaacatgatttataattttgcagggtaggctaagatacattttttttgccgggtattccttttttttctggcgttttctctctcccacatacacgagatctagagggatatgaggaattagttccatagatctaatctaatgcatggttgaataagatggatccaccaatttaagtgtaaatcaatggtttagatattttttagaacttttctaatttattagacacgcgtgacgtcttagtagcgtttgtaggagtttcacatgatggcatgagagcatttatagtaaatttaatggacttttagtatataatagaggatacaaatacctgcatggatcggtagaatgatgtccctggaaaatatattgggaaggaaaccatcccctgaaagaagtcctgaaagttctttctcaattctcttgagttggtgacatcgagtccgatcaacttcttggcaactaggtcaaagatcatctgcaaaatacaattcatagtaaaacaataggaccattttgtgagacagttaaccggagataatctaattacagtgcgcactttgcgttcttaattatctaccatttattcatattagacatctatagatccaacaacattagaaatgccttaaccgaaacatatatccatgtagcgtcgcatagttttgcataaatgcagttgttaacttacgtctgacacgccgtcctgtacctcgacgctgggtttcccagtccatgatgcgaagctctccctcatagagttttctagctcaggaaggagtgattctttcaggttttcaaggccaaagagcttggccgcgacaccccggataaacttgtgaatggttccgttgtatgtggtgaggctcttcttgccaaagatattaattgcagtttctggataccaactttggaacaatttaccctcttgttgaaatatgaatcggttcacctctgggtcaagggaaatgatcactggccgtccaactaagctagtcttgaatagaggcccatacctgatgatcaagcgcaaaaccagcatggcatagaacttagatttgttcatatttatagaaagtgtgttgttcgtatcaacaacgtgcatatgtttgttgcatatttaagtagaacactggtactaaaaagttatcactaacctctccagtctttgcttgtagtagcttggcatgtctattgatgggcttgctctgaagaactggaaggtctcaccaataatagggaagcccatggagccaggaggaagcctcccaatgcatggaggattcatccatttgtatacccagtgagctaaccatcctatgatgagtgtgacaccacatagagctgcatatgaatacgatcctagcaagagctcagacttttccatgtcctagctaactagtgagcaagtatggaacaaggcttctagcttgcactgctgcccacgcagaggggaggtatctagatctttatatagcaattgtcacgtgtactattagttgactagtagaattttacttcatgcaagttgcaggtatctatgaagaaaatatattcctttccatggattgattggtttcctttagtgattggataaatgagattgctttatacataatatgtcattgattgagtttgtcaattatttctactccatgccgttagacagaatactttttcacgagagcctcattacggtgccctctactagtaataaaaaacaatatgaaccgttgtagcgcccgttccgtcgtggcgcctagcgggaaaactatctcttaaaaactctatttgcgaaatctgtttctttgcttgttttctagtgtccgtgccatctcagatctcaaatccccgatctatcgccgagttcaatcccgaatccaaatccttcccaaatcaattcctccgcaaaagtctattttgcctccccgggttcgatgggccgaatctctctcggcccatctccccctccctccccggcgctctctctctctctctctctccctccctcctccgctctgcccgcgcgccgcgcgcgcgtgtgcgagagccgcgccgagcgccactccctcgctctgcccgcgcgtacgcgagagccgcgtggtcgccgcccgtgccgcgcctgcgccgtctgcgccgcccggccccgctgccctgccacgcagccgctcggccccgcgagccagcgcgcgtgcccgagccgcgccgcccgttgtttcccgcgcgcgcgtgccgtggtggccgaccgcctggtcgccgccaccgtcagcctctgccgcgcctgccgcccgtgtcgtcgccccgctccaaaccgccccgccgtcatcgccgtcgtcatcgcccggcccccgccactccgcgcgcaagctgccaagggacggaggcagagctccttctccctctgccgcgtcgcccccgctccctcctccttttcccgaagaggcaagggggcaagcccccttttctctccctcttttcccctttttcctcctgccggcgtcatcctcctccctcctccctgtcgccgctttggccacgaccgccgagcgctagccctctcctttgaccgccctaagtcggttcccaaaccgacattgccatcctataaacccaagcttccccctttcctttcctctcccattcgcctccacgccattgccgccgcctcccgtgctctgttcgccgtcgccgttgtcgttgcgcttgtcggaggagccggcacgagcaaggacgcggaaggggactccgagcgcgccctctccttcctcttccccggcccgaggccggagagattactcccgcgccgtcggcctctcgtcactgcgcccgcccgcacggtagagcatctccccgttctccctcctcgctccatctcctccccttagactcgggtagtagcacgagtagcctccccgtagctagccggcgccgccccgaccgttgccgccgctcgccgtgtgctcgccgccgtcgccgcccgagctcggaagcgccgctcgtcgccggcctcgctcggcgcagctccgcccaatccaacgctagcatcggattcccgtagccgcgtagatgctctcgccgccgggaatcggcccctcgtgacctcgtcgccgtttcccccttctcccgccgccggttgccgccgccgcaattcgccgccgtcgggcatcctccggcgaatccgagccgttggctcgtctccccttgtcctgtgcaaccacccggtgtgctcgctttcgcctgtatcgccgtggttcgctccaccgctcgccgctgtcgtccgccgtccgttccggccggcgtcgtcgtctacctcccgccggcccgcgtggcagccacgtaggcgccacgtcggcgtcagctcggccaaaaccgggtcgagtcgaccccggttagccgctccctccccgtgcgcgcggtccaccgcgagccatgaggctgcgcgtgggcccgccgcatccgcgtcctccgcgaaccgcgcgcatgcaccgcgtctctcccccatcctagcaccgcgccgcgtgctccctccgcacggtgagccgagccgctgacaagcgggtcccactcgggaccatgcgaggtgagcccggtccaccggctctctctctcctcccctcccgcgcgcgcgtgccttgggccgccttgggccggccggcccatttagctcggccgagccgccccttttctctcgggccgcgccctagccgcccgagggaagtctaattcccctccctcttttcttttcttttcttttctttttcaaaaaggatttaattaaatccttttcctgtagaccaaaaatccaataatcttagaaattcaatatcttcccaaccgtaaatccgtttgactccgttcaacttccaaaattcctcaaatctcgagatctatctaatggcacgcttagaggtcattaatagggctttatttttgccgtttgttgagttgtcccgttttgcgcgtagtttcggagcccgaagacccgcagtgcgaggatttcgaggatcaagctccagatctcgagcaaggcaagccacctttgaacatcttgagtctatatttgattttaattatgttgcttgaaaaatattatgcattgataggatcgcacttaatctgtttgtcccgtctgcaaggcagattggcggacctacctagtttgttgcatttgatccttcctttgttaattgttataccatgttcccttgtaaccacccagttgcgcctcggaaatcgtgcactatgcagagtatcgacggtcgccttcaaacttaaaatctgaaaaacttcttgggtaaaacttgggttttacaaaagacttggaaaacccgacacctgggtcggtacttgcgaactaaatgaattttccaaaaccgcggaccgggaaacgtaccgggtgtacggtttcccgctcttgcacttaaggaccgtttccttggaatttcatccaaacataagaccagtagaccacatgggtggaatgggacacccctggctgagtaactagcttatcagggagccttgatgccgagagacatgtggattcaccggg

SEQ ID NO: 43871 - DNA, 11660 bp, Oryza sativa
tgtgtcggctttcgaaatgccttgtcatgaaagcttggaggtctcccgacgtggctgatccccacgggctgggtgatccgggttagtaatgtcgtgtgggtaaggtgtaccccctctgcagaggttaacaaactgttcgaacagccgtgcccacggtcatgggcggatgtgaggtgattcctagcgtagtgttgtttgactactgccttgtgaaattgctgttgtggaaaggggttcgatgtttggaaaatctgcagctgatgggatcagctaggcccgggtggccgtttgaaagttgttggcccgggtggccgttgaaagctgttggccgggtgccaatcttgatcaattttaaagactgatacattgcacatactccaaccggacgagacgcactgtctcaaccgtgtcgtttgagaagcactcacttagttgttttcagaaaagagttcaaataaaatcaattgcaaaaacaacagcctttccttgaagcctgcattaaacacttatttcccatggcttgctaagtactcctatactcacccttgctctatataaataatcccccccagttgctgaagaagatgtagcggatcccgctgacgaggagttcttccaggagcaagccggctacgatgagttttagggtttcggcctagttcccaagtcgcgcctgtgttgtttggtccaagtcctggcttccgcttcccttttgtaatgcagttgtgagctcgggatctgtctgcagcccgacttgattgtactcctactctataataaagagacctctgttgctgtgatattctgtcttcctgtgataccagcactgtttcctggtactggtatcgattaacaggttaatttggagcgtcacgggctagttccggtcggtactagttcggggcgtgacaaccgttgatctcatttgatcgaagggttcagatctatttatactactaccccagttaacggtagtacaaacgtggagggacattattgtcaaaaataataggtgggtataatcgccatttaacagtgagtatacttttttcctcctttttagctttttcgatgaaatatgagtgatgttggcgcaataaatggtcatagatggaattaaccgggaaaaaacataaatgacaaagtaacctctagtcatcgtgttagtaaattgctaatctatcctaataatactagtagtataacaggtagagagcatctgagcatcgctatttccaaaaacgtgcaaaatatatttatagacataaaggggtggtgatgactcctttttgaagagaaggggttaggggtggcaactaattggcccaacccttacaatatacgagtaggagtcggtaaaagaattctggctaaggataacctggttcattaggggttggaaaagctgaaatgcattctacttttggtatgaaatccattacctggtagagtcgatgtttttttttctactaaggaatttattgatggttaggatgacagcaattctgcgggtgttttgcaaaatttcaaccattattatttgatgcaacctatataagatggctgtatttattcttccccaattaacttgattttttttctaggggttgttttaattagtgtaggcttcgcaaataaatatgtaggtaggtagataagattgggaatacaccgattgctacaaacgaggccatgtttaggtcaggagtgaaaagtttttgcatgtcacatcagatatacagacatatatttgaagtattaaacgtagtctaataacaaaataaattacagatttcgcctgtaaactgcgagacgaatttattaagcttaattaatccgtcattagcaaatatttactgtagcaccacattgtcaaatcatgacgcaattaggctttaaaaatttgtctcataatttacacgcaatctgtgtaattagtttttttctatatttaatactccatgcatttgtccaaacattcaatgtgacgggatgaaaagtttttgtttgggaactaaacagagcctaaatcagcatgaagaatacaagtatcgaaaaggaatgcatagtcaactatgaattcgagtttcatgcagtgtgactttttagaatttagaatgtctcattttccttaattaccagctcgattttgatattttcttttcatgagaaatcacgatatttatgcttttccttaccaattataatatgtgtatagattgacctttgattcagttcgagctaaaattattattgtttaatcttttttggggagagggggactattttcatagcttcttttccaagggtacaagcgcacaataacttgcacaaaagctatcacattaaagaaaaattccttgacgtcgtctagacagccctggctgaatcctcccagacttttctcccagacttttggtgcaagcgcgctctctagacgcatgtcctcttgtgttagcgtcctagcttacgcaagttggccatgtcggagggtctagaggggagagcggttccatccttctctctcacctctctctctctcaatcccaaagatgttgctagagttagggtttggtttcagttgttagggataggttcgggcgacctcggctgtagttcatttgttggcctagcggcggccggtcacgcttagcgatggctggtttggtgctagccttctcccgggtttgtgtttgatgttgtcggtgcgtggagaaatctttgtattttttttcctggttacgacctcccagggttgtaatcttatattttttccctgctctatcaatatgaacttcgcactgtctggtgcgagtcgttcaaaaaaattccttgatgattgttgcaaaggatgctttgcccttgtaaatgatgccttatttgcccgcggtgagtcactgacatgttattaagagtgagggccaaataaggggttgagttaacttttaggggtgaataaagattttattccttcaagtaacatttttctgggtgaaaaccatatctttcttagattggcgatggcggtatccttgatgtcgtgacctccatggtggcatcgttttcggagtctcgtccctgtgatgctgtcgtaggcctagcggcgattagccatacttagcgggggtcatttttggtgctaggctccactctcagttgtttgtgcttggtggtagcacgcggtgtttggtcatgcactttggtgcattgtggtgttttttcttgtaacttttctccttcttaatatattcgaatagcctccttcagccttcttggtgaaaaaaaagcaacattttttcagcattttggcattcaatcgttcaaattaactgcaatcaggagcagatctagcgtgggtgctcgagggactcgagtcccctagtccccaacccctacccggctaaatcactattgataaaaggagagatgggaggaggaggaagaacagagaggggaggaagagtaagggacattgaaggaggaagaaaaagataagtctctctccaattttgttctagatctgcccctaactctgattgaattattgacttgagagttcggaaatagacatgcaacggtaccactgttttcgaaggatgcattcacctaacaacccgtttgaattggataatgattctgtgcaggaatttgacaaactttggtcatgttatatagtacttgctacaggaatttgacgaactatttttcgagcaatacggaccgctatcttttgatccaattgcaggtcatctcaattgctttggatcaactgtccatgcatttatttcttgcagctgacgaacgtctcaatcgcagcccattaagtaattactactacatccgtcatattataaatgcggttatggtttccatgtccaacgtttaaccgtccgttttatttgaaaaatttataattttttttaaaaaatagtcacacataaaatattattcatgttttatcatctaataacaacaaaaatattaatcatatttttttaaataaaatgaatggtcaaatattagacacgaaaagtcataattgaacttatattaaaacagagaaagtagtagagagccccgtgtcaaaaatataaataagtaaacagcccatgcgtccaataataaatgtacatctctcaacataaagtcgttttggaattctagacattgtttatgttttcttctatgcctgtcattctcaaaaaacaagaatgctatccctctcacaaataaaatttgtcgtctttttcaagatagtatacatgaagggcatgagagttattttctcaagtcttgtgcataagcctaaaattgacttatatttggaaccatttgagcatgttttctttatattgttgatactggccattgtaaatagcatttgtagtattttcggatgctgatggagttaggccttgttaatgtctctggataactttgatccgatagccatcaggaaattctagtcctggagttcggactaccctgcttgctcccagcggtatccacctgaaaaagaaaagcgcaattatttcatctccttcgctctcgtttgcgagaccaaaaatttcagccatcgctgttccgaaatgttacttcaattggttggcacatcacagagatatgggatgacaaggatttggacttccccaaatatgccctcaagttggactgcgaaagagaaaaacactacctgtattttgtcacaaggaaatggaggaaaatagccaatggtagcttgctgaagtctgctccaacgcagaaccgtagtcctccgccgaatgccatgaagtgttttgatccacggtttatctctggtttatcctgcatgttacactcaagctgattaaaattttcttttagtggaaagctaactaaatatacccgaatgaatagatatttttgtgtctgtatagggggagacgggcttggccggggtacgtgttactccatccgtttcaagttacaagactttctaacattatccatatatatatatatatatatatgtctagattcattaacatagatatgaatgtgggcaatgctataaagtcttataatatgaaacggagaaagtagatctttcatgagtttattttttgttttttttaacttgtgggagatatgtttcataaaaaaaatgagtggaaaatcaggattatcaaaccttaaaccttgaagggatgaaggtgagaggatccggataaatatatggatttaagtgcactgctggtggacagaccatcactccccatcctgctggaattgtgtatcctgtcaccaatggatgtcacttaggaaaagaagaatggtattcagttatgctttttttaaaagtaaatttcacaaaactatagatactttggtcaaattatcacaattaagtaatgtatcacagaactacaaatttaactataaatttatcacaaaactacagatttaaggctaagtatcacaaaactacatattgaataataaaattatcacaaaactacatattttagggtttaaattcttagcactagtgttatgttggacttataattgttcaagttttgtgattaaattgtcattaaatatgtagttttgtgataattttgttactaaatacgtagttttgtgatatttcaccataaatctatagttttgtgataaatttagtactaaatctgtagttttgtgataaatttagtactaaatctgtagttttgtgacacgtcatgttaaatctgtagttttctgataatttgatcaaaatacttgtagttttgtgaaatttactcttttttaaccggatgcatgatgtactgactcgttagcaaggtttcaacatgtgacatagtaatctggagatggattctaatatatcgctcaataaacatgcgagttcaaaagtgacttttgtagtttgtaaaaaaataacaaaattaattgtgaatatagatatactatttaaattttgatttgctatttttattacaacttgtaaaaatcaaatttgaacttgtatatttgtagagtgccatattatacatgaatctatcttatcaaaaaatttgatttttttttcataacaatttaattagcatgcaacaaatcggtggatatctagctaagtgatcaaaactgtttcaactgaccacgttaaaaaaagctcaaactaatttttttagcaaattttgcctgaatatcacatgttttcatcgataactagcatggtggcccccgcagattgcgcggctagcattattatattttctctcatataatactacatatattttctcaatttgttattaaaatatattagaatgacaacatattttaaattttatattaactttaccaaactactaatttgtaatattcatattttattgtatatacatgatagttactaatatcaaattttagttatttctgaattgtatttctatatggactctatactcgcctttcaatatttcttttttttaattccgaatttttgttatttgcaaattgtattttttatatagactctaggctattcttttaatattatttatctttaattctgaattttcattatttctaatagtatttctatgtggactctaaactcatctttcaatattctttatttttttaatttcgaatttcaattacttcaaaattgtatttctatatggactttaggctcttcttcccatgtgttttaaatttcgaattttagttatttgtaaattatattgctatatggactctaaactctatttgtaattttattatttttattcccaattttagttagttctaaattcctatatggactctatgctcttctactgttccttattttttaattccgaatttttattatttcttaattgtatttctatatggactatatactcttcttctaatattccttatatttaattctaaatttcagttatttctaaattgtatttctatatggactctatactcttctttctgtattttttttaattttgaattttagttatttctaaactgtatttctatatggactctaacctgatttttattttttttattttttatttcgaattacaattagttctaaattgtatactggcatgaactctaatctactcttccaatatgcggatttgctcatattgttttcttgcccaggcattgctgcagaagagtgaaatgaaaaacttattccttattttttaattctgaatttcagctatttctaaactgtatttttatatagactctaacctaattttaattttcttttttttaattccgaatttccattagttctaaattgtataccggcatggactctagtctattctttcaatattcctttttattaatttcgaatttcaggtatttctaaattgtatttctacgtggactctgtttttctttttctccgattaatatgagaatttctatgccgtgagagcgaacgtggaggctcatttttctattactttaaataagttggagtaatagatagattgggttattcaatgactggtcgcatttgtaagccttgctagctcatcaatcatactcctacctcattattaaatagcagcatcaagatatgattttggacccatgatcaacagattgtggggggctcaccattgaaccgtatgtctttaagtgcctttctgaagatgacaggagcgatgttggccaaacggaccgtctcgtttatgacctacataataggagcatgtgcgcgtatgattggtttagcaacgcacgttttgatacaaaacatgcatggggtgctataattggatccaatgcaatcagtagcataaactgttgcacagcaaattctgaaccctatctgatcgatatttatctagcagttttgtgcgagctagtactagtaactaacctgagatgtgaatgccatggatttgtactccttccatgtgattctatctagctcgctgcctgcctcacggtccttcagaatcgtttcatgctccacctgcgtacgtacatatccgtgtatgtcagtacatagtcataaacgtgtatgtcagtatatcacatcttgatttttgcgtatagtataggagcactcaccgtgagctcctccaggacgagagggtggtcggcgagcagcttgacggccagggtgagcgccagcgacgtcgtgtggaagctggcgaagaggagcacgaacatcaggtcgagcgccatcttctctgtcatgaccggcttttccttcgtgatctcctggatcacataatccaggaagtcgccgtgctgctgcgcttctcctcctcgctgcaatcctgtcgattgcttcctctcctccagaacttgctctagcaccaccatcgcgcgcctccgcccctgacaagagtctcaaaaccaagagaccatgtctgaaactttgcgaagaacgactaattagtgcaatatcgtgacgacataagttttacctgcatgcatgagtagtaagctgtccctggcagatacagcgggaaggagatgagccctcgaacgaagtcgaagaagctcttccgcaaaatctttgacctcgacggctccaggccgagcagcttgcttgcagcaagatcgaacaccatctgcgcaagtgcatgcactcgaacggaacatacatcacaatgagacagtacaagaaaccaacattctaaaatctgggtagaaaccgcgtacgtacagtggagacggcttctttgagctcgacggccggcaaggtggaccaggtgcagagggagctggagacggcgcgctcgacgtcgcggatgatgccttccttgaggctctcggggccgaagtacctgagcaccatgttcttgaggtacctgaacatggcgccctgctgctccccgacgttgtccttccccaggatctccacgaacgagtccgggtaccagctctggaacagctgcccctcctgctggaacaccatgtggttcagctcctcgtcggccgacaccaccaccgggtgccccaccaggctggtcttgaatatcggcccatatctgaacttgcagcccaaactagtaaaaaaacagcaaaagaaacccagcccgttctctggcccattaacaaaggcgtacctagccagcctgtgccggatgaagggagggatgtccaaggaggcgtcggaggagaagaactggaacgtctcgccaacgagcgggaggcccatggagcccggcgggagttggccgccgcagcgagggttcctccacctgcgcgcctggtgccgcagcagcagcagcagcacgagcgcagctgcgccgcccacgagccccacgtaggcgtacatctgcacgcgtgtaatatgcgctagtggcagtatctgcttctgttgatctacatgtgccgtcgtcgaaagcaaagcacatttggctgtaggacgatcggtatgtaaggagtagaggggggggggtcacggctttgaccgtggtttggtgaagccatcaacgtaaaggttgtgaaaaactagtggttgctcagcctgtcgttgttggtggatcgaatgttcgatggctgctgctactaggatgggccggcctgatccttcccgttagatcttaagattctggcccatctacagagatttcggcttcccaaaatccgcacaatgcccatcgtcacacggcctacgaaatcctttgctctctccgggtttccgtggcacaactgggaaggcaaacccggcgtctctccgccccccaatccgcatggacgagctgctgcttcgctcgtctgctgattgcggaggccggaaggatcacccgcgtagcgtggtcaggtactgttggcgaactcccgcaggtgttcgacgaaataccgatcaaaacagagcgagcgagaagatgatgtttgtgctgcgaaaaaacttgcagcgtttttagttgcattaggaaactttaaatagcaaattacatgtccacaactctctactggatcacgtcatcccacgaccgaagttgccgccatgcgttcctaccctcccgccacttcgccatgcctcccgagtagaccgcgccatcccacgatcggaaacacgcaaagcgcacgcactccctaagaaaacggaaagggctcccgcatgaacgcagcatgcgtcggagcgatacacacgccatgatccccagcaaaaccggaaccacgcgcttgactgataacttggagcagaaaacgggagatggcgccatggattatcacaacaggtacttcctcctcaggtcaaagcctcaaggccacatttggtttagggttgcaaattttggtacggggtagtcggtaggtccgagcattgaacggcagtgttctgaatgtatatatcgggtgaaagtaaatacggagaataggccaaggactcaccgacgagcgggcaccgaaaaaggggttgctcctcaatgctgcgggtggctttttccttgcttgtgctgggcaccaagccaccaaccgaagcagagagcagaggataatcccagctctcgtactgcaagcacgtggactccgccgtggctcatccaaatgtcaggtttctcggaacagatcagtgctcggattatcctgcctccaatcatgtggctaccctgcacgccttgcgtagggtcgttggggatagcactgagcagctgggatggatgtccccaacgcaaaactatccgcagtggagtactgaggttgttgcaaagctttcttttcggtccgcactgagatgaactttgtcaaatacctgaatccatttattacagtaaagaaacactacatggaaatgagctttcagctttgtcaaaaccaaaacaagtactacctgaattcatttcttcgtccgttaacagtaaaattgcctgataaagagccacggttttcattcaaaggtatatatacccacacacaggataatggaacccgacgtattgtctgacagaagatatcagcagcggaagtacttgctgcaccaatccccaaaggtatgggcttaatttttaggcagttataagagtacaagctaattaatcagtaccattaccagccatacttcttgttacagtatatcctgttcatacttcttgttggacatgaaaatttactgtattatttgctctggcctatggcattaccacaaactaaatgtcaattattttttctccgtgcatgtccttgacagaagattcttaaccactaccactagcatcctatatagactgattgccattgctagctcaacagctaacaagtaaccactgttgcgagctaaccagtaaccagtagccctcctattgtatacagagatgccactgttaagagctctgttattgcagcgttaggtgagattgacactttggttagctgtaaggtggtatgcatcactgttcttccggtggataatgggggatatctcagatgaatccttgtgacagggggacctcgtggtctgtcaagtgtcctcatcatttcaatacatgcaccgatcgcccaaaagtgaattgtttcttctgctcctcctgtcggggaccagtgcgttctgttgccgtcgcattgcatgcatgccaatggtgatgaactctttaattagccgttagtccattacttgcaagatctgaaactagacagctaacgttatcttctccataatacagggagaattttgc

SEQ ID NO: 43872 - DNA, 9108 bp, Oryza sativa
cttttaagggcaaaattcagagacattccgatgttttttttaaaaaaaaatggtactcgttataagtaatacatgaaaattatggcatgacagtgacaaaatggtgtcaataattatgcaaatatattccagatgctgattgaagtggttaggacttaaaagtctttaggcccttttctcaacttggctgactctgtgtcagatttttggatgttttgcgtggcttgtcttccactaccacttccaattccagcaccgacgctgacgtcggcacaaaacaacgaaggcgtgtagacgcggaatataccagtacaaccgttttgtctcattttaaggcattgcagtcggtgctagcgtgcctaatgttcagctacactgtaactaattttgtaattttgacattattcacctggagttagtgtagacgaatgcatatggtacgctcagtgtgggccaccaaattttcagctgaatccagagtcaaacctcacaggcatagtagttgagttcagcactccagtagcatgtgcgagcaaacgtaaaggcagttcagacaatttgcgtctagccatgtaaacattccacggtagttctactgttctagggagagtaggcgtactatggtggtacactggtactccgtactaaaatgcctgatgacagcgcatgaagaatgctactgaccgtagaaaccagacctacgagtaatgtaagaattatatcagaatggtaatctactagtaaaaagtaatggcaaacaccgtgcattggaacaaaaaggattgacaccataattgtagcttctatttacccacctggaatactttggttgtcctttaatgtaaaaaactttgcagggtttccttctcagcacctcttttacacctaaacatcgagggctgaactccatatgtgaactattccacccaaagaatgaaatggaaaaagaaacttcaaatccacaaggcaaatggtaagccgattacgatatttgcccaatatgtcaattttttctaacactttatttcacgttattgctattccttttcttccccgagtgtccagtatgtctttacaacaaggaggagcttctcccggacgagcgggccatcttcgtgatcaacgatttggctgttccatctcataccgtcggtaatgctctttattttcaccaacatatcaacatcatctcttataatcactgtaccctcaggcctcagtattctgtccatttccagcagaatgttgtccatctggcatctgcaagagacgaaaactgcgtcagtccagtaccagggtaaacagtctccaagagtgactgttaacgatacctattagatttctcaaatacaggcataaagaataatgtgcagttactactgcataggagtacagatttatactccacggacaagaacagaagtcactgttgctgtgatggactgaattttactgcagcttatgattacctgtccttgtatagcgtgaacactgaatcggcatgaatgaggtcgtaggtccgagggtacgtggacatgccctcacacctgcagtaagcacggatagaagtcacacaccaacaaaaacatgagcacacacaccaacaaaacatgaccgtcatcatattcagtctcaaagagaggggcagtgcttgcagagttgcggtacaagaactcaccagtcttggtagcttccgatgagcccacgctcgtatataaccccaagagttgttgaattgccaacagttgggaccatattcatgacccacacagggtcatccaccaatgccgcagcgaagccgccaaagcgcgcattcatatcaagcaagttgcggtaccgtcctttctgtccaaattgacttatcacggacttgtagtgcccgaccctcttctgccatagtttggtgtcttccacgaacatttcatcagtgacaccctcaatgctaccactggcaattctgggtggcactgcagtgagcctctctggccatttcttcaactggccacccgcaatctcttttatgtcactaacctctgggagaggagttatgcaagcctccatcttatcgtacctataatcgatcacatgaatatgatttatcctgaactgtgaacgtgagttaacttcaagatggacaataaagatataattagtgttgtaattaccatgcagcatctggatttttatttgagcagaagggtggggacttgacgactttgcgggaggccttgcagtgaatgtggttagtaggtttctgccagatggcaatgtcaccaacctccttgagcgtgatcttcttccagcaaagactcttggccactgcctcaatcgcttgctgctctgcattcaggtcctccttggttctctgccaccccttccagtgcttcttccagttgattggaggtccagacaaaatccaataccctcctggccgcagaatgcgatccacctcagccaagtacagcccatctgcatttcaaattgcacctgagttatcaaaggattaacagagcattgccaacacatttaattttggacaaaatgttgccataccgtagagctgccagggaatgaggcagcgggagcaatgtgccatgtcaaaggcacgagctggataggtgagccggttggatgaaagaacaccgatcatcgccggcacaccacgttccagtgcaaattgaacctgtgcctcgtgagagtcacgtggcgcgaaggacatggccaggatgttgcgtgacagcaagtatgcgccccagctcgctacctgcaacaagcggcagagtgcaacacattaggaatccataactctaggcgtctggttataatatacaaagggtaacttgcccctctacacatgagaaaaactcagtttccacatatctagcaatacaaatagatcaaaatgacaactattggcacagcttgctgtagacgtgaaaattccattatgtgtgacattgtcactgtgtaaaaaggcactacatatcttccaagttttcaacgatattagtgcacagtgcacacaacagaacctctcctatccgcagccgacatggagaatttgatcaaagaatgcactatgcgcacggaatgctacaagcagtcaagtactagtaacttcagttcagtgcttcagttcagcctctaaacgaaacggtatgtcggattggtcacgttactctacagtctgacctgcctaatcacagaatgaaacgaacaaatgctcctctgatccgggtcggagcagaagctcgtttagggtcagacccgtttgcccgggcagaagggcccagaggagcagtgtgggactggaaacttccgacacgcgcaaagcaaaatcccattccggcgttgccgagatttccgcctcatgttctagtgcatcaacaaactggagtataactaaacccccaaattttgctacgaatgtacgaaacactacttaaaatcgagctaattatgcgcgaatgtcatctatcttaagcaaatagggtgtgcttatgtatgaagtggcctaccccacaaccggtgtcgagggcggtgcggatggatccatcgtggagggggatgatcttgccgatgtcgtcgatgtacgcgccggcgccgtgggggaacatggtgccgccgccggggaaccggaacttttcgccttcgacgcggatccagttctgcaccgccttctcgacggtgagctccttgtgcggcacgttggcgaaccacgcgacgtcgcggctggtcggccacgggaacgggttgcggtacccctggggcgccggcacgaggcaccggagccgctcgccctccgacgggcagtgccgctcccggtacacgagccggtcccgcgggaaccgcagcgagcgctcgacgtcctcgcacggcgtgtactcggagtacttggccgggcacgcctcgtacgtgcggtgcacctggcccgacgccacctccatcccctccgcggtatggtgcgccgcgaagtcgagcggcgcggacgacgaggagtcgccgccgccgccgccgccgccaaggagcgtcggggtgggggagacgcaggagacggaggcggtggtggcgatggagacggaggaggcgacgccgccggccggggaggcggagaagccgccgtggtgccagatgccgatgaggtaggacaccgtgcagagcaccgcgacggccgcgaggtggaacagggacgggcggcggccgcccgcggacggcatgtgcagcttcgtggcggtcgcgcccaccgccatggctggctggcggcttctgctgctcccgctgcgcgctctcctctctcccctcgcctcttgtgggattggggcgattcgcctttctgcaccactgccccccttgctggctgcttaaagcgcttgccgcctaggaaggattaggggcgtggggatcgattgattaggtggaggtgaagacggggggaggccgtgaaagggagccgcacatgcatccggttttggtttaatcgtgaagagagagcgtttattactccggagcggctggtttattactcttgggaggatgcaaatggttgcgctttgggaacacgacactacgccaccctacgctgctatcgctggcggcgcgtgtgctgcgtgtgcatatcgcggcgtggcagcagtttcagcaagcattaactcggtggtgttactgtatattttctgttgatacgatcctggttggcgctattaaaagtgtaaatgctgagtgcacgagcccactctgtaaggttccctctgaattgtagaagtgaaaaaaaagggaggaacaagaaaagtacagggattatgatagaaattcaacagcaagatgtatgaaaaatacataaataatcgtttgattatttataggaaaaatataaaaatcggatgaaagagatagattcaaagaaaattttccatgaggttgaagctattgctaagttttcttcaaaattttgataggattgtatattctatagaaatttcaaaggatacgataggattcactccattgtttcaaatgttttcatagaaaatattttctatagaattgaaatcctctaaaatttatatattctttctacaaatcaaatggccccttattcgacatttgctcgaaaaaaaagacaaaatatgtttatgacgatatattttcatccataaacaaccatcgtaagtgaaaagggaagaagttaacaaaactataatcgtacagttaatcactcaactgtaggtccatacatagtggtttaatagtttgctatcatgttcaagatttatgttatatctgcgaaaaaaccgtgaaaaacaaactaatcgatcaaaaataatctgtatgtcggtctcgtgtgtatggatcgttgttgacatgcagattattgatgctcttaccttgttttccatatccaagtttaaaaatgaagttattttgaacggagataagtagtataatgacatggcagtactagagcaagagtttgagcacaatttattccttttctttctagagacacatccaattatatactcctactacaagtaacgcaatgacactgaatttcttctataataatatgtataaataatggtttagatatttattgtctacccccgtcctataatatagcaacctaggactggataggatattttatagtacaacgaatctgaacacactcatgttcaggttgctgtattatgggacggagtgagtatagagaatatagagttttttttttcacatcatgtctaacagaatatagagaacccacattaaccatccgtttagctgtttcaaatagatttatataattactttttattctataaacaacacatacaaatagtgaagtagatggttattttaacttgtctattagactacatgttaattaacatacaacaatcttttctgtgttctctcttttctgtacaacatcgcaccattattcatgtcgtaagattgttttcatcaatcaattaatttgcccttgctcgtattattttttaaaaaaaaaaacgaaccgcacaagacagtgcgcgtttcatgtattgataaagcaggagaaaaatacaatctatagtcctggaagaccacagaccagaaaaaagaaaatacaaccacaccgtgcgtctacaacaagacccactgcaagagcgaaacagaaggtcttcgagacgacacctccaagaaggaaacgacaccaaaggtgccactgtcgtctgtcccgggaggccaggacaaggttttcacctgaagaaagtaattaggagagataagaaatacaaaaacaccccaagaggaaaacggcacccacaggcgttgttgttgccggcccggaggcagagctttcgcccaaaatttcgtccctcccaagaactaaactcctgcacgctctgtagccaccaccaacgaaaaccttcgacgcacggccaccgcaccggcgccacgccgccagtcgatcatcatggggaagctcgaacctcgacacacaccggctccatccacgcagatgggttggatggggagagggtgagagagaagaatggatgccctctccccccccactagcccgctcgacatggacaacttttgtcgacaaaggcgtcgtcacaagaggacataagtctggaaatgtgcccgtcgaaggatcgtggctcctccctgacagagaaaccgccaactcagccacgaatctgttgcccatgtcacctcgggccgccggaccgtttcgccggcgccttgccaccctccacaccgtgctgatgaccccctccgccacagtgcacccgccgtccaatggcgcggcactaggacgtccaacgaagcacgatgctcacgccccaaaaccggtggaggggaccggttcttgccggagggaagccagacgcccagcactcgccaaagttgccagcataggaaggttcgcgccgcacggagaccataaggtcaccatcgtcgccacatctccaccgtccaccgtggcctggcaagcgtgccgctcgtcgatggctgcccaccacagcttgggctccgccaacaccaccactcagtattgactttaaggaacctacagtagcttgtcatgcaatgatttataatatttgtcatcctattctaccacaatttggtagagtgatttttcataggtaaagaattaaaccaaccctgtaattcttttgtcgtggaggtttggattgcgtggaacatgggctagagcctaagcctttcgataaagtattatcctcctacccaaaccttgtttcttctaggtctagtagtaacctgtagtactaacaacgaagtattattttagaaggacattcatcccaaacacgtttagaggtgcagtaatttcgagcaggcggaatgttggtctctcagtcaattagggaaaatgcgcagaatcataatccactgctctgtgagcactctactcttcctcacaagaacaaacaagatcacaagtttcatcgatggatcaacaagatcgcatcgcctccgccgccttaaccgctgatatattgatctttctcagatgagtttcatcatacagaggagtttgtttatatatctctctctctcgttcggcaacaacgccagctcacaactgccagctatgcattagctattacatggcccaatccggcccaacgaatctagtatttgggatacggagtcttgcagcccgtttgcgcggcccaccatcttgcggttgctgttgctcgtccgaaacgtcagtagctgggctgctgacaagcccctccccttggaaactgacttgaccccaagtcagggcagctgggaacctttgcctgagattagcttcatcttcccaggtcgcttcatctgcagcagaatcagaccaacgaaccagcaactgaggaataatacggttacctttcttatggagcctagtatccagaacttggactggaaactgaatactggaagttggaccaggtagctgactctgaacaggatgcttgaacccacaagagcctttcaattgagagacatgaaagacaggatgaacagcacagtccaatggcaactgtaacttgtatgccacttgaccaaccttggcaatgatttggtatggcccataatacttaaaagatagtttgtgattagctctcttggcaactgaagattgcacataaggctgcaacttaaggaaaacccaatcacctacctaaaactcctgaaaactcctttttttatcagcttgatatttcataacctgtcgggctctattcagatgttgcttaagcagttgagccatcaacttcctttcagataaccattgagctaaatcaggtatactgcaagcatcttctctgatgccgaaatgagtaggaggatagccatacaaaacctcaaaaaggtgacttatacagtgaagaatgataagagcagttataccaaaactcagcaagatgtagccattcagaccatttagagggagtagcatggacaaaacagcgaaggaagatttccagacactagttaaccctctcggtctgtccatctgtttgaggatggtaggctgaactgagatgtaacttagtgcatgtcggagaatgaactcctccacaagggaaccgtgaggcccccctttgtgagttcggccgggggcagcggatgagattcgagggcttggtgagcggagctgtgtgatcttgagggggttagcccccccccccaagacgatgagacaaaagagatttatacaggttcgggccgctaagaagcgtaataccctactcctgtgcatgattgattgaatgtagaacacaagtgcttggggttgcgagacccaagcgccagttcgcccccctccctccccccctcccccctccaccactaggcctggacctccttttatacctcaagtggttaccacatggacccaacaacctaacctagctccggtggagaagtattataatctttgcattaaatgcatgtcttgtctctgtggttgggaagccaagcacacgtcgtcttgatgatggggcctatcaaatcttgccgcctgacacgaggggtacccctgcagtcaccatttaatgggtgaagacttctgggctcctattacaccgggaaacagga

SEQ ID NO: 43873 - DNA, 5231 bp, Oryza sativa
acacctaacccaccgtacgtggtgacctacagaggggtcgggggagcccgacccctagtcacgggagggggcggcccccgcccaacctcgggcccgatcccccctcgggggggagccacatggcgcctggggcggccttctccctctagtctcggccagggagtggccgccgccctacctcaggcctgaccctcctctggggagggccacgtggcattggagggcagcctcctccatccagtctctgggaaggagtggccgccgtcctacctcgggcctgactcccctcgggggagggccacgtggcatcggggggcagcctgctccgactagtctttggggaaggagtggccgccaccccacctcaggcctgactcccctcgggggagggccacgtggcatcggggggcagcctcctccctctaaacctgatacccccgggcccatatcaccgacagtgcctgacctgatgaacaattgctcccacaatgtactggtaaaaattttatctctgtctgaaattatagcttgtggcaacccatgcagcttataaacattaagcatgaagactttggcaacatccatggcagaaaaaggatgagatagggtcataaagtgggcatacttagagaacttgtcaaccactaccaaaatacagtcctgcttgttagaacgaggcaaaccttcaataaaatccatggatataatctgccaagctccatcaggaacgggtaaaggttgcagcagtcctggatatttagctctgtctggcttggattgcaaacagattgaacaagcattcaactgttgttggatggtatccttcatatgaggccaagagaaaagagatttgattctgtggtaggtaacaggaaatcctaagtgtccccccatgggactgtcatgcaaggcagagatgatttgctgttgcattgaagaattattgccaacccacactcttcccttgtgtttcaagagccccttgtgcagcttatactgagggtgagaagcaggattaacggccaattctgtcagaagcttaactgaaacaggatcttggtcatatccctagattatgtcttgcaaccacacaggagaacattcagatagagccaagaattctgacacttcggcaggaacattccttgaaagggcatcagcagctacattgtgcttgccctttctatagacaattttatattgcaacccaagcaatttagtgaaagccttatgttgccagggagtgttaagcctttgttcagcaaggtgcatgagactatggtggtctgtcaagatcaggaactcttggaattgtaagtaagggcgccaatgatcaactaccatcataatagccaaacattctttttcataggtggaaaggccttgtgttcttggtcctagaggcttgctcacataagctattgggtgctgattttgggaaaggactgctccaatgcctaggtcactggcatcggtttccaaagtgaaaggttgctggaaatcagggagagctaacacaggagcagaaaccaaagattgtttgagcaattggaatgcttgttctacttctgcagtccaattgaaaggagcatccttctttagcaattgtgtaagaggtttgctaatagcaccaaaattcttaataaatttcctataatagcctgccaatcccaggaatcctctcagctttttaatagtagtaggtctgacccaatcgacaatactctggattttagaaggatcttttgcaactccagccccactgataatatggcccaaataggatatatgttcctgggcaaatgcacatttactgagtttaaccttccactgatgattagataacagctgcaggacttgtctcaaatgagtaagatgagtaggcagatcaggactgtatatgaggatgtcatcaaaaaacactagggcacatttcctcaacactggactcaaggtgtcattcatagcaccttggaaagtgccaggggctcctgtaaggccaaaagacatcaccttatattcatagtgtccactgtgggtttgaaaagctgttttgtgctcctccccttcagccattctgatttgatgataaccagctcgaagatctaacttggaaaaatatctagcaccagccaactcatctaagagctcatcaataactggcatggggtaagttcctttctgagtgatattgttaagctgtctgtaatcaatacagactctccaagaaccaaccttctttttaaccaagagtgcaggtgaagaaaatgcactgctgctgtgctgaatgactccattttggagcatttcttgaacctgtctctctatttcatccttatgtccaggtgtatgcctataaggtctgataaacactggtttggagtttgggaataagggtatcctgtgatcacaataccgtttaggaggtagcccttttggttcttgaaaaacttcttggaactcagtcagtaagggctgcacaatctcaggaatagagggagatagctgattagtagatttatccaattgaacaaggtacatgattccaccagacttagccaatccatgtaactggcccggagttatagggagacagctgagagtactagacagtgttccctacaacctgaccattgagtcattcaactgaaattctagccacttgtgtacccaatccaccctcattgggctaaaccgttcaagccaatccatttcaagtatcacatcgtaggcacccaatgctaaaagtctaaagttgctcttgaaatgtattccttgagttaaccaatcacagtcaattatgtgcagtgagcaagtgaggaacccaccatcagcaaccttaactctagctagtactggcatagccttaacccctgataatttgagaccaatctgttgatacacaaacgagtgagtactgccagaatctatcagcataagacttcaatgccctgaacccatcctcttaacctgattgagtgattggagtcagtaccattaatagcttgctatgatatagccattaaggtgtcagattcaggtggttctgaaacagcctgctcagactgagatgaaccttgtaagacgtccagcaactcttggaccacatgtaactgaatggaggaagcacatttgtgatctctgccccacttctccccatagacaaaacaaagtcccttggatctcctataagacttgagagctgacaatctatcatattcccttgaatgattgcttaattcagttcctctcctatcatttgaaatgattggaggccctcctttagtggttggtggcagaggcaatggcatagcacctttgactgactgtttctggtatccatcagattttttagattcttttggcttatcaccctccaatgcttcttcctgtaaaagagcaagagtacaagcaacattcaaatctccaagtctttgaagcagaatagcagacctaatcgcatgccttagcccctcaacaaatttagtgacaaagtagactggtttcaaagatgggtcataagccatcatttgatgcatgatgcaatcaaactgctctacataatcagctactgatcctgtttgacaaattttaatccattgtctaataagggcttgctgcctatctttgttaaacctagtacaaattttttcacatagttcagaccaagtaaccccttctagttgagacctaactgcttgcagccaaaaggcagcattaccagtgaaattgagtgttgctaccttaacccaattacccggatgtatgccatagacatcaaaataagcctcacaattagacttccacatgattgggttatctccatcaaattttgggcaagtcatgggggctaccccaccagtcataccaactgacaaagcagactgaaacgaattcatggcagaagcatccaaatggaaaggaattggagagacattgtgagacgcatacgtaccattggccgggattggctttggggtaaaaccctcagcctcctcacgattcaaaatttgaacgcggtggccatctagaccggttgagccatttggtcgaacacctggtgagtccagggttcccgctggagttgtttgctctgttttgttggctgaagagctctccagttgatttacttgcatttgcagcagatccacggtggattggagtacatccaccttcttctccacagctgggatccaagattccaccgcctccttgaacaaccgcatctcctacgcctgcctcttctccccttcctccctcttgcgctcagttttctccatcttctttagaaggagatcaagttttgcttcgttctccatgattttagcggtctacttcgtcacaaaacgtggtttctccagggcttcagatcttgtctcacctcaccccgaattcggccaactcgagcaaggcaagttaccttttcacggatctacccgagggtaatccaatccttgcccaagaatttcacggccaaatcaagggaaaaagaggattgacgaagctctgataccaagttgtgagcactctactcttcctcacaagaacgaacaagatcacaagtttcatcgatggatcaacaagatcgcatcacctccgccgccttcgccgccgatatattgatctttctcatatgagtttcatcatacagaggagtttgtttatatatctctctcgttcggcaacaacgccagctcacaactgccagctatgcattagctattacatggcccaatccggcccaatgaatctagtatttgggatacggagtcttgcaacccgtttgcgcggcccaccatcttgcggttgctgttgctcgtccgaaacgtcagtagctgggctgctgacatgctcacgtgtaaataccaataatgcaaactcctatcaaatcatggttaattcgcaaaattttatttttactatacctcactctcagaaatcaaatgacacttgtaaaaattaaaccttcggaattcaaatcattaatttttctttcaaaccgaataaaccctaaatttaccgggggaaaataagcccgggcccacgccagccgccacccatacggtgcacgggcagacaacctgcaaccgaccaaccggactcgcacggccgatagatcaacctcgaaccagaccgcgcgcggcaggtctctcgctggcacgtgggccagggaagaggtggaggagccgaggaagagcctgcacgacagcacgagtaaagtacagcgcaac

SEQ ID NO: 43874 - DNA, 12756 bp, Oryza sativa
cccccccccccccccccctcccgcggcgcgcgcgggtgttgtcgtgaccacccccacggtggtcgacggtgaatggacggtcctgccgcctggatatgcctcgcgcctggccgcccgcagtaaacgccacacatgctgcgcggtgcctactcccctcccgtaccccgtactcctgatgccaactatgcaccgtcttttgactcggacataacgcatatagtatgttactgtactactgctgctgctgtctcgtggtacaccggtgcgaccgcctccatcctgtagcactagcacaaagagcagtggctacccagggcaacagggtactggactagtggaggagtggggttaatacagtcagcaaaggctgtattaggcccttcttgaccgctcgatgagttgaaaaccgggcacgtaacctgttcacaactgtccatcaggaggcgtgcctgtccctcactagaatcattgttgtagcatgggaagcggtaggatcttatcctcgagaccttgacggcgtgacgaatgcctaatctgatccgactgaagtctggatattcaaatcttgtgagcttcttattgtaacaataggataaacggccaagttgcggtgtggtatagagtacggcatcttaacaaatgctagtcggcgagatcaatgtcagcatgctccaatcaattggcggagatttttgtgggccgtacctttgtgtgagactgaagcaaccaacagaatggactactctgtgttcggataccccttttcccaaccatttttcatcgttttttcacgcgcacgttttttaaacagttaaacggtgtattttttgcaaaaaaattttatacgaaagttgcttaaaaaaattaatctatttttttaaaaaaatagcaaatacttaattaatcacgtgctaatggaccactccgttttccgtgatcactgttcttggtgggaacttgtcctagcgaatacttagggcttgtttagttcccaaacaaaacttttcacactgtcatatcgaatgttaggacacgtgcatagagtattaaatgtagataaaaaacaattgcacagctcgttgggaaattgcgagacgaatcttttaagcctaattgcgtcatggtttgacaatatggtgctacagtaaacatttgctaataacgtattaattaggtttaataaattcgtctcacagtttactgatgaaatttgtaatttattttgttattatactacgcttaatattttaaatatatatcagtaaatctgatgtaacatgcagtggtaaaattttttaccaaataaccaggcccttactaaaactatcaaaggcaaagcaacgacaaaagcaatactaattaggaggtgacacgccaacatctcgtcaaagaaccgagctgtatcaatttttcgcgccatcaacattatggttttcctctgtttatttataagctagcattggcacttttcaagtgctactatactgctatacatggttggataagtatagtacaactagtatatacttttataaataaaagaggaaacatatattcggtcattcgggtgccattgttcttttcaggatatataccatcctagggcaaggccaatgtatgatgtatatacacatattaaggtgggacccatgaatagttagcatttcttatggtatgatgcacaatgtatatggtctttaacatgggtctcactataaaataaaaaaattaagatggctgccaacttctttgagatagtagtagggagagagaggatgtgtaggagaaaaaaatacttgtttattcactatggctagttgtaagcttgagttgcatcataagaatttttttcctattgctaacttacacaatacacaatgtataaggtgtgtctcgagaatatatttattccttaaggttaactttttagcacattttggttgcccttaacacatactccacataagggggacgtaattggcaatatgtacatatggagtgtgggaatcggctgttttgacttgttagctagccgtattaagagtacttaatagcagttggtccatcgcccaagctgatccagttaatcgctaatctctatgctcccctctgataaggatgccatatgtctgacactcgttttctagtacggggtaccaggaaaactctgttcagagtatggtttggaggcacatgggttggccaggttggtctgcggcacccaccagccaaaatcagtagtaccactactcagttcttggatctggagaattttctttactggaagatggtgtgcactgtaacttcagaactccggcatccagcggttacaagtgtaccactgtagtactgtagtgctagtagttctagcgctgctagcatgggggcaactcagccaactgccatgacaactttccactcgaaaagacgaggaaactaacccacatgccaaagcatgcacgtggttcatagagccctaaaacagagtaatcctggtttattttagtggcccctttttgcagcaaaccgacggcctccctcatgcttcttctctatagcttgggcaaagtgtagttaccagtagtagaagtcctctctgtcccgctctctctgtttctgtaacgataatactataaaatggcaggagtcatccgtgatcgatgccacgacttggtttagtccgagccacatgccaaatacaacggtctaatctaggagtagtagtacttagcatcatcagctggaggaatggaaaaattggaccaagacatagtgggtcgggctgcttcaaagtatgcaaccaatcaccaaagtatggcgatcgatatgtatcattatctacacgaaggtcaaaccgttgcacagctcgcgaagttcagaagacatcaagacaacttgcgatcgatatatgtatcggcggcttcgagacgagccgtgcgtgtgtagcgtgcatggacgccgtctgttccaggcagcagctagctagcggatgaggcatggctcccgcgagacggcgagaagacgatctgaccggtggtcgctgtgccaaccacagcgaggctgcggcgcattgccatgccgccatcgtcagaactcagaagttcccttttctaccgtgctatgggatcgagtacccaccagtctgctacacgacatgcgtgtggagccgtggtgtatggagtaggcgctagcatagcaggagcagcatcaggccgggggagacggagacaaacaaatgcttccccacgcaggacggaacgaagcctgtgcgtaccttcattgcccggcaaagaacagaacatccgaagttctcaacatgggatatattgctatcttgcttggtcttcggtggattcgtatcatcgtatgcgctgcaacggcagatcaacaatccatctacacaccgtccaccattgcggtggagatataaacacactgtagaacatttcgggtgaagaaggccaaaagtggtgctaaagctacaataaaattcagtgtgaaatctgaagccatgggaggcccaaaaccccctgtctcagccaatatcgtgcagtccgtttgttcagtttggtgcctgggaagtgggaacagagggaagcagagagtgtgaacgtgaaattcagaatcgggtgaagctgcattctacaatgggcctttaaatttaactggaccaaaggcctcgtgggctttaaattcaaaaggaggcttaagctcggggttaagggcctttaaatttaactggaccaaaggtcgctgttataagctggccttcaaaaggcccactaatcattagttgttgggggaaaaagtgcaccgaaggtccctcaacttgtcatcgaattacaaaatcgtcctccaaccacaaaaccggatacaacgcatcctccaacttacaaaaccagtacaaattaggtccctcggcgggtttgactcctgttttgtcggacgtggcagctgactcggcgtggggtctacgcgggtcccacatgttagcctcttcttcccctcccctctttttcttttttctctcctcttcttttctctcatcgggcaaggcaaccatcggatgaagaggaggccagtgggggaggcgggaggtgggactccggcggccagcgacgggcgacgagatggcggcggcaacgatatgggagcaggagggcctccccccacgccgccaccaccgttgccgacggaggaacacggtgagctgcctccggtgggctcgccggaggaagtcagtggcggtgtgacggcgcaggcggtgaagatctcctgacgagggacagcagcaggttgttcgtctccaacatcatggccgcgccccctacgtgctccgatctctcgccggctggaagaggagctcgcgagcggaggagacgacgtgcggctgcggcgacggcggctcgggttaggagagggttatgagagggcgagagatagtgggggtgggagatgcatggatggacgacggcgacgacacgagagaagggaggtggcggcggctgcaacgcttgagaagggaggcccgggctccgacgccgaataccacctccttcgccgcatacccccgcgcccacagccgctgggagccactgccatagacgactctgcgccgctcggcctcggcggcggcggcggctccgggcagggatagggccgccgccgttgcccagctcctccccggcggcgagggagggcgggcgcgggaggccgtgctgcgccgccgccgcctcatcacctgtcgccggccgccggattcccgcctgccccaccggccggttgccctggcgactattgaagtgcggagcaaatggagagaaaagaagaggagagaggaagagtggggaggggaagaaggggctgacatgtgggtcccacgttgagtcagctgccacgtcggacaaaaccggagtcaaaaccgccgagggacttagtttgcactggttttgtaggttaggggacgcgttgtatccggttttatggtttaaggacgattttgtaattcgatgacaagttgagggaccttcggtgtactttttccttgttggggagagatgtgtctaagacgggaggaagaaatctactggaccgggccaaattgacagatactcaatggaatattggttgtctgtatacattcgaaaaacttacctccctcgacaatggaccgaatctaattctactgtaaaaacaggtatatattgtctccttcaactatcaaaatcagctcactttatctttacgagtggtttttatttgacgtagcacttgacttggtcttctaacatggtgctctaacatggtgcttaattagcaattcaaccggaaaaaacccatagggtccagtggtccacatatcgataatattgttgccatctcacacctctatttgctctcttccctctcaatagtggagggatctacagtggtaggcctccttggatcgtgatagtagcaacactagcatgaactcgaggaagagtagggggttatttgtggagtgcagagcaggccacacttcgtcgggtggagcaagcagcaagcgacgagcgatgagacggcgtggaggttggcccctatctcggcttccttctcaactccaaccattagaccctaccaccaagatagccttcatagctccatagatggagggtattcgagaacaatgaaggagaagacgttagcgatggtttcgggcttgcctagcgcgaggatgatgcggcaaagtagggcttcgtgggtttaccagctgtcaccaatgacttgtgctgttgccggcactagcacgttggtgagaaaaacagactcccgtcgaggtggtcgagcctgagctccaacacatccccaagccttgttgtctgcatggagccatcacaatcaccgtctcctacgacctcgggtcttttaaggagaaagggataagatggcaataatgtttttttttactgatatacgagtctcttttaattttgtcatggctaaattacttggcagatgaatcgaatcaatgtggcacgtcaaacaaaactatggactatgatttgacgtaagcatcatgtagcacataacatcttcaaaatcacttgtggtaaaatgagatgattttggtagctgaaaggctatatacatagttttgtcagcccatagttaagggaggtaaaatggacttttcttcatatccgttttattgctgcggcagtgcgggattacggaatggggtttgatgggagttgcgtcataatcatgaacttatcaatggcttaaaccgatttaaaattgtcgtaaaacatgggagcaccgagcacatccttctctcctgctttccatgatatttgaccgccacaaacaaattacaggcgatctaaaccgtccgttcaacctccaatacggatggcccgacgcgaccgacgccccacggcccacggcaccttctcgaccctgacgcgtggaccctctaggctactactactcatcaccgcgggccccgcgaaccagccccacacgacggacgccaccacgctcgcggtggactcggtccaccaagaccgcaggcacaggcgccggcggcgcacacaacaccggaccggagcaccggaggcgggatcaaggtgaaaggccacttgtttgtgtggactgtggactgtggtctgtacctccacggctccacctcactcgtcgcagctcgagagttcgcccaagtctccccccgatccgtgcagagatcctcgtgcgtccgaggtaagcacacccccccccacccccaactcccagttcctaagccctcgtagattcgccattccaactcagttttcgcgcacgaaatgttcgtcttctttcttcgtcctaggtgagctttattgcagattcgccggttcagtttcgtttgcggctagaaatgttcgtgttctggggcagtaggatgggtgtcgggtgcttgatccgtggttcatgaggagggttttggagtgtgagaagatccgagacaccgcactgaattactgatcccattctgtgcgtgtgagcgagggagagggagggagggagactgggagaggaggggttagttttaatgtagccgttgaatgattgtgcctgatttgttaggtgagcatggaggtgatgcatgataccactgggaagaaggaagtggttgtctgttatatgaacgcccctctaccgtacatgattgaagagaattacgggggatgcttctttgaagacgacgttgatcttgcacaggttctccaggaccaggttgggtgcgaccgcctgctaccttcttgtttgattgttcctatgctactgatttgtttcttgttttgttcctgttctccttgttgcatagaaatcttaacatcatgtgttccaccccatggaaaattgtgtgtttggacaacacaatgtacaatgttatggaaatgcagccaaacacttcatggattaggttgttaatttgtcttttgttttgttgtagtattattgaaagtagacctgaaaggtgaaacatctttggctctcgtggtgccataataatgtgtaaagaatagcctcttgatgacatttacattgtaaaacttctagctcatccctcattgttacatggtgctaattaccattatcacaaaatattttgtacagtactagttatttgtcgaaggtttttcagtaggattgtgatgtttctcttttatagtacaactgcacaagtcaacagtgcatgatacatatgaaaaatatgatcctcatttgcttgatatgcttgcaccttgttcaggaaatagtctatcaattaatacaaggaaattatggtactggttcatccaaaactcattcaaatcctagttctagttatagccatggatgtgaattgggtgaacggaaaccatcaggagttgcaagttatgaagcgcaactagttgttgatgaagctttagctcgagagctgcaacagatggaggaccaactagcaagtgcatcaattgatgaccataacataatagaacatggttagttgtttactggtactcttctatatagtacaggacaactggtgagtgtctttcctctcgtaaatgctaatacgtggttcaaaaatatctgttcaggaagaaagccaatagcttcttcaacatctagcggtggtaatgcttctgcaagcagacctcctcaggtagtgatggaggatggcattgatccagataacatgacttacgaggtgaattccttcaaaccattgttttgccagtattttctctactgtttcgtaaggggacgtgccattgtcaactggtcttctactccatgaactttcatttcaaagtacctgtatagtctatggtaactactgttgtgtcatagaaaattcaagtatacaaaaattggacgtctccattttacacacattgctctaaccatgtttactatataaaaattgtaaagttgttctttaacagcttattgcttttaacaaatgcaaataaatgggataattgaagctattttcttttattttgttgaattttgtttgtatttcaggaactgcaacaattaggggaagctataggtactgaaagcaaagggttgccggaagatgtgatagcgctcttgcctacttcaacatacaaaattaggatattctcaagaaaggaaaagcatgacgagtatgtccctgtcctgattagatatttcagtgaaaatgtgatgtgcagttatcaacaggttattaataaacattttctatgcaacactctcatttacttattattattgtagaaggatatttggttagtacttttctgatcttaagttgcatccttcatcattgtgctagcaaaggaagctcctagagtactcgttatctatggctgcatgttcatgttgagttatattgcttgagtatgaaagtatttttaatacccacttctttgaatgtttacaaaaacagatgtgtgatatgctgtatgacttacaagaaccgagataggctgactaaattgccctgtgagcatcagtaccatcaaacttgtgtcaccaaatggttgaagatcaacaaggtaggccaaccatgcttttcaatctttccaatgtttagtagtgataagtgtatatgtgtatttattgtagttaccgtgaatatgaccttgattactttgctcaccgtaaaattgttctgcttttcgaaattccatcttattacctggtcaggctagatttaggctgagttcaaatctacgggtttgtcacccgtcctccctagcatgcaaaatggagcggcggattagtgcatgatcaattaagtattagccaaaaaaacttgaaaaatggattatgaattttaagcaactttcctatagttcttttttttttgcaaagaacacactgttaagtagttcgggaagcatgcgcgtggaaaatgagggagtatagaagttgcaagaagggagtatagaacacacccttagatagaatgacaatagtaatgtactgacaagaagacttaaataggtaatgagatgggtaagttatgaggaaagctacccaagaaaagagcttgtaatctcgtgtgttcatagatttacaaaatttttgagaccatgtttgcatccagaatgtattgatactgatcagccttgtgacacatttgtcaggtatgccctgtttgcaacaaggaggtttatgggtcgggcaagtgaaacattacggattcatctttcatgaaaaaggaggcaaacatgacggattcatctcacgccagttcaacaggcttaagaagtatcattgttcactggctgtgcactcattagcatgcatcatggtggcaggaaaggcaatgcattgtattgctaatgatcggaagattgtcagcgagttaccgaggaatgtctcagcaagataaataagatagatgcttctgttctgtttttaagctttatggagtcttcgagtaactgagactcttatttcagctttcaggcctggtgctttacacacactgtattgtaacatatcataggatgtatatcagtatgtgtatactgaagattagttgcatgctagcatctctgtattgcttgtactcttatcttttatggtatcaaatttggctgctggagtcagacttgtatggtcttcttgatgaatggtcattggtcaattccctgacttctgagccaaccagctggaactatggactgctatcgtctagccagagagtgtttggtcttgtttccaagtggccaatctatgcttggataattctttataatggaacattggactattctacatccattaacgaaatataaccttctaaacaggactaaatgatgttggcataaaggctttgtacaagggaagcagcttatgaagagacaaatttgtgggagcttctgaaatgagcatgaaaatgacaaattcgacgggaacaaggacacaaaatggcaaaagtcgccatgaaactgcatgcgtggtgctcgtcagagcggaaattcgacgcacacaacggcacaaacgcgataggatatcgttaaaccccaaaacttgaccatcacaggtggcgcgtcgaagtactcgtttgaccagacaactacacaagttcatctggattagctttgtttattaaagtgtaaatttcacttcgggccatcttttattaccgatgtttcgttttgtaccaccctttaagcaatattttcattttggactgggtaaacctgcctttgtttcactttggaccaccgactctcttctcaagcatataaacgatctcgattacatcgtcccctactcgtcaatgaactgccacagctatatgtaagactatttcttcgacatattataagttggatgtagatggataaaaaagtaagggtggtccaaagtgaaataaaggtaaaaatacccagttcaaagtgaaaacattagtcctaagatggtacaaagtgaaacatcgataataaaaggtggccaaagtaaaattaactctttattaaaccaatcctgacgctgctctgcccgaactgtcacgcccactgctggtttcagataggaatcctatcctgacgacgaagcttgtcattttccagacatcccctcgaatcatagcatataagcacatcataatcaattcatcaaactcgacagggatttgtagttgtttagaagggatttgagaggattttattagggtctgaaaagcaattgtttcggaatgagaagtacttaaccgacgaagtgagcagtactagtggactactaggcgtagtgtctacgaagtggataggtttgcaatgggctgggccccaagctaggttgctgactcggatccacgcccatgggccccgatggaaaatgtttcatattgctaggcccaaatcgcacgggggcccaaaggttagcgcagcctggtcccggctgattagacaccggcacatgggccccaggtagttaatcattgatgtgagattttctggttgttaagaggaaaatccggagagaagagagaggtccctgtcacacacgctggctaatactcctcccatctcctaacaccagaaaacgtatacatttaatttccatttcttgttcatcgtgaataatggaccagacaaaatcaatggctggacaacgtttcagatactagataagaacaaggcctcgatgctgcttatgtactaatactacaacatgttgatacttgatacaagtatataatcagtggtccagtgcacacctgtatttattttgtaccatcagaaaacaacggagtttatccgtgggagaaaaataaaagaaaggggtacacaagtctgcatgcaccaaacattttgatggcaacttggcaaccggtggaaacttggcagaatgccgccaattgtggccggcatgatgatacttcacgcgtgtacgttgctcggtgctccaaaccttatcggttcccacggcgaagaatgcccgtagtctcgtcatacactcgtactcccgcggagataaacactctctgtagttagctgaatattttgtgccatgtgtcgccacaaccctgaatcctgatttgataaagatgacaagaaaacgatacaatctccctgtgctgatgctgcgctgcatggatcgaaaagggcaacctctctgtactgatagggatcgatacggcatcgatccagccgaagatatttagcacctccatttcgcgcaattatcagtgacaaccgacaactctattgattatatttttcttttccaaggaaatcttagggtgtgtttgaggagaaggggattgaaggattgggtagatacgtaaaacgagatgagctattagctcacgattaattaagtattaactattttaaattttaaaaataaattaatatgattttttaaagcaacttttctatagaatttttttttaaaaaacaccatttagtagtttaaaaaatgtgtacgcggaaaacgaaacaaacaaactcactctctaccctctcgaacgctgccttagtatctttgccctttctgaccacaaaagggagggtgctttagtgcgagtagaaaactgcagttcatgcaggtgaagatgacgacgtggatatcttcatctttctcgatcggttgttgctttcggagtttcagtacttgtccatcgatgtttcttacccgttttctcatccttcgatgatagttcaatcttcaaccgatatagtagtatatctgatctaatctactccaaaagggctgaatacttattgatctaccggc

SEQ ID NO: 43875 - DNA, 7142 bp, Oryza sativa
ctgtcaaacatggtgcggtggtcagtgtagccagtataaaatggacatgaaaactttgtttttttttttttgcgttacatgaagatttttatctctcctaatgcattgcgcattagcagccaactgggaatatttcatatgaaaaaaacacctgtcagaatcacataaggacacgaaatatatactgcaccaccgaaactgattgcattgctacacacctaacctgaaagacctgttccccaactccaggcacattcagaaggctttcataaagaagaaatagaaaacaaattaccgtaaatccaatctgaatcacaggcggtatctaaacagtagcacttacagaacaatatcaaacttgaccttaacttattttgtctgaaactagcaacccaaaaggcgcatatattttacacagtcatcaccaggtcagcaaacagaacctcctagtagctcttatgtcttcaggcttccgctataacttgagaagactggccctccaaagccttctcttttctcctccaattcgacaaatttgacgctattccgcattttattcagatccattccccctcgttcgcagctttccgcgtgaaggtacgagcattttagagcaggtcagggatttttttttattttttttacgcttgatttgatgcctaaaatggccaagaatctgggccttgattcggagacgagtttctgattaattcgaattggctgctccggataaggtgaccggttgtttagctccggaagtccggatgaagtattcctcgctgcaaatcggttgaattgaagcggaattagcggttgtccaaccgctaacgcccggacagagaagaaaaggtatccgcttgggaaggctaatccggaagcaatcgcggcgatccgtcgtcgttgaatcgcttcgagagttttggcatttcttcagcgtggcatgggggcgggggcgtcgagcatgatgggaccggaggggtacggccggggatgggggcagacgtcgctgggcgacatgccggagagctgcgtcgcggcggtgctgctctacctcgacccgccggagatctgcaaggtcgcccgcctcaaccgggcgttccggggcgccgcatccgcggactgcgtctgggcggccaagctccccgccaactaccggtacctcgccgccctcgccgccgctgccgacgacgacagcggcggcgacggcgccacggaggggaatggcagtcgctgctcctccgcagccatgatcaagaaggagatatacgcacgcctgtgccggcccaccccattcgatgggggcaccaaggtaagctaatttatcctctgtaataatgactctcattgagaactgagtttagcacctgccttatatcctgtgctttctgctcttgttgttggcaatacatctatgttcttatttaggttgaagagaggacatcgaggttcttattgataggaataatagcattccttatgtggaagagagggacatcgagtagaaagtagatttgattgtgaattaacaattagtaattgttgagtgagatttgttactttatggtgatattagaattaggatgacttgattgttgagaatctcaaacatcttatttgatatatcggagcgctagtaggatagatcggagcactagtagtaaaatatgaaataatcatatggaagttgaggaattttttttcatgtgtatttggtttgccttgcttgtctatgttggatgatgcttgttcttgcttttcttgtatgtcgtgtttcaatgatctaattgaaaaatatatttgtgtgtaggaattttggatggagaagacaagggtggtctttgcatatccatttcctcaaaggctatggcaatcacaggcatagatgataggagatattggagtcacctctccacagaggagtccaggtacttccctcatggcttaaaacctcggtgtgaagttcctttagaagttaagattaaattccatgaaactattagtttcgagacctattcaagttttggttttcataggatatttgactagaaagaatgggaataatatcgaatacctctcactgcatggtttattttcctaaatatcctactgtatggaggtcagaaaatttcacttagctctggatacgtgcttattggtgtattggaaactctcgataattatgactctcaccatgctctctttaacttagtgtcaactgctctttatctttgttatcatggccataaatttatttcccctttgtcggaaaatctttcttatgctgatacatgctttcatctcgcacctgtccaacaagagaactcctcttctttttctcaattcaaaaagagcttgttttccataaggtccatcaaagtaataagtacaaacaaactgagaaggctaatctgttagcaagcttattgtctaaactgctagtaacaccctgtgccggttcattcaaaaaacaagaaaaaaaaaagaaactgaactgctagtaacagctcacatctttgctagctattccgcttgagggtatgcttggcatgtgttggtgcttggcaaggtgctagggtccaatagctgaaaactggagccttattttctgtaggcagtgtactctaccaaatatacagagctcgtgcgtacataaggccccaaatggcgcatgattcatttttgttgatcaatcgtgctgatatatgtcatcctttgggtcatttctgttgtagaaaattcatgttgtacaaaatcatctagcagttccgtactaccattgtctccagtccgataatttctgatgcaaattgtatcttcaaaatttaggtccttctatttcattcatcacctatacggtttgatgccaaatgatttctttgataattttgcatagttagtcctctcagatacctccactgggtatatctttttagtcttcactgatgttgccaaataacaagtgactaaaccaatatatttttcaccatacagattccaccatgtcgcgtatcttcagcaaatatggtggcttgaggtggctggggaaattgatttctgcttccctgctggttcatacagtcttttctttcggctccagttgggccgaccgcacaagtacatgggccgccgagtctatggctatgagtcaatccacggctggaacattaaaccgacaaggtttcagctttcaacttcagatgatcagcaagctacgtcgcaatattatctgaatgagccaggaaactggatcctttaccatgtcggggactttgtcgtatcaagttcagatcagttaaccaaccttaagttctccatgatgcagattgattgtacccatacaaaaggcggtctatgcgttgattctgtttttatatatcccaagggtcatcgacatgaggactgcacaatctgcaagtaaattttggaaagccactggatcccgttctcctttttccaggtcattcctgtccaaaagctcaatgtatatatccaaacttcccacagaaaaaatttttgtatgggcgtgaagtcttgatcgatattctttgtagtgttagctaaatcagcaggaagattatagatgtaggtagtgagttaggcatgagtgcttctgtgcttggagttttatctgtagaaagagcagttccatttgttcatcatttgtgtagtgatgtttaggtgataaagtctttcgccgatgttttttgagatttgtacaatttccccctttcttgtacagattatgtcgtatttttacttgtaaataatatgtcagattaaaatgtttatagtttgttctactacttattctacttaactgtgtcttggtggataatttgaggctttgaactgaacatactggtttgctggaatattttattagggggaaagaaggtaagagaaaacaaggacattagttcactttagtctctcaatttatcatcaagtctgaaattcatccatcaactgaaataccaggtataacttatcccctaattcacaatacaatgtcaactttgatccctcgaaagttggtactatagtagccggttttggctgatgtggtgagtggggcccacgtgggccccatatgtttgcgggtaaccgttgtctgcgtcattgtcctcctaccttgcagcatcatcatcacctctctttgggtagatgcgccatcagatttgttggcatctacataagatgatgtggcgtcggacctgcgtgatggtctttcccataaatatgaggtcgcggttacggcctgcgtgtacggagagtcaaggggaaaaccacggctttggttgatggactctgacgatgacgacaacggctctggtggggggccaacggctgtagtgccgcatagtttccaccaccactccataaccgcccgagacaagcttaggatttggcgtcggcaatcctcttggcgatcttgcggaggcagtagttggagctatcatggaatgggttcgacgagttgatgcacttcggccacgatatcccccccccctccccgccgccgccattgtgccctgtgctcaggcttcgagattcggtggaaccctaaaagaaaaggattagcttcgcgtgcgattagggattgagaagctacggtgatggcaatggcgacgatggcaaggtgatgtggtgggcttttccctccttcgcgagctcttcgtgccgggccaccatggccctttcctcgctggccaccccgctccacgcttgagaatatgagagatgggaaagagagggaagaggatggagaagagttggctgctgacacgtgggcacatgtggttcccacaaaccacgtcagccaaaaccgtccattatattgtcgagggaccaaagttgagacggtgttgtgagttgggagatgagctatacctgatatttctgtttagggatgagtttcagacttggtgagtggtgacaacttgagagacctaaagtgaacttattcagaaaacaatagaaaagcgtttcaagaggaaccctatgggcctttgggtgctgggctatgctcagttgggatctagcgggccaactcttgcgtcggaggagtcttgttcactaagaagtgtaatgggcctagcggctctgggtttccaagcttagagttgttgtcgaacacaaaagttgcgcgtagtttttgcttttctacactctaatccttttcttgtctaaataaaagaataaactttgaataatctggcccctttacctcttggacgtatatatagcacatcaagctgcaaacctaaccgttctacaagagattatgctatgcgctttataagtgcgtaagattatcaggttgacaaggccattgaagctgggaaagcgaaagcaaggctcgttagtggtaactcgatcagcacaaggaaattaaagacaagtatggaagcatctcagtggccaaaacaaccttagatgcagtagttttctggcaagcaaagctagctttacactgacgcgggatttacgtggtcgacggcatcgcgctcgtgttgtcgtggggaaacgggaactcgccgagattaccgggccatcagaacgtgcggcaataataatcagacttcgtcttccgcctgatagagtaggactcgtttgtcctggagcggcacacttttctttttctttttgccaagctagctagtgctgcctcctcttgtgcaatgcctttttacaccgggtgccagatgggaacgtacgtgaccatgggacacgactggtagtactagctacctgtatcattaggagggaggagtagttgttacccaccgagctagctagggagaggagggcgaacctgctcgctctcagtgctgagctcaatcagcaaccgtgttttgactgaactggtatgcaccttgaatgcatttttggcggcaatgatgcatggcagtgcgatgatggctttgctgtgttgaagtcgttggaacactatgatggggtgccctggcacagggcatgccatgccaatgccattgccaggggcagggggctgatactgatatactgggctggctggctggctggctctgacggccccggcgcctccctgtctctggccggcctcacgagcggtggacgttaaatcgccccctgcctctgcctcccctctactgggtggtccaatctcatccattgtgctgtgcttgtgttcagtgcaggttgcttcatgtttggtcttcctgtactctgggccacagtggtctaagtacgcgccggtcgatcgacgtgtcgaccggtgagagcatgcatgcatgagtgcaccagcgatcgacgggattgcactccgcgacagtgctatatacgcatgcagcgggggagaaaaagaaaaggcgcgcgcggtcagtgatgcgacgtagcctggcgtccaccgatctcgtcgcgcgcgcgcgcgcagacatggccggccctggcgccgcaacagtgaccccctcctgatcggtgcaggccgtgtgcctagctagtgtgtgggcatgcatgcagagacggcactgtggcgtggcgtcctccagcgtaatcgatctcacgcgcgactaacgcccctcgcgcgtttcgattccttctccctaataatcatggattgcactctcgcggagcgagagcgagtttaatttcttttaccaccgccccttgtacttgcagccttttgctgccgccggccggccggtcaaggtttgaaagtcgtctagagagcgcgcgatcgatcgagcccgcattgtcattgacccaagaaaaaataaaaccgatccatccgccgcgccatgcacgtcaaagcgagtcgctgtcaccgcgctcgattcgcgcagcaagttgcaccggcgttggccacacgtcgtgcgcgcgtatcacatacgtagtacgtactcctatcctagctagctacgtcgctcgctggacggagccgacatggcgagcacggcgcccatgtcgtcggcacgtcgtttgctgcatgcgcgcgcaggcggccgcgggtcgtcgctagctagctgatcgatcagtcgatctgcaggcgcggctcgagaggcttccttgggttattgaggggcacggtgggcaggaggccagcgcgcagcatactacatggcacggatagggctaagggcagggagcaaacaggccggtac

SEQ ID NO: 43876 - DNA, 5659 bp, Oryza sativa
aggggggattaattatgatatgattccagctcgggagcaggcatctgatttagggttggtgctgcagagaatccctgcctgatcgctcgccctgtgtatcgctgcatgggcgaatgggtgtgtgtgtgtgtgtgtgagagagagagagagagagagagagagagagagagagttgggatggatctgttgcccaactgccagcagctgcacccctgagccaggtccgtgtgtggcaccgccgattgctccccatacacgcagcaacaagggaagaacacctgacggattgcttggagccttggatacgtgggattgtctaatccattccgaatccaagacaatactctcccttcgtaaaaaagatcacacaccgtataaaaaatataaagattttttaagttgtatacggtaatggaagtcggttgtgactatatgaggaagcacagcagtaaataaaatctgagtagaagtattaatttgtaatatctgatctatcaaatttttttataattttgcatggagcaagattttaaatgtacagttagatatgatatacaacttagtgcttcaatttttacaaatacaattgtatttcatatttttaaaatatccttctgttttgaacaaattaaaaaatcacttgtattgtatgttgtgtacaatttatatagatcattagatttatttccactcctataatttggacccaccactattgtgtgtatctttctctctctctctcctttccttttcaattactaggatgaattttaggcctccatcatatggtcctagaaaagcagccaccatatcgcttctagaaacctagaaattgccacattagttattacaaaatagacaatatgtaccatttgaccatggtgcacctaaattataaatgggggagataaatcgatatattttacgcaaaatacaactatatttatggaaacataaacttatcaatatatatatatatatatatatatatatatatatatatatatatatatatatatatatatatatatatatatatatatataatacaatagtatctatagaaaagccatgagctatatatcaaatcgaattataatttaaaattctattgcgcgcaagatataattatattttttaaaacaattgtaagtacaataaatccaattctagttttatattctagctccccacaactttacgcaggaaatgcactagcttaaccatgaaaattagtacgtagttttaagggtttcaagggaaatttaaaaaggagcatgagtgatccaatataataaaagggttaaatatgggattattatttttcatatttatatgctgtttttcgacgaatccatataattaaagctggggtttgattggccacaaaagcttaaatattattctctccgccctaaaatataacaatttttagcacttaggatttgtcccaaatataacaacttttgcactaattaatattcccttcccaaccaatcacaaccttacaccattcatttttcccacctacatgcgcttctcaaccaatcaccaacatctttatattcaattctatctattttcttaataactgtgtccaactctaaaactccttatatcttgggacagtacattggtttatacataggtaacagagatgttagctgtcgagaccgagcgagcgcctaagcaaataaaagatgattttccggctcgacaaaaatgtcttgtgaatgagttcagtaacatcacaatgcttggtgttaatcggatgtaactttagtagaggcattaattagaaacgcgttgattgacaaatgaaaattgtttcaccaatgaggaacacatacgatggtcaaaagatgaacaacatcacagtcggtgctttaatttgcacaatctggacggcataacatgataagcaaaaaacctgactcatcaattaacttcacatctgatccctgaccgaaacaatgtcagatcgatgtaggtagagggacaccaaattaattaactagctagcatggccaaatattaaaggacatatatatatatatatatatatatgtgtgtgtgtgtgtgtgtgtgtgtgtgtgtgtgtgtgtgtgtgtgtgtgtgtatatatatatatatatatatatatatgtactttaatatttacaccgaacttctatttccaaccatgtcgactagatctggacgtacgacaatgaaaaaaaaagtcaagcgaatgtttgttaagctaacacgcgcagtacaaaaagaaaactctacttagattgaatccaagtttattttgtccggccgtgcgttagctttatttgacgtgccattgcttcatttcacataatgaaagcgactaataatataataagtaaggtgcgtacatgcttctattacccgtatggtcacaaaagtattagcattgtcactagaatgcacacctacaatttgattcaaccgggtaaacatcagagattctttttggtttagtagtggtgcataactctactctttagatttaaatcctactagctagtaatcacaattttatacacatgagtgtattaagagatgtactcgattgtgtacgtatacttgtcttccgagtaataaaaaataatttcatttgaaacatgaccaaattaaaatccaaagacaaataatgaaagcttaaaacattaaaaatccgatatattctctccgctcaaataattgtcgctttagctaactccttagttattcttttttttccaaaatacatacagtaggcgctcatataaatgcgcacgtactcacacatacccatccctataagtaccttcaaaaactaagccagtatattctgtaattcacaaagttactatatagatgttttgttgttaaagaatacattgtctaccactaaaaattaattaaccgaaatgcaaacacacgtgactagtaatttaaaaaaaatatacatatttcaaacatcgtggtttttatgtttttagattcacaatgataaatacatccctaatatatataattcacatgttgtttaactacgtgactttctaacgattaatgctcaaagttggaagcaaagctaaaaccataaataaactaaatcgaagaatgggaaatctagaaagaaggacaaatcttcttctccccaacaacgacgccacgcgtacaaacgttcgtgcaatcgtacggcctgacattcacacacgcatgcagcttgtaaccctgtcacatgtcggcagcgcaggcgactccgagcgaaactgcgagcggcggctgtggcgcagcgtggctctcccaccgctcacccgagactttgaaacggtatgcatgcacggtcggatgtggccgcagccgcgagctagcgagcgagcgatcgacgcgcgcgggcgccgtcaacctaaccggacacgacacgccgcgacgtcgatctccacttgcggggatccgtgcttggaacggttcaaggccttgcatttcaattccccgctcgccgcgaagcgacatgctgggacagcgagatgtcgggcggtggattggatggatccatatcgcgtcgagcgcgcgcggccggtcgaggtgacgtcgcggcgtcgttgctgggccggccgggcgcccgcggtcgcttgccccgcggcgaccggatcgaaccacgtacgctccacgctccaaggtgttcttgtcacgttttcgcgttttgattctatatgacaaccgattccgcgaactgtccggttgagattgattaccactttacaggcattttcaaccttttcaaaatttgatattgtcaaatttttgataagttagcaaacattatccagttttaatagaataggtaaaatacccaaatctgatgatatcaaattatctattcatgaccaatatttgatagtagactactatcatatactccttccatcctaaaaaagatttaattcttgggtttccgtgttcaacgtttgattgtctgtcttatatgaaattttttttatgattagtattttcattattgttagatgataaaacatgaataatactttatgcatgacttatcttttaaaatttttttaaagtttttttaaataagacgaacggtcaaaggttaaacatgaaaacccataaattgaggtttttttggatggatgaagtatttatcaattttaacaaataataatatggtttaaaataataccaatatgcagcaggtcctacatgctaactacccctagctccgtattaatcgctccatactttggcgatctttcaggatgatgctgatcagtacggagtattaatgccagttcagcccgatacacctcctctgtgtattttggcaatctgtattcagcttgaattctgtatgaacactaataaacgaggcaacaaacgactagtgcttcgaaacagacccccggacagagaactagcgcaactgctttgtgatgtatctcttgataaaccccttgttgagtcctggatatcctctgctccgatctttttgacttcaaacaaatgaatgactgtttccagaaaacaacttcgatgtacacatctcgacgcccttttcaatgccaaccagtaacctgtcatctacaataagatctccggtgttgactaggatatttaatttatcgccttgttttgcactgttcaatatttagttcaaaagatatacggtcagctccaaatccatttcccttcaatctttcgatactatcaagattatttacaaagactagcaaactatcgatcacaacataaatattttagtctaaagttcaaactatcgatcacaacttaaatattttagtctaaagtttttcaattattttttgagggcctcaagagcctgggcatgcaaatattttagttgtgctagtctaatcacaactcaaggttcccttgaaactagggggtcaataacgagtcagtttagcccgttgagttagttatcttaaggaactagcttagctcggcttgttaatgttaacgagctaaaagcctatctcgacttggtttgtgagctagctcacacacacacacacacacacacacatatatatatatatatatatatatatatatatatatatatatataaaatttgtttggtgcttcatggtgcccggacaccattgttgaaattgagtatatacctaattcaaatgagtataaaactttttcaattatttaggtattaacattaactactttactaactagttcaaagcaagtttgaactgaatttgaacttgtttttgttagattttgattctaagtatatagcatccatacatataattagttaggtatgtaatcatagattgtgaaataaagttaaatttgagttgttttgttgataggtataggtatgaatcgaattcttataactaggtatatactcaaaatttaaaaattttgaaaaatttgagtgattttctgcatttgaaaccatggtgcccgggcaccatagtgccccatatgagtgtatatacatatatatatatatgtatatatatatatatatatatatatatatatatatatatatatgtatatatatatatgtacatatatatatatatgtatatatatatatgtatatatatatatatatatatgtatatatatatgtatatgtgtatat

SEQ ID NO: 43877 - DNA, 2767 bp, Oryza sativa
acttctatgcaaacatctaccaaaatagttttcttcaaggcaaattgctgtgtgaaataacggtatgatcagatttgttttatttcatccaaactttaagagacatcaggatatagaggagattatcagataaatgagataatcaaatggaataaaagtccatagttactccacaaaattgagaatatcttttccacacaaggcttgccggttgcggctgttatatgctgtctgctggaagtacgtacgttttcaatgtggttgctttctgccggaattttttacttcagtatcagactatcctagtttggttccttgcttagaccaaacgcacgtaattaactagtcgtgggcactggattccatttattggtatccatccatttgtcaaaagcccttagatcatcagctgataaaaagtctagagcatcagattgtgtggtctcctttactctgcatccacatttgaagacacgcatgtcttgtttctgtagttcccaggcagcactaacaagttctgtcaacttagctacaaaattcatcgtctttttttatggtaacacgatgtctagaaggataacgacaacagcacaagctgacaagcacgctgcactgccaaatcttctcttcatcctttttggcaaatgattcacttagtacctgaaaagaggcccttttcgggggaaaacatcgattaagatctgaaaaagctgaaaggcattgattttgccttacctatcaaattttgtttgtgtttggagtctcaactgctgttttttttccattatttaataattataaaattcgttatcaataaggttttacttagtttggaggcttaattatagctttattatgttttaataattaaaaaattgaaaaaaaaactatttgatttcatgttcaagtctcagtttgctcccttcgattttaaataactatgagtgatactattcaccttcacgctttgattattcatttcttttaaaaataaataccttttcaaatatcacattgtcaaagtgtgttgcatcctattaatttctcacccttacctaaaatttaagagaaatcaaatttcaaagttgaaaaggcaaagtcaatattgacaattattttaaaatagagggagtagtattttttttcaatattgtagatatttaaaatcaataagtagtgatttgtactcgacatgaacactcatttttagattaatgtaaaaactaaattatccaaggtccaaacctacgcacccagggcagcaatgaatgaaatatatatgatgatggtgaatctcggtctaaaccgatatacaactagttgaaccccacgatttgctgtaaaatatgtggatgaatgtatgttatatattataaaaataatatatatatatatatatatatatagatatatatatatatatatatatatatatatatatatatatataatataaaaacattgtgaagataataatttgtcattacttgcatattgagttctaaaataaaataaaattgcgaatgatatgccacatttgcatgatatttaaaatactctagataataattgctagtttgtgatgatgggacacacttgcatgttgagttttaaagttagcgagcatcaactatatagatagtatagatgtggtgtattttttttcctatgctaggatgtgactggagatggacaaaacacaacgaatgaatgacataaaaaaatctttgacagaagcactatcaatctattaacttattaaagtaatagaaaaagaaatctccacttttgctctcacacctagaaaattttcatattaataagataaaaaataaaaaatagaatccatatggaaatacaacttaaaaataactaaaattcaaaattaaaaaactaaggaatattggaagaggatactagattccatatagccatacaatttagagataattgaaattataacttattaaagtaatagaaaaagcagctcatggcctagacattctcatattaataggataaaaagaaaaaaaatagagtctagatagaaatacaatttaaaaatagctgaaattcggaatttaaaagtaagaaatattgaaagaggagactagagtccatgtaagtatacaatttacagataaatgaaatttggaattaaaaaaattgaaagtagaggttagagtacatatagaaatacaataaagaaataacttaaaaaaatattgaaagaagataatagaatccatataggcatacaatttagagataattaaaattcgaaattaaaaaaataagaaaactaaagtagaggttagagtccatataaaaatacaatagcgaaataactaaaagttgaaactaaaaataagaaatactggaagaaaagtgtagagtccaactaggaatataatttagaaataaactgaaattcgaaattaaaaaataagtaatattaaaagaagagtcaagagtctatataagaatttataacttactgaaagtcaacaattttttaaaaataaaagtagagcttagagtctatatagaaatacaattaagaaagaattaaaaatcaaaattataagaaaagaagattaggagaagtgtctagggtatatattggaataccaaatttggtttggataaccggagttgcaacctagtattcgtctaaagaaaagcaactgtatcatttggtctaaagttgataaagacattttcaaataaataaataaatttgtacgtaaacttttatatttgcttt

SEQ ID NO: 43878 - DNA, 16444 bp, Oryza sativa
caaagatctgggcacgtacgcccgggacgagctcggaaaggcaaaatctgatcaaagccatccagcccagccagcgacgcccacatcttcgcggatcgttacatggcgacaacgagtggtggctggctcgcagccggcatacgcgccaaaaaagaggcgttatttttgcgcgcggtacacgacgcccctctgcgtccccgtcgcaccaggctaaagacagcttttactctgccgcgtgggcgtcgacgaaacatatgcgaaaataacacaccgcccctgcgtccgcttcgcgcgcgagcgaccacgggtttcgtcccccgccctccttcgtcctctcgcgctactacgagattatttctagaaaccaacaaggcgctgagctgattagtggttaactagcgtcgttttgctccggaaaagcaaactcgtggcctcgaccgcgttgctctccatggacatttgcctcggccacgggggccaggagcaaggcaacaaggaaaaagtacagcgtctcgcgacaaaaacggtgggaagcggaggttacttgtttttatttacgccgaatcggtgggccaataacagcttcccgccggccgggcgggctggctggctggctacaaatacaacaaggcctcgtggcagcataggcatgcatggtccatctcgacgcacacgcatgcaacaaaagaaaaaacgcaaccaccaccgcctcaccgaggcaggcaacaatgccaaaacttgtccagccttccagcagtacttcagtagcaccactccaaaatcaaatgcatgcatggctgcctggaccaatctcggccgttggctaggccaccatgctctccatgcccgttggtcaccaccggtcaagacaaacatactgttacttgcaatcttgcattctagcttgttgccgctggtactgatcatgcatggacccctcgcccaaaatagagaaaagaaacactcggtgcttctcaatcggttatataaaatatatgccaccacttgttcgccaaggtgcattttccatgtacgcctatggcttagctagccgatgcatggcgcacatactgcatgcgttcttggctactaaacccaacttgcaaagaaaaaaggcctagatttcctcactccgaacatggcgtgtcgctttgcacctatatccccgggtgaggcatccacatatacgcagatccattactattgatggtgtgtatctgaccccaaaagcagctagtaggttgggtgaggctacttgatttggagagcatcgaagcagaaatgattagatcgttgcctcatcgagtaagtctagaagcgaaaccacgcatctggtgaccagcgagggagtccccagttttccaaacacctggttttaaagcgtactagtcgtacatgcttctctggagatttctcacaacttgatcacacaacttcgcaagtgtgtggcagtttttaattgtcctgcatttagctggggcggcagatgcagagtaacctagctcgaagagtttacctttgcttattttgaaaagatcccaagaactattataattttactactagctaggtgtgtctaaaatagctttttaaagtgggcaaaacgaatatgactaatggcctttgccgaccaaaactcaatccccagtatatggattattgtttgacagatcgttttgcagtgtacaattaagtccactatttctttatttgacagatcttacttctatctttactattataaaaattaaagatatttttgccggtattttggtacgtcatccgtgtatgagtcggtttttaagttcgtttgcttttgaaaatacatatccatatttgagtcggtttttaagatcgtttacttttggatatgtttaaaaaaactcgcatgctaacttagatgattggattcctaactgtagctcatgattttcttaaaaatatatatatctaagcgaactcacacagtgaatttcatcttaactaaaccatataacaataataaaattaaaatagactccacccgttacaacgtacggatatttttttctagtataaacaggtttaagcaaaaccttgtatttatctgtcgagtcagcaaattcatcattttgatttcgcaaaaggttgttttctatgttcacaaaagtacagatgacatggcaaacaaattaaggctgcgttctttccgcaagtttcccaaccccttttcctcgttttccacgtgcacgcttttcaaactgctaaatggtgtgtttttttgcaaaaagtttctatacgaaagttgctttaaaaaaacaaattaatctatttttgaaaaaaaaattaactaatacttaattaatcacacgctaatggaccgctccgttttccgtgcggtggagttgggttcccaaccccaactatcaaacacagcctaaggatgagagtatgcaggaagcgaagacattgacattgctaatttatcaaattattttttatcatgtttattaaatagctgtgaagcaatgagataaggaacgctgctaataaaaccagttgactttgcacagtacttcttccgtcaaaaaatatagacatttttaagattgacacggatattaataaagtatatgagaatgattggagaaagtatgtggttggctgaacagagaaagtgcgtaaaaaagaatggttgtgattagttgagaggatgaagtaggtgaagaaatagctttattttgggacaagatactgttttagaaataactatattttgaacggaagtagtagcttgttagacacatttgttatacaaacagtatggagggtagacttcatttgtttgtatatatatatacgttgtcaacgcataaaagaaacttgagtgtgagttgaccagagggtccagaagtactatgtgggataggcgattgaactttgaagggggaataatataagattaacatctcgagagaatatcatctcgtttgttcatacactattcaaatagttaaaaaatgacaagatttatacaacattcatatacaatttcacaaaatcttatctaaactcaactcatatattcacatagggatttgtcaattttttaattatacattggatttgtctttgttttaattatttctcaaagtgtggatcaagttttaacttactgtgtttcatattataagactttctagtattgtccatattcatatagatgttaattaatctagacacatactggatatgtgtctagattaattaacatctatatgaatgtgagtaatgctagaaagtcttataatataaaacggaggaagtaatagatttagatttttggtgcagtgataaatgtcactggatttttccctaaaacattttgtgatcatttatgttgaatttgattgaaaaaagggatatccttgagagattaaaatcaattcctctatttaaggtgtcctagagctcaatgttcaaatcggagaagaaaatcagaaccatagaatatacctatttccctgacaagtttttaaaatttaagcgtaaagaatgagagtcaaacacaaataaaatgggctaacgaaatctcgcgcaggcactactattgccggccatagcgaaaaaaatatcacgcagggcggcattatcatgcatagcttaataagaaacgaaagaaaaaaacatatctgtacgaccatgtgattcctgtttttttttccctcatggcatatcttgatttggaattttgtcatagacttcagaaaaatgttttatcagtacagaatctggacgagttctcgtaaaactgaaatcaataccttagcaataagatttactactaactctgaccagtggtactaaataagataatcaatgccacttactgtagctataaaggagaaggtatgtaactgagtgcacccacaatagttatctataggctctttacaatagatccatgtcaacatattttcctacttggaagagattaaatgaagagagagagcaaagctatctactaacctggagaaagtctatagagaaaaacgaggcaatggattagagagctatagatacccatgtagacataccattgaagtggtttactattaatctagtctattactgagatgtaaatgttttatagatagcaacttactttaccattgcgggtgctctgaagccaaaaggtacttgtgccaacatgtttgtcttggataaactaaaatatgtccttcgaaaagaataaaacaaaacaatattaaaggtataagtacatcgtgtatgttttatatagtaaatctaaataagagctgttgttgaacgcgcaggtacacgaattagcgaaaaggaaatggagataatacgcatgggcggctctggcagatagatacagcagcaaggacaagaaaccaattcaagaagtgtcaaaagcaaagtgctgcgcctatgcgcgctatgagaggaaaaaaggccgggagcagagcactcctcgcctatataaagagaggctcaggcttcccatcccctcgcgcggctcagagcacacagctccaccaacctcacacggcctcaggcctcagcctccaaaggggagacaggagagaaagctaacgcttctctctctctctcggttaattgcctgtctgcgtgggagttacctccacacagcgccgtaaaagcttcgagcgaaaccccacgcacgtacgcaggcacgcacacgcgcgccggcgggcgggagaagaccagagtgttcttctgtttcagctatgacgacctgcgcggatgaccagacgggctgcgccttcttcgcccccttgctgtcctccaagggggcggaggtcgtcatcttggtggccggcgatgaggcggaggagcagcagccggcgccggtgctgacgagcaagccgccgggtcggctcgccaaggcggtgaacgaagcctggtccgtttctttgggcgtcgcgttcccggtgacgccgtccatgttcacctgctcggcacggggcgaggcgcggtccattcttggcctcgcattcccgatgatactgacgggtttgctgctctatctccggtcgatgatctcgatgctattccttggtcacctcggcgggctggccctcgccggcgggtccctcgccatcggattcgccaatattaccggctactctgtcctctccggcctcgccatgggcatggagccgatatgcggtcaggccttcggcgcgggcaattacgcgctcctgggcgtcaccatgcagcggacggtgctcctcctcatcgcggccgccatccccataggtggcctgtgggtgcagatgcggcctctcctcctcttctgtggccaggacgccgccatcgcggcggtcgccgagacctacattttcgcgtctctccctgacctcgtgctccaggcattcctccacccggtgaggatatacctcaggacgcaatccatcaacctgcccctcaccgtgtgcgccggcctggccattgccatccacctccccatcaactacgttctcgtagtcgtcctcggcctcggcgtaaaggcggtcgcattggcgtccgtgctggccaacttgaacctcgtgctcttcctcctcgcctacatcttcttgaaaggcgtccacaagcgcaccggcggtttccttctgtccgccgagagcttccgtggctggggcgagctcatcagcctcgcgctgccgagctgcgtgagcgtctgcctcgagtggtggtggtacgagatcatgatcctgctgtgcggcctgctgctgaacccgcaggcgacggtggcgtccatgggcatactgatccagaccacgtcgctcatatacatcttcccttcgtcgctcagcttcggcgtgtccacccgcgtgagcaacgagctaggcgcggggcagcccgaggaggcgagccgcgcagccacggtggggctcgtgctcggcttcgggttcggcgccttcgcctccgcgttcgcgttcctcgtgcgcaacgtgtgggcgagcatgttcacggccgacccggccatcgtcgcgctcaccgcgtccgtgctgcccatcctgggcttgtgcgagctcggcaactgcccgcagacgacggggtgcggggtgctgcgcggcagcgcgcggcccaaggacgccgcgagcatcaacctccgctccttctacctcgtcgggacgcccgtggcgctcgtcatggcattctggttccacttggacttcaggggcctctggttcggtctgctcgctgcgcaggccacctgcacggtgcgcatgctgctggtcatcggccggacggattgggcggccgaggccaagcggtccaagcagctcaccggagcgggcgccgccaacatggagagtgacgacagagttgccgcggacgagaagtcgcgcttacccgtcgatacggacgtggagcgatcgagcgatcacactgatcggtgttgaactgctgacagcaacagcgcgagccgcatgcgtattgtagtaatctagcctctctttttttctttttcttttttaccatttttatttcctccctctttccaaatttcggcgggggaggaatcagatgctgacagagcgacaattttgttctcggatgctaattagcaatgtaaagattatgctgattgtttattagtagcatagagttggagaatatgagataccaaggaaaaagattaattttgactcttttcacaatggaggagcaaactgttcacggcttcgctttctcttgctccgggtcggtgtctggtccagggaggccggccgcgtgacgactcggtcagcggcacgggccaaccagtggtagcaccgggtctcagctctaaagtcgcgtggcgcgtggctttggacaaaccgtcgggacccgccattttttagcctcgtagccgtcgggccgtcaagttgacactcgcggctttaacttctggtagccggtaccttttcggatacaactgtgctatggaaatcggactatcgcacgttcttgtaacaaagggccggctgacttgtaaagcacacctaattgctatcgattagaattctagaccatgattagctctggttttctttgcttttggggttaggacccgcatgcttgtgtattgagaaaattctgtaggataagcgtggaatagtccatcctataaattacaaaatgcaaacccatgtctcaaagagctgtaggataagcgtgaaatagtccatcctataaactacaaaatgcaaaacccatgtctcgaagagccctgctccggccggcatcgcgggcaagcgagccccacgttgaggcgtggttgggcttgagcgagcttcccgtgcgcgcggctcgcgcacaggcctggatccctgtgttctggctcagctcagcacccacgcgcgtgcgcgcgacggatggcgtttggcaccggcatcgccgcaccgcgcgttaaaaaacgacccgctcctccgctctcgctcgctcagccccaactcggccactcctttttttttttttggaaacctgccactccttggagttcctagaagatggcactgtttggaggcaccaaaaggcatcgtcaagctgtcaggcctgcttatatatgcactgctagtacggagtactataaactagtactcgtaataccgaacgtttggataaagtacagctcatcttcacaaagatgttggagttcggatcgaatgcccgagctgcacaatgcgctgcatagatcggagaccgaccgatgactagatgagcacctgttgtgccaacggataacatggttatgtgtctgttgtatgtgctccccgcccaatcacacctgctgctgacgtggaagggaatcgtactcatttggagtcaaaaccgttgtttacctccaccgatcgaagaatctgaggtggagtggcagcctggcttgctcaatcgaccaatgggactgtatacacgcttgaatgcttgatcctttgagagtcaatgattgttcccggtcgcttggattggatcattccaatttaaacaagttatgttccctggttcttgggcgagctcgagaggtgtctccaccgaagtagaaatcgcgtttactttcctacgcgatcagctcacggctcatcagtgatcgcaatacatgcatgatgcacacgtcccattgggctgagatcgcattttaattaggccccctttaaactgtgaccgatagtataggtcgcatggcaaaccgtttgaaagggcatgtacctattaaaggctaagttcctattaaaaaaagctacatatatccaaatggatatagaggccgggtaaaaaaatattcttctaaaaaaaagattcaaaacaaattttccaagagattaaaactcttgcttactttcctataaaatatctatagaattatccattccataggatttttaaaggaaatgatatgattcaatcatttgttttaaagggttttgtagaatttttcctatatgattgaaatcattcaaatttcctatgttttttcccttacaaatgagggttcttttgaaatacgagattgaaaaaaaggaggaattaaaataaagtaggattttgacatgaatataagtgtcaaacaaataattacaaaacatgcaaaaagtacaagaatgattgtttgagttgaccgaagaaaaaaatcacatgaagcggatgagagagagactcatagaaattttcaagagattgtgccctttgatcatatatactattcctatataattatctccattagctgttattctagctagccatatcatcttatttatttcagccattagatcactatcaaaatccaataaaaaatgttagatccccttttcctcttgtcctatgtcactgcatgtttgcatctgtttgaaacggtaagtaataagaacatccctaacttagaaactatcaactagtttctatagttgccatgtcatatagagactatgtataaaaactatatatcaatggacagtgtcttcaaattaaattctcatccaatcatctatcctctcttcttttatccacatatgccattgttttcattcttggttcttgtgtagagatgatttcttccatgagaaataatttattcatcattttacatctctcctcattaactctcttgccacgttagatttttgctcatgtgacaatttatttaatgctatagataccagatgatatggagggctgaggatggcctaaaaactaccatcaaagctctttttcgccaaattggccctaatcccattaattctctcataactatcctacaattaggataatcctcacacacaacggcatcctccttctcgagagctgatgtatgccatcatcccttcttaatcgatgctaattacatggtagtcatcgttcatttcctagagtactttagttttgccgattatctatagcatatatttgctttcatgaacaacacttgacagcaactcattgtacatatccactatacctgatatttgcaaggttaattatatcaatgacttttcggttagggatatgcttatgtgaaagtatgttcaaattttgattatttgaagtcgttctatattcatgtaacttttaagttaaactgagaaaacttctgcacattggattttttttaattttcccgcacataaatgtttatgtctagctacatacacatgtaaaagccaaacactttgtgacatactcctttcatcccataaaaaattaatctagtactagatgtgacatatcctagtcttacgaatctaaacatacctttatccagattcattgtgctagaatatgtcacatccagtattagattcgttttttttgggccggagggagtatgcattattttctttgaaattttcaaactagccattctcaaagagaacaatgatcatagtaataaaagaaacaattgtcatcgttctattcaacctccctattttacaccttcactaatgattcttatttttttagtgaaaatgttcgcaatgcgcgggggcataatctagtatgtacatgtttggccatcattatggtctttaaagaacactaatttctccaaattatctacacaatgctggattgaagtttactttttaaaaaatataattataggttatataaactctagtttctaattttctataaacataaatatgtttcgtacacactatattaatcaaactacattgttttaaatcaatacccaattaaaaaatacatctatttctcttttccttggtttaacatgggaatttttctagtcctagagcaaacactggttccttttatgcttctcctaataataagcaaattgccatgttttgcgatggataaaagaaaatatatcataatatgtcataaaaaatatagttttatcaaatatgttagcatcatgtgttttcttattcgaacattaagtattcacttgttttaaccaaatactggatcgctccataatattagaaaactatattcacgtcaatttgtataaactacaaaaaatctgccgccactagggcctcaaggagtttacaaataaaagctagataaaactataataaagttataaataaatgcatgaaaagttgtaatggcaatcgacactccaggcttatgcaaccacaattggattcccaccacaccaaacttgtagtttctgctaatatgttccacaatttgactctatataaacgaatttaagaaaaaaaaagatggaatacatttctatatcaatagacgttgttgtaaatgaacttattgttttttttaatgaaagctacatgtgaacttttccttttgaaatcgagatgacatgtttctaaaagagagatgacatgtttcctcaattaaggcacgtataatagcaattaatagcaggttcgtcttagggttgtcaatttgctgacacaaaagagaggggaacggaaagagaaatatcgatgttaagtttaccaatggcttaacattatcatatcttagcgtttataaaaaaatattactccatgggaatatgaaaaggaaaaaaaagtaataaaaattatctgatacattaattattatattctttaccgttgtaactgttgaaaaagatactagctagtctctaactgtgtgttggtcgtcattcctgtcttgctaaaattttctccatatgtactatttcatgtcttgacccaatctatatgctagcttatgaaccttctttaacaaccatattatagtcatcatgatttgttggtttattactgtataagcgacttacagacatggacgaaactcgcgatcgttgcttttcacacctcgtgtctatctcttaggaaattagttttttgcttctagttcaccgcaacctccgacgagttgctgcgtccatgtatatccatccattcgcaggtggagacatgcatgtcgacatctcttccgaatcatttaaagggaaatacaaatagaaaacacatgcctccgccgctaatcatataggagctgactatgcgtcctcgagataactcagcaccgttagtgcatgaatcctgacggaatggtaggtccgattttcctcatcaaatgcaggtcagcgtgtgatatatggcactatggagcacatgaacttaattatacgaattacgaccccctcctctgccgccgggttacgtccctgttgcgcgatttcaatttatttctctcgtacttggattgcgtgacttttcatgtacatgaacgggcggtcgaatgtccggcgccacggccggcctcgtaatttctgtcaatatcatggagctccatccaccgacttgtaaagcgacgccgatcgcaattgaccatcttccgtagatccactgcacggtaggatgcatgcataggcggcagagaccaagcaggagcagtcatagctagtttcagctgctcgtctcacataatttcaaccgaagaacacttgaagaaacagcttcctggtggaatgtcaagacaccgtgagcgtccccggccagtaggatcactcgcttccggcgaccggcttcagcttccgggacgtatcctccgaatacgacgccgcgagtctgcgacggaagatgaggcacgcatgccatgtgcgtggcagactggaacaagctaagtaaggcagatacactgatgcctaaaacacgaactgttatttattgtggtcaattcggccacggcaatctgggccggctggcgaccgatcgatagagtgagcgaacgccgattccagttacgtgcctaccttgccgcggccgtcatcgtcgcgttggtttcccctttgaacagggcaaagcagcggggaagggaaatcaagcacgtcgcctgcacctgcgggctgagagtgacggctcatgtggtcttttgcgcctgggagggagcgtgtctagtggcaggggagcacggggcaatccagcccaatcccatcgcatccatcccgggtgcacacggtgacacggctaggctaggcgcccgcggcgccgtgggtccagcggtcgctgccccgccagtagctagtggagtcgatagagggatcggatggctggttggctttgggctcgctgagcctcctcagcgagccccgcgcgcgcgtcgcaccggtggaaaagaaagtcgtgacggcgaccgcacgcgcgcgcgcgcgagggagacggggcgcagcgcgtggtcgtggttggtgcggtgcacgggagggacgcgtccgcgcgggcggcgggggcggcaggtgcgggtgggggcgcgcggtcatcagcggccgagccgcgggcgccgcagcgcgtggcggtcgtattccgcggcaaagctggactggtaaattggtcccttccgaggaaacattcagcgccgcctcgcccgctcgtagtagcttcgatttcgagcggagttggaagaatagctggaaccatctccaccttgcaaaatgccgaaccacatgattttcaccgtatgaaccagtcagcactcaaatctcgcagatatctaactccggacttgagcctgatcctaacgtaagacttgtcatgttgccatccgtttatctctgacaaagttagcgtttgtcactaatatctttctgattggtatgtcgtatgatgggtcgtttaatttttcgttccccaattgtctacccgttgtacgtacgtggctgactttgtactacaatatatcaaaagaattgctggcgtcgcataaccggatttatgccataatttaaggtttgaacccaggttttgtttacctcatttgccacgcctcgtcaactggcgacgggtacaggactacagcgcgaaaaaggaggtggggagatagcgttttctgttccctgattcctcatccatctgcagggcgcacgtttgccgggctgcagaatatcaatccctaggacaaaaagtacaacagaagttagacctgcaaagataagatattttatatacatataacaatgtatctagccactctacaatacgccaattagccgcctaaatttgtaatgtattacgacggataagcttatctttgtgaggaattatttggataatggttttttagtatagtagttcggataagctagtaaaactacatcggcaccttcatcctagtagtagattagaactgaggcctccattattactgcaatcgcggaatcagaatcttgatgaaagagagtaaagcaacaaaaagccatgctcaagaagatgatagatgtgttgactattgcttatgcgccccaacagtttataagtgcagattttagatgactggagcccgcaccaatttccatcctgatcggttttcttcactggcagttcatgttgatggtggagagtgctatagcagatagatatggtcttggtaatacacagtgatattgtttactggagtatatggtactctactgtcatccattgaggtggagcttggacaaaggtaaagagatactatcaccaatactcacattaattgttgagagcttggaatcaaagtaccactgatgcacttgcagagtattgaaacatatccaaagttgttcggtaaaggggccgttttccaaggactgccgattactttaaataatctcacaacatacccatttctctttataagaaaccatcactaccagcagaaacagagatatattaagataaatcacttcacttataaaccgtacatgtagcccttgctctagtctagatgctaaaaatatttatttggtactacatccgtcctaatataagtgcaattgtggttttcgtgtccaacgtatgactgtccgtcttatttgaaaaaattataaaaaaattaaaaaaaattagtcacacaaaacactattcatgttttatcatataataacaataaaaatactaatcataaatatttatcaaataagacggaatgtcacacgttggacacgaaaactcacaattacacttatattaggaaagaggtagcactttcatagtagtaagtggtaaaaggtatactactaattagtactcaaacaaaacatgcaaaccaaacaagccaaactggtggacgaaggccgtgtttagtttcaaagtttttctttaaactttcaattttttcatcacatcaaaactttcatacacacataaactttcaactttttcgtcacatcgatcgttccaatttaaccaaacttctaattttggcatgaactaaacacagctgaagaaagatgaaggtcttctttttttttttttacgttgcaaaatttgcaataagctactacaacagataatgaaaataagttccatttggacagaagaaaagaaacatgtttagaaattttaaaacaactgatcgtcagctcacatgtaaaaaaaagaagtctataatgaatttccaaaatgagcagcgatgttcctttgtctgctcaggagatcaattgtgtaccggatagctagccagtgacatagagccacctgatgtcttgctgagttcattcttgaattctttagatgctgacttctctacaaggtattttattatgagctgatctactttgccaatgtttattgaccaataataaatacccataaccagtcaatgtccattcatattatctaagaaaagtcaatatacatccacattattataggaaaatccagcgtgtacttcacgccgttgaccatttacatatataatgtccgattgagaaacatataaactgcaagtaagtcaaatagtaaattagaaatagttctgtggtctgattcctgaaagttgacaactccaatttcttattagttagttttggttgactaattgtatgaattataaaatgcaatcgtgtggcaaatggcatagttgtttcttttttcgctgttaaaacctctaggtgttctgccaccacttcaaagactgtcattcatgtaaaactttgctggccggtttgttagaaaaccaaaatttgtaatagttgacatgagtaatgctaattttcagaattttgcagtgttgaaataggtagacaccagtccgagaatctgtctatattaaaacaaaagaaggtcaacactctaaactagcccactatgacattccagcccacatgagtatacagcccagcacataccaacttagtacaaacttaaatttatccatggtccagattggaataagttcactttgactctattaaaagtgacccgaatctaatccgtgaccttaaaccgcaaaaccagatatcttaacctctaaactgttaaaaccagtgcaatttgactccctcggtagttttggatagcggttttgctgacgtggtgtctacgtggcattgttgacctggtccgccgttgacgtggtgcttaggtggcatgtggagttgtggacccattcgtcattcccacaaaataaaattttgtggggcccactgggggtctatcccttcctcctcccccgctctctctctccctcatcattgagccagggccagtgttggcggcggcagaggcggagtggcggcaataggtggagtggtggtggtggacgggcaaaggcgccggcgacgccgtgggaaaggagccagagctcgagggagtcgttggtgtccctctctctcccctttaccactctttctctctcccacttcggcggcagaggcggagtggcggtggcggacgtgagggtggaggcgccgacggcgccgggtgagaggaacaagagctcgagggagccatcgacgccccccttctctctcactctctctctctctctctctcttcggcagtggaggcagagtggtgacggcgaacgggagggtggaggcgccgacggtgctaggggagaggaacaagagctcgagggagccatcggcgtctctctctctctctctcttcctctttggcgccgggggcggagtggcgacggtagacgggagggtggaggtgccgacggcgcttggggagaggaacaagagctc

SEQ ID NO: 43879 - DNA, 9811 bp, Oryza sativa
ggtggaggcgccgacggtgccgggggagagctgtcctccatccgcatcgccgccgcgaggagctgcgacctcgtagtccaggcatcggcgtcggtgctgccatcctctcccgcatcagctccagcccactgctgccgccgccgccgccgctccagcccacgctcgccgccggccgaaggggagagagagagagagagagagagagaaagagagaagggaggaagaggggaggaagaagaaagagagaagatgacatgtggggcccacatgtcagtgggccgcacaattttttatgttgtgaatgacaaacgggtcccacatatatgttttttaattcaaatgcaatctaagcgccatgtgaaccccacatactagatcaacactgctacgtcaatgaaaccgccctccaaaacagtcaagggagtcatattgcaccagtttcaatagttcgggttcgagatatctgtttttgcgatttagggttatggattagattcgggtcacttcagggagtcaaagtggacttattccatccagatttgtaagaacgtgattgcccatggcttttcgcccctcttcatctactacttgttaagctactgaaaactgaatgaacatggcaaatcatgttctgagatagataataatgtaagtgaaattgtgctgttaaaatatttctgttctgtgcaatgtgacaagatttgtatgaacatgattgcccaggccttttcacccctttccatccactacttggtaagctactgaaaactgaatgaacattgcaattcatgttccgggatagataataatgcaagtgaaattgtgctgttaaaatatgtctattctgtgcaaagtgacaactaagttatacaggtgttaaatccagtttcactcaggtagacactagcgaattaagtacaagtgaacatctaaatatttctccctctacttagtataacacctgctaagctagctggctaagtgtgcggcagtgtgcggcggcagcaagggaaagcaacatgattgtttattgagattaacagtactctgcatgcataaattggagtggatgaaaacttttatctcgcattacttgcgtaacacaagcctgaatctaaaacgaatccacttcggatcgcttcagtctggatgcagaaaccaaaacacagaatagtaagtggatcgcttcagtctggatgcagaaaccaaaacacagaatagttatagaaaccgtagcctcgtggttctgaagccagaaacaacggactttcagtcttgcgattgcattcagatgcacgccaatgaaatctatatgaagtgaactacattaattcagatcagaacggggacacgaaccttcgggctagtgaacatcaagcgaactgcgttgattcagatcagaatagggcacatgaacctttgaaacttcgtgatcggttctgaacccttcgtcccggaagcagctcgtgttcacaaaaggggtttttcccccgagatcggaagtactactgtgtcatgcaatcgtgggtgatccgctcgtcggccacacttcggccgaatcaagttgggccgtaggcatgaaagtgtagagacactttcgagttgggacggattagccggccggggtctaggtggttatcgagttgggcttgattagcccaccgtggggacgaatttttttcgtttttagatttttttttaatatttacagaaataatctatcgaccaaaaaaattacagaaatagcccctgccgccctaatggtgggcggcaagctgacgtggcagacggtgggtcgaccgcgccgtctgccgccgtcggccaaaattgcgattaggcccttgccgcccatacagagggtggcaaggggctaattgcaattttagccgcccataaagagcttgcggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacgactatttgcattgcggttacatagatgatattagattcgaattaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggataaacaaagaaccttcgacctaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagcacctaaaaaagcgccttcctcgaatattaggattcctcgaagccattagttggcatcgatcaccgcataggtagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatatgactgagttctgaaatattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcgtatgcgccaaatagcggtcacatataggatctatgaatattacctgaaattggcgtctgaatccggcagggcttcgccccttcttctcttctcctcccctctcttcttttttttttcactggaattgaggagagaagaatgagggctgggggctgggcagcaggccttttataggcagcgaggcctgccgcccggccagagggcggcaaggggccgcctgcaaaatacccggccccgactggcttttttgcattcgggccccttgccgccccaccagagggcggcaagggttttctgcaaaaaactctccctccgtcaccgcccgttcctcccctgtttgccacgtcagcttgccgctccagaggtgggcgacagggtctatttttgtaatttttttggccgatagattatttctgtaaatatttttttaataaaatctaaaaccgaaaaaaattcccgtggagacgatggttttgaccgaggcgtctgtgcttctgtggaggtagcaggtgggctgatgtcgtaggttcacgtgggcgcggggtgtccgcgtaatgtgccgtgcgtcgcgccgtcgctcgattcgcttgggctgctgtgctctgagtgctcccgcttgggcagggccgcggccatcggcaaaagtctactactaactacaccgtacaggcagcggaatgatttaagggataagggagggacctaagtgaaaaaaggcggcagtagcggtgaaaaaatggcgaccaaagtgcacgcccgccgcctctagcgccgaccgcctcccgttccccttccccactccgtcccggcagctacctccgctttccaccacgccggccgatccgcctccccaaccctatcgccggcaggcgcgccacgccaggttccgggctcggagacaccgcacgctccgcccgatgggcacccccgggccggagctcgccgctctcgcgattcgccgcagcggcggccgcctgttcgagcggtagggagggactcgtctccccgcctctccttgtcgtggactcgtggtagcgggggtgggaggagccagagaggctgggggcagggagggaggatgctggggtcgggcctgaatctcgtcagcgcggcgctcggcttcggcatgaccgccgcctttgtcgcgttcgtctgcgcgcggttcgtctgctgccgcgcccgccgcgcggacgctagcgcgtcacggccacacccctcgccggtggacttcgacgcggacttcccctcggatttcgatcgcccggtatgtggcaccttgttctccctcaataatagtcttccgctgcgattttagtccacaaactggagtagtaatttgctcgtgttaacggtatcactgctacctgcagtggcatggcacgtgcacaaaacgactggagtatatctgttttcattttctgtgttcatggacagtacttttctactttcaagcagaaatacttgtcatgtgtcatgctcaatttatgatggccttactgtgtagtaaatcaaatggggaataagtacaggcactagtagtacactagcctgctttaccttgggcgtgcaatgttgttaaagtggctttggattgcttactggggttccttaagagattcattaagaatttgagatgttaccgtctaatctttttaatcattttaatattgtttatggttttatgttccctgtacaaataacaattttatttaagcgactaaaggaggaaggcacatcaacacatgtatgctagacttgtttctgaatttctcttctttgttggtttaaattgggttattctctcttttaaaatgaaaaatgtgttagtcttttggatcatttcctatatatacaaaataagctgaaaaatatcaattcaataataatagtataatgtattttcactgaagttcgtatagcgccaactgcacaaagcatctttctttcagagttagtggtcttgtagtagttcctcttagctagtactactacatataaaacagtgcattgaatctatagtactatgttgagcgtttgagctcatatggaaattattagtgaatagatcaactgaatcaatagtcaacacgccctataaattcattttggacttgaaagtaaatgcaagatttttttttattgttcagatagagcattcccgcagtgggttggaaccattggctgttgctgcaattcctacaatgaagtataactgtgaagctttccattcggaagatgacacccagtaagtacaatcgtcaccatctgaagtaaatattattgaacttctttatagtgtggttcaatgcatataatctgcttctaacatgctattgttagaaaaactatggttattgaaaaatattagcacaatgagttaaaaggtttgttagactttgtggaattcatatccttgtggaaatgttggaatttagatgtgcttaatcgaagcatatttaatcaatatgtacaatgggtagagatattatagattatcaatcatacttcttgttgatgagataacataggacaacacacctgtagcttttatcagtttttttgcagtaccttgggccttcgccaccagtccagatttaataggaaccaatttggcagagttgagtcttatctcattacgttgtcaacctgggttcagtttagtcttacttcaagtaaactttctatcattatcatctctgcttgcagccatacctcttaaatttatgatgcatccataattttttttttttgtaatatataggatgttttgttgtaacaggtgctccatatgtttaagtgaatacaaggagaaggacattctaagaattgtacctatttgtcatcataactttcacctttactgcttagatgcatggttgctgaagcagactacttgcccaatatgccggatctcattgaaagaactgcctgatggaaaatcgaccgtatcctctgctcctaccatgtctcaaccccccaccctccctgagagttctgttaatccaacatctcatttcctcccagttcatcaagaacacagaagccaccaggatggcccagatatgccagaatctgtagaggtggttattgaaatccgacagtgactacggcggaatagtgcaagacaagaatttgcagtttaaattctttgtacgcccttcattgcattgtttgtcgcagtttcaaaatgtttgaagtcaaaattatatgtggtccctttgcaagttgtagactagagaagtcagtcatacaatccacattatcatatgttctttttaatatatgttgtatattgcaagctaagtaaaaataccgataagatctactgatataggagtagagcttatttactgttgagtccctaatttttttatgagtgaatttcagcagggacacctcttaccaaagttttactttcgactatttagggtcactttgaatcgccggattgagaaaagtaggaataggaaaaaagtaggattttgataggaatgtaagtgtaaaacagaggattgcaaaacgtaggaaaaacacaggaatgaccgtttgattgaaccgcagaaaaaatgcaggaattggatgagagaaatagactcaaaggaaagttaccaagagattgaaactcttgttaaatttccttcaaaatctctaaaggatgtccattccataggaatttcaaaagattggatatgattcaatcctttgttttaaagggctttatgggaaatatttctataggattaaaatcctctaaaatttcaatgtttttaggctgtgggatcagctgaccagatagctttttcgcaaacatgtttgcgagtctccatttttaaatgtaaatttattaaaaattatgaaaatgacccactaaaatatggataatggtatttgatcttatagaaaaaatttattgctctgccacttacgatctacatccaggttatactcctcatatttccgccaatgcatatatatcctctagctacctggatacagagatggcaatgggtctccgttcaccgtttccccacggtgaattcatctattaggtggcggggatggttaatatttatccttcatagggaatgaaatggtttcatacttatcaccatcggggatgacggggacgggacgacgcaccattcccccgtccccgtcccccgtggtgacctgactttgttgtagagaggaccaattctaaactttttagacgttctggcccataatattgaagcccaaataacatgtatatataaaaactaaccctagtcaaccagtcaaaactccaaatcctccactccttcagatcgagcactcggcagcggcggctccgttgcacgtgtgcaacgctactccgccagcggccagccaccaggtgcgccgccgctctagacggccaagccgtggacgcgccgccccagctgtcgtcgtcgcgtcccagttgttgacgtgccgccgggagccacggtagttgcgccgcccggtgcctgcagccgtcgacgcgggcgcgacgcttgccgtcctccgtccgctgccagcgccatgccgccctctgtcgccactcgctagcacgccgtccgccgccaacggcctccgtcgctgaagaaatcaactactgaagtgatgatttgtgttgagttgatttgttttgtttaaccggggacggggtaaccacggggataaattcaccgagtggtgatcggggctggagaaaatgtagccctgttgtggttgacgggggcggggacggtgaaattttatcactatgaggacggggacgcggatgtgacccctaacggtgaattccccgttgccatatctacctggatatagcagcggtgttaaagtagtagtaaaatgtatccaaacaaaactaaaaaggtcaagcataaagtgctcctcctgtgatcctgtctccaccggtgcatctatatccgtatttctccttatcaggtatcagaacaactttgaaaagaaagggtgcatccaactttgaaccaacttttattaccaaagtttcagtttaggcatcatttattcaccctttttattctaaactactacctccggcccaaaataagtgtagccgtggatattcgtgtccaacatttgaccattcgtcttatttgaaaattttattaaaaaaattagtcatacagaaaagtactattcatgttttatcatctaataacaacaaaaatactaataataaaaaattctaaataagacgaacggtcaaacgttaaacatgaataatgtaaaactacacttattttggaacggagggagtagctaattttatattgtatcactttgaaccacctcaactttcttatccatccacatctagctcattttctatcaagatatgaactatagacagttttagggcccctttgaatcaaaacatttagagaggaatttcatagggttgaaatcctatagggaatttttctatttggctctttgatttaaagaattgaattttccaaattctatacaattcctatgaaatgactcattgcatgtaagttttggaggaaatttagcaagaggtccaacctattggaaaaaaaaaatcctttgagtatatctctctcatctgattcctgtgtttttcctgcgactcagtcaaacgattatttctatgtttttcctgtgttttgcaatcatctgtttcacacttacattactgtcaaaatcatgtgtttttcttattcctccatttttgttttcattcctactattcaaaggacccttaggagtttattgtcgtgcaaaagccgatgtaattgaaattaccgagttaggccctgtttgattcagcttaggattatgataatctggattattaggagtaagctgaaacaaatagatagcgtattatgatagattattataatctataagccagattactataatctggtaatccactctaaaagtgctttttctactccctccatcccataatataagggattctgagtttttgtttgcactgtttgaccactcgtcttattcaaaaaattttagaattattatttatttttttgacttactttattattcaaagtactttaacacaacttgtcgttttttatatttgcataaattttttaaataagacgagtggtcaaagagtgcaagcaaaaactcaaaatcccttatattatgagacggagggagtagattattgggtgtaacagctaataatccagagaatcaaatagctaacagcttattatatatcggcttattataatccagatatagtaatctgatttaataatttaaattataataattttaagttgaaacaaacggggctttaaaatcaaggtgatgtaaagtgtaacgaagataaactaaacgatacttcattaataaaggacggatttacttgaaaataaactgtatccaaatcttccaacctttttttttgggatccaaacctc

SEQ ID NO: 43880 - DNA, 1407 bp, Oryza sativa
cagataaacccaacaacgcggtccgtcgctttcgccgctttttcaccgtaaggcatccgggggcgcccctgatggtggaggagggggtgggggcttcacatggcagatgccagaggccgcctgatccgcacgcggtcgtcgctctcgaagcacctatcggatttgacacgaatcaaagactggttgctggttgcttccgttttgcttgcatggggctgagctgctgaaacgggagtacgacaagaagaatatatacagtaaagtatagtatgatttttcacgactctcttgtttgattctccggtcaattatcaatcaaatagttatatacttttatggggattactgccaaattaaatcaacatttccaaaatttagcaataccaaatttttggtaagtggacagaattaccaaattttggtagaatgaaataaatatgttatgccaaaattttctatgcattactaatatttggtaacaaactaaatgcagctatatatttatcgattttaccaaacaatgataaagtatggtttaaaataacatcaatcttaataggccctatctctactattataaaaattaaatatgtttgccggtactttggtacattatccgtttatgagtcggattttaagtacgttcgttttttaaaatacatgtgcatatttaagtcggtttttaagttcgttcgttttttaaaataaagaagaaatcttataaggaatctcttttaaaaaaaaccctcatgctaatttgagacgatcagactcccaggcgcagctcatgatttttttttaaaaaaatacatccaaacgaattgacacagtgaatttcaccttaggtaaaccatataacaataataatattaaaataaccttcacccgttgcaacacacgtgtattttttctagtataaaagaaaaacgttgataacactgataaacaggaagtctaccatcttgtaaaatcctatatccaaagtcgattcacataggaaaaacaaaaacttcagtcatgagtacactaacaccattgtatccaaacttctggttttttaagttagtgaatcagtgggattacttatagatcgaacactaggtgataaaatatttgtaaagattgatttaggccttgtttagttccaaaagttttttccaaaaatatcacatcgaatttttgaacacatacatggagcattaaatatagataaaataaaaaactaattacacagtttgcatggaaatcgcgagacgaatcttttgagcctaattagttcatgattagctataagtgttacagtaactcacacgtggtaatgatagattaattaggcttaataaatttgtctcgcggtttccaagtgagttatgaaattagttttttcattcgtgtccgaaaacctct

SEQ ID NO: 43881 - DNA, 1518 bp, Oryza sativa
  unsure (1)..(1518): unsure at all n locations
agtatataactatttgattgataattgaccggagaataaacaagagagtcgtgaaaaatcatactatactttactgtatatattcttcttgtcgtactcccgtttcagcagctcagccccatgcaagcaaaacggaagcaaccagcaaccagtctttgattcgtgtcaaatccgataggtgcttcgagagcgacgaccgcgtgcggatcaggcggcctctggcatctgccatgtgaagcccccaccccctcctccaccatcaggggcgcccccggatgccttacggtgaaaaagcggcgaaagcgacggaccgcgttgttgggtttatctgcnnnnnnnnnnnnnnnnnnnnnnnntccggctaaagcgtgattcccctagcgttgtcagcggcgcggcggttggttacacggttacaactggctttgagccgtcgccaagtgtaataggcagggcagattattagtgatggcatgtgacggagcgtggggctcctcaccaggagaccgcgcaagcccccttttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctacaaagagctggagagccagagagctcttattctaaaaaccctcttctccttttttttttctcgtgggatctcctctccagatcatccccccttccagtctcctctcttaagtgggcaaggtcctccttttatatctcaaggggataccacatgcaccacttctccctctctctctttttgggtggaggcccatcctatctatagtaaaacttggcttgccttctcttggaagctgaaacactgcctgtttttgagtgtggccacgcgtcctcgttcgtctgacctcggggatcaccctgtcatctcttcataaatgggcggagatttgcaacggctgctgcccgagtgacccttctgatgggacggcccatacctacctccactccgccggaagcaggtgcaacgtgggaacacggttgtcttctggcgacataaccagtgtcagaccagtcacagaccggtcacctttgtccaccacgtgtcagtttagcaatctgcatgttcgcccttcttcatacaacgtcttgtttataatggttgggataaagcctggcatatatctgaccaggaccaacgtgccatctccaggagctagcacgctggctctggctccggctagggacgagtgcctagagactctcatcctgacgggacggggcgaggcgtgtgtcagatcgcctgttgcctcctaacccgcaatctgaccgatctgtgaccggtcacagaccggataaacgagcgtgccatactgcgctacatgtggcgtgacgcgctcgtccaaaccgcaataaatgtggttaggtgagccccgctatgctcacctacccca

SEQ ID NO: 43882 - DNA, 1987 bp, Oryza sativa
tggaaaaaaatattttcgcttttattttcgaaagtatacttatctaagcacgtaaccatgaaagattataatttagatttttttatatgaatattttagctttttaatattacggtcaagattattcttctacttctttaaatatgaattcaatctaacttttgaattaaaaattaatacttttgcgtcgaagctaaagcagaaattttagcaccgaatggatggtacacctcacatccactgaccacacagattattgtttaattgttaacgccattattcggtcctatccttttccgtttacgcttttgcaaattgcactagaatacgacatgctctgtactttgtgcttctggtggtactacagtatatatactggtactccgaagcctctgagagtcaacttgcccaagatattacttatttaatgcgctaattgtacaattttctcacgcaatcatgtatttctctgcgcattatacgcaccgttcggctatcaacgtcgcgttttcctacttcatttcgtaggccactaatacactaccaccccaaaggttagtagctcatgcgcaaggcccaatgcgtagataaggaagtttgatagcaatgtgtcaccaacattttatcaccctgtggctaatacgccaacgaatcgtgtgcagctttgcgcctgacgcctgacaaggtgcatggcttagatcgctcgatcaaaagcagtagtattactattgcacaatacagagagacactcgtacggggtgaagcaagtatatgcgtatttttctttttctttttttttaaaaaaaagaagtagagattgcttcgcaaattgcatggtgtatgggtcaacggaaatcacttcagattgaagacaaatggaatgccgcagtaaaaaaggcttacttcgaatgttggatagactttgctggaacgttggcgacgcgatcgagtcgtctacgtcgtcgtactcgctgttgccgttgccgtcttcgacctcaccgtcgtcgtcttcttcatcctggctgaggaagtccatgacagaaactgggctccgccgctgcccctgttcgagctcttcgtccaagtggcacgtcgcctcgcaatccattttactcgcaacctgtttctatcaatcacaaaaatggagtttgcgatcaatcaagaagtagctaaaagcctaaaaccgagtaagatcaagagcacaaaaagaaaaggcgcaatcctttatgaagcaatcgattgccaagagagcagagagcgcacctgagtttcatggctctgacggccggcgacgccacctgcgtggcgaccctcccagctcctcctcctaggcgacattgccggcgacgagccatcatcccttccgctaacggcagccgcagagcagctatccaccctactgttcacctcatccccctcccctctccgcttcctccagaacccgcgccccagcctcctcgagaagctcttggacagcgcggcctctcctccctcccgcgctgacgacgacggccggatcaacagagcggccctcaccgcggccgacaccctctcgatcacggcgccgttcctccgcctgccgctccctcctcctcctccccggagctccgcggcgagctgccgccgcgggtagcacccgaagccgtcgcgggagagctccgcgctggactccagctccagccactccttgagcatcagcagcggccttgccctcccctccagctccatggacgcagctgcggtcttgcactctcttgtgcgccggggaagcagaggaggagacgcgagccgcgcgtgcacagctagtgtaagggattggcttggggtggtacgtgcgtttttagtctggaagctgcaactctgagtcgagtcagaggcgcagagggtgagagggatgtctggacattgcaggccgcggttaattaagcatgggaaagggcgaggatttgggagggtttgcagatcaaacagcgcccacatcggatgc

SEQ ID NO: 43883 - DNA, 20244 bp, Oryza sativa
aatgaccgtccaaattaagcaggctagtatacctgaatgcatctgactgtcggtcatggtataatactgccatttcttattgtcggtagtagtctaagtttgttttgaacattctcaaattttagaaaccaaatttgagtactggagcatataaatgcataacaagagaaaacatgtagtaatagcttgcgtgaaacgatgggaacaaaaggcaactggccaaggcctacttctttttttcccaaatgcaattttcgaagttttgtatggagagattaagggtttgttcattaaaaaaacttaccgtaataccaaattttagtgaggtaatgtaaaagttgggtggtatatggtttaatatatttccaatattaatagaaatttcgtgagtggaaagtttcactaaatttttactcacaaaattttggtacgattgttttggtaatagtatgtttagcttgttacgttgccaaatgtcggtgatatcaaatttaagaagggttgaaaataacaagagtaagcccttaaaaagataggttggttgaacaagaaatgattgtaattggctgagacgagaaaataggtaacgaaattaaatggatgatgagtaggaaaagaagttatttttcttgacaaattttaaatactaatttggatagtgaggaggggagggagtagcaaacaaaggacctgctatactaatatgagatgtccaagaaaacataagaagttttacatggcataactataaaaaaacataagaaaataaatggaagattattgtaattcgttgagatgagaaagcatgtggagaaattaaattattgttattatcattaattgaaaagtgggaggatatccatatattttaggacaaaattaaatggttaaagtgctatattttagaacaaatagtagaaattaccatgttgataaaaaaatagatagttaaaaaatataactgtataaaaaacataagtaaaaaagttgtatatgtttttcccatcatgctttttgaagtccattgtacactgtcgtgtatttggggacaaaacacaaaatgcaagtaaagaacataaaatagtatttacatatcaaattcaattatactttagaatctattttatatgaaatgcaattacatctatgaaacacatgagctaagaactgtatgtcaaattcaattattcttaaatctaattttgtgcaaaattgcgcgaaaaatccaatagttagtttatgtcgtacaacgaatcatcagtttgctcggagtaatcatccccttggaagccggatttgaattcgcggtggcaaagctcaaccatctccttatcggacgcaaaggcgccgtgcgcgcgagtggagctgcatgccgggggcagagccgattcatgtgccggccaaatagttttagcgcgcgtcgcggcgatcggggggcaccgccttgttcaaaaccggtggactcgccctgcgccgtggccggccacgcttgggcgcgccgcgcgcggggtggtcgcgtcgcgtcgcgtgcgagtgaagccgcgcgcggccgcgcgggcatggagatccgcgatctcgccaaggaggggaccgaagcgaaacgtacgaagcggtggtgcgtgcgtgcgcggagtcctccagcctgcaggccggggtttgcgggcgtgcggatgcatcaccgcgcacgctgtgggggtgtagggtgttggccacacgcacacggcgacgaggcgccgttttggctcggttcggtgcgctgctggatcgcgagaattacataattgggcaggcggccgtagtgctttattggattcccgggggcaatcagggtttaggcgtttagtatgggttgcttgctgtggttagcgtgcttgggcttttgtacagcttgtatcattattctacgtaccgaatacgggacggcgacaaggtccgttgcaaagatttggtagcaggtggtgtacaatagcatgttacattatcttgcgaatttgcgatcgattggttgccctttcgaacgtatttgttgataacagaatacaggcggcgtagccttagttttcaattgtttgtttgttggcttacaacccacagttaaagttcaaatatttaaacttaaattttaagttgaattatgagatttttttatcgtaatttatattctagtcatgcattaacttatatactattaatgatatttttttcttcgacttatgaatattagcccaccaatcttttatctttatatttaatgaatatcggcacttaggcgcgcccattttattgaatggagcataagaaaaaaaaactatatgagagcaatttatggggaaaagaaaaaggaaactaaggtatgatctatgcaagatgtttcgttcttgccagtgcctatgttttggtctcctcttttattttcttttattttcaccgtaagagatagagtcgtaagttatgtgtgttcgaacgttaatttctctcctttcatatctcccagacctcccatgttgatattagcccacatcgatcgtgtccttattttcagtcaagaaaaaaaatgacaggggtctaattttggcaaaatatccaaggggctgagaatggcatgttctgttattattctatttttttcatcgaaaaggaggagcaactggccaaatctacatggttggattcgttcattagcaattcagtggtgctagtcagttaagtaaatgttgaatatataaacatatattgatttaatttagtctaaataaaacatagcattgcacatatctatacctaattaaaaataaggcttccggtattattttagtctatccgtctttttttattgtcaccgtttttcattttttttccattccactttttttacgtcacggttttttcgcacgcggtaagaattcagtttttttatccacctgttttttcgtcaccaggctgaaccctagcgccaccgccacgtttatgcacgctggcgagcgggacgaaatagactattagcgacgacgcagtacatagaaagaggcaaaccctaaattgatttcgtgtgtattgcgagaaggaggctgctcgatttatatagagatattagtacatgtgatcaggatgcctgcacgatcttcatgtcgcgtaaccgaaccggataagtcatgcataacttatccggactccacgccgctccacgcacgatctccacactgcgtaaccgaaccagataagtcgcacggaacttatccagactccacgcacagattattcggtgtgtttccaaaaacaaagccgaattttgcaacaaaataaaactgcaaaaagaagccacatctgcgcaagggtggggaaccaattttggcagaatattcacgcgcatgtcgcatacgcgtcgcttggcctggcggaacgagcgagcacatgcgtgtttctcttgttttctccaccacacatatctcaagtggttaagaaagtatcatttcttataggggtctccctctcttaagagattttatgattttaaaaaattaaacttcaaataggttaagatccatctatccaacagtaaaaatactctagaacgggtggtgaatggacagatcacgcatgggcaaatgcatgtagccatttacttttgggtaatttgaaaccatgccattataattttgtaaagtttaagatataccatcggtatctcaatgacatgtaggacccacatgagtcaatgacatgtgggtcaggatgccatatcttaaattttgcaaaattataatggcatggtttcaattttccctccatcattattttctcaagtttaaagtgacatggagagtcgacacgctgaagtccttttctgctgtggttgctctgcatctgatctctgagatttggggtctgttcactttgatattattttcaaccttaccaaattttggtaaagttgccaaaaaaaatgactacatttagtttgctgtcaaaatttggtaactatataagaaatcctgctaaaattttagcaagctgccaaaattttggcaactatactaaaattttggtaatgccaaaatttgataaggttttttttggcataaaagtaaacaggcccttggactgggatgccgtccagaaacttccccaacagttcaagagctcgtcactatgatagcttgattttgattgtgatcaatcaaattcaaatcaggaagagtatattgtagtacgagcgtagagtggcggaggatggaaaaaaaataaggtgtggcagcaacaacacagtacaaacaatgtcatactactaatcaaaactgtatagatttgcaatgcgctgatctagggtattgtgcacattagttgaatgctactcctacattgtaattccatcatttagttgctgaaatatagagtatctacgtgacaataaatagacacgggccaggatgtctaataagagcacccgcaatagtaaagtaaggtgctctctataaaacatatacaactcagcaatagactagattaatagtaaaccacctcaatagtatgtctacaggggtatctatagctctctaatacattgcctcgtttttctctatagactatctccaggttagtagatagctttgctctctctcttcatttaatatcttcgaagtagaaaaatatactgacatagatctcttgtagagagtctatagataaccattgtgggtgtcctaaaagatactatttaatagtaggtgcatcggtaaaaacacagtgattagtatattcattagtgattagacgttaattgtacatatgctcactgacaaaatctaaccataccggaagctccgccgcttagtagaattctgaaattgtccagtaaaaggtaccagtcctgggtccaataacgataagtcgatacaatacgacgatgcctagtgctcccgaaatcataattagatgcaacctggtagctttgctttttaaaattcaacaattagctcaaaacaaattccaggaccatcggacaaacaacaaaatccaccataggtccatagtcgtactagtaaagattctggagcagtgacatcacaaccaaatgctgggatagcgatcttttcctctccccttcctgcttccgcgtttatctggaaatgagaccatttgtagcctgtaccgtgacaattccagatggaattagctgatcgaccatatatccacttcattagctccctcgagggtcataaccacgtacaaggtcaaatatgcagcaaacttagctgcttattagacaagcctgggaggtgaggcttgttactacagaaactaaagggatcatccgcagcaagtgctatttctggcgccaataaaatttttggcccccattgccagtgtcgcacgagcatggagccccccctaccaacctaaaggacactcctctgctccttctgatcgcattccattttcgtcagaatagcagggaaacggcacaccataagtacggttcgtacttgattatataccataataagctgtacattgagtcctcctgctcatcagggctggttcggttcaggtgcacgggcgatcatcagtagctccatagattgacctcgcagtcgtagtcctcctcggcccacgtcgattgccctgccaatggcggcggctcgatgagcattccctgtgccatgtcgaggtacccctgcatttcgaattccagtccgtccatcgggtagcaagggaagtcggcaaagagctccgcgctcgccgcggttgcctgcgcagcgacagcggccgccgcctcggcagccgcattgtgctgcccgggcgccgggcggaacagctcggcggcctcgaccgcggcgcggcgtatctcctcgtgcccggcccccagcggcggcacgcggagcctgcgcggcgagtcggcgaagttgaggcaggcggcgcggccgcgcagcgccatcgccgcgacgtcgtgcgcgcgcgccgccatctcggcggtctcgaaggtgccgagccagatcctctgcttgccgtgcggctcgcgcacctcgcagacccacctcccggggttcctgctgcgcacgcccttgtacaccgggtgcctcgtctccttgaacttggtcctccccgcccgccgcttgggcggcgccgacgacaccgtcatgtacgagtcctcgtccccgtcgccgcccaccggcgacggcgtccccgacgaggagtacccactgccgtagtacgcccactccatcgatggatcagttcactcgacaaggatttgaaattatccgatttggtcttgatttgggaggaaaggaaaacggaccggggcggcggctttatatagttatgcacttgacgggtgggggatgctgcgagcgcgagagcgtgcgcgtccactgctgctacgcggggtggcacagtaggtgccagccagattgaagggcgatgggcgggagccgggtccgcgcgcgggagggggggtttgggctctcgctctgcggttggttgggtgagtgggttcggttggctgtcggaccagctggaggttgctcggacgcgatggggacgcgcgcgacgcgcaggcatggggcgctctttccctctcctgcggggagcggactctgcacggtgggcttgggctcgtgcttctctgatgcggagtttactgggggttgttactctggttttggccgtttggggctttgtggtgacggggacgtaagctgaaagaagccggatcgagagggatcgtgattcattgctcggttgatgcggacgcgtgtgagttggagagcgcgtgattcgttgtcggagccgtggtttatggatggatggggttgcacttgtggggttgatgacgatgctgatgccttccatcgttccctttaatgcacagggaaacatacatacgagcttcatgtgcacactccgtacacaccaattagtaaatgtcacaaaaaatctataaaaattagacatttactcgtaatagtattacatatatatgaaaagtctcgtattcaaatttattgtattttaaccgtaaaaaaaatcagacagttttaagggtaaaaatttgtcaaaaaattgtcttttttattacagctaaaatatattgaagataagatttcacacgtatgtgtaatactattaaaaatatgtctctaattttttctaaaattttctgtgatatttgctagctggtatatacgggaaacttatgtgtatagaatatattcccaatgcacatatgctcatctgaacgtggtaagcttatgtttattttcacgcacaagttcatcctaatacaacacaggaaaccccatgtaggcgtaaatgacttgcacataaagaaagacaactctcacagtttggcgaactagcatatactactaatcggtagaattaaagtttaaatgcacatatcatataataatattttttttgctaatatgaaattttaacaattattaaagacaaataaaaatgcaccgtgacgtttagcacgcgcatactactagtactactaatcgttagaattctgatgcatgtttcatcactccacagtttcaaaggacgctttgatacagaaaaggtacaaagagcagcatgcactaatcgaattctgatgcaatgtttcatcgctccactgtttcaaggacgcttgatacagagagggtacaaagagcgtcatgcgctttgttgctcgagccgtataacaacgggccccactttagtactcctactatggtggacttggtcagctggtctgatgcgccacctgccaatcgacggataccgactgggatacggctgcattatctagcagccagtcctttttgccgctaaggggaatagaccgttggtttggcagttagtacttcgcatctcgcaagctggtttctcgcggtattctggatgggctcttgccgtattctggacgggctcgcggtattctggtctggatgggttgcgcgcatgcgcgctgcgtcgctgccaatggatgggacccgtccgtataaaacgcagcgtttgccaccattgttgctggcatatcttcgatttggactttttaagtccaagaggattttctccacgagaactgaaggctgaccagctgaaaaacagagaatactcctacttggctactacactcctataggtcaaaactacccgtgcttgaaattctagaagccctttgtagaattctaagcttctactaacttctagtagatgattgacatagaaatgtttccagtactagatgattgacatagaaatgtcaagctctcactttctaacagtgtcctgactctgcagctgcttcaatgctgtcatttagctataacaacaaatgttactggtactcttatagcatttagtaccacttatatgcatgtcagtacgctacatcaggatgttcttcttgatgggtcatatttttttaccggttttttatacatgaaaaggaaactttgcatggacaatcttttttggttggaacattttttttatacatgaaaaggaaacttcttaagggattggaaggggaggaagaagaacagccatgattctatagtagtctgaggatcaacaaaattatactcatatcctctacgttttgcagttcatagaagttcctaagtactctattcgtatgaggaagcatcaatacgtaggatctggagaatgtgttatcccctccgatttttaatatatggcacctttacctttttatatatatatttgactatttatcttattaaaaacaacatgattgtcatttattttgttgtgcaattagatagataagagatggggaattttcgaactgtgttgaaccttatttcttgccaacaactcataaatggagccagtaacgccattgaatctgcatggcaaatgatatttctcgttcatcactaatactaatttcacaaatattttcactaatcaacaatgggtatgaaactggtggagctagggcggccgccttaccaggccggaatctagtttcgccgctgactcatctcccacggctaggcctagacccttgcctcctgcccttctccaaaaaaaaaagttatctcatgcacatgagtatattatattaagaggtatttttaaaagtttgtaaagaaaaaaatataaggtcaattttttaatggaaaactcattgaacgaagagggagaaaaatattatccaacaaaaaacaagtgagctatatcaacatattgatatttggatgttgggttatgtataaccatataaagtgtgaggctctagctaactttgtcctataaatatatgtggagatctgatagaataataataactaagggattttactctatgcactccagaaaaagaaaacaaaagctcccatacacgaactcgtggattgtatacgtgacaaagcttgtatatggtgtgaggcactaggtcgacccattgtatggtgggccacatcagaggttacatggtaatctcagtgtgtaaatacttttcatgtacctttagtctcaggtttgttggggtcatgaatccgctagtgattgtacacagcataacaaaggtatgcacaattatgtctacaaggaactaatacaaatactacatctacatgctttttttctttaaaacaatagttgacatagaattcattgtacaaatagtactagaatgtcatagggctcatccttagtattttgtaagatctagtgcatgtcatcggatggaatctactgacagtgcgtggaccaagagacaacatcaaaagaaacttggttggaatatattacataaagcagttcaattattataggagttttttttttctttccgataaggacatacacgaacacatgcacaacactgctacacatacaacactatattgaagcacccacaaatacactcttaaccgtagtaaaaagacaaaaataagtggcacatctatgatttcactatttacgagttttgggagccctcacaatagtgctaattttcgcttggccggccaaattgcaggattacacgctctccaacaatcccaaaagagaacgattgccgggttggtcagggactaattgtcgatcttaacccttaaaccttgggagctaacatagagggcaacatatcctatgcacacaggcccttacgtgtacacacgtgcacaccaactaaaaaatatcaccaaaaaatctagaaaaaatcatacacatactttcaattgtattacacctagggttaaaatcttaacgtcaaattcattatattttagccgtaacaaaaaaaaactgatagttttaaggttgcaattttgtcagaattttattttttttgttattctctatgtagaatgaatttaaagatgcgactttgcacgtagatgtaatactattgaaagtacatgtatgaatttttctagaattttttgtgataatttttagttggtgtacatggtgtgtatacgcgagggcctgtgtgcataggatacgctcccaacgtagagatgcccagattcaagttagcgtggcgacaaactcacggcggggcacgaaccgtacggcggcccatacgtccgtgacggcatgattcccatccctatccccacctcgctcgcggcgcggcccaccagcgccgtcgtgcccctcgtccgcgtcgcggtgcggcggtgcaggcgagatccgcttcgctcagctccctgcccgaccgcgccacggcccgtaggccccccgcgcgcgcaccgcgcccaaatcgatcgatccccgcgtcgtatgctgttgctctgctccgctcaggttgggacgttgggtaggggggatggcgtcgtggaccactcgtcctgtcatccatgcgcgcccaggctgcggctgtaccgcctgtgtacccgccgagccccgtatgcagacaccgggctgcaaaaggtgtgggtgtgctttgtccttttgtcagccactcagccttgcactcgtgttttatcgttctcccctccggctgtgtacggatcgcgtggacacgtgttgctccaggagagctatgcacactgttcagctattggccctggttgtgggcgtaattttgtactttttcaccccttttttgacttaaaaaaaccctaacggaatggtatttgttttgccctttcatatatatatatatattgggtgtgggtaaaatctgtgagactcaacttacccgtattatatatacatcttctgctgatgatttgtgaacctaaagctgttggtgatttgatgcggctgctgccgccaccgtcacaaccaccaaaatactcaatagtaagaatagacttgggctgtgtttagttcagcgcaaagtttagattttggttgaaattggagatgatgtgactgaaaaattgtgtgtgaatgacaggttgatgtgatggaaaaggactgaagtttgggtccaaactttagatctaaacatggccttggtaaaacacacaggtacacagtgaggggttatagattttcaactgctactgatctgataggataccagaaatattgacaagttcaggtatctttcctttttcacatctcaacacatacacataccaggactgaaaaataaactcatttactaaagtatttaatatggcaaaccgacgaagccatccatgtgttggaagcaagtactatcatatgtttttaatgaaagtaatcatctggttaatcatttgcaaaagatcgaatcttgttagatcaggtagtatcgagctaattaaccaccccaagtcgttggtcttttcatttttttcaacgaccaagatcacttacccaaaggccagagtccacacatcggtcatatctacacacactacttcactttttttttagaattactacttcacttcatttcactataagcaatgagcctatgagtgtttagaaaagggtaaggtgtggagcgatgcactgcgcgcacatcttacagttaatccacccccaaattcttatttcacacatgcagtacaagcatacacaaccacaatatatacagtactcctcatggttactcggcatttcaggaaattaaagtattatttttccttttgcagtactgtttatatatgtactgcactggccgatgtgaattgattaatatttcagctagtgagtccccagccaggtgaaacgggagacctataacttccctttaagccggcttcatcaagccaaaacaccacagagagaagccaagagcccgggaaaaaaagagaggagaaacaagctagaacagataggtagacatgcattagcagcagattaggcaatcagctgctgagctaacaccacatccagcatgcatgactggagagcaaaaaagggactccataccagtttcagtttgtagtttgtacctcctcgtctctccacatcattccagcatcatatgcaagcttatcatatcaaatacttagtggtactgtagctataacgagcggcagtgttttggtttcatctccatgcatgcatcaagagtagtagttaattaattattaccgtcatcgatctcagttcatcgccagccgttaccatgcatggagggattgttatctatgggtcacggtagctccagaggctgcccccggcctccgacgggtccggcgaatcgtcggaggagctggggctgagcctcggggggctcatcatcatcccggcggccatgttccgcaggaactgcggcgtctcgaagagggcctcctcgtccaagaaatactggtggctcccggcgccggcgccgctgctgccttcctgctgcgcgccgccgctgcccgccgtggtgcgcgcggcggcactgctcccgccgcgctgctggtgcgctgatccagaggcggcaggggcaatgccgccgccggcacggtcgtgctgcagcgaggcggccgcggcggcagccgctgcgcggatgtcgtccgctgagctggacgcgggtggcgcggtgcgcgaggcggccagatcggggaagttgagcgccgcgtcgggcccacgcagcgcgcgcgccgccacgtcgtaggcgacggcggccatctcggccgtcgggaacgtgccgagccagatgcggcgagccttccgcggctcccggatctccgacacccacttgccgctccggctcctgatccctcggtagaaggggtgcttccccgacgaccgcggcggcggcggcccgtggtcagacatttgatcgatcggcttcagctagggcagcagctagcaagctaggcgcacctatatagttgacgacgacatgcctatctagctatagctagctagctagctagctagtatcatcagctcgatctgagcgcacgtgtgttcgatcgtggcagctgtgggttgagcgcgtgccgagaaacacacgagcaacgcggctatataaggaggcggcggcggcggcgagatcagagcgcgggagagaagcgtgaggaaagccatggcggtcgcttgcgatgagctggtgctcccgaagcgaacaagcaaataacaccacagccacagccccgcgcgcgttattttcaggcgggtgtgtggggattagaaaagtcgcgttgccttcgaccttactaatcacccaagaagggggctgtggcctttccgcggttgaacatggatttaaactgttccatttcaggctccataaattaattgatggccccaatatatttacccctgacctaaaattgcacatgcaaagtgtcgtgagtaatttggttattgataaagtcctactgcctccatcccaaaatatagcaacttttgattatgaatctgggcacatagttgtccagatttatagctaaaaatgggaacggaggaagtaaattggtccacaaattaatttggcttgcttgtgctgctgtgcaggtgcataattttttttatttcaagagacgttttttcccctgaaaagaaatgtgtctatctctattgtatgaattatggtcctaggttgagatggggggtgagaggagcgaggacagaggggaaagaaaggggagattgttgggcttagaaggatggttgtgggaggcggtgaccctacggttgacggtgaggcgccgacagcggcgccagagccacagggatggaggagggcggtgagcaggcggggtaaagcaaggttatggtttagacgccgtggcggattcttcgaccagtggcagagccaaggcccggccagtacaagcatgcgcccgagcttagtcatacagcaagacataagcacatgcttaattactcgatctattggttccaatgcaagccaaaacatccaactaggcactagcaagcaaggcacacattacttggttgtggcacgaggaaaagctactgagacaaccaacaatcatcttcttttttcaaatataatactactactcataaatcttgtttgcaattgtggtatataatgtcacaccccaatccggcaccgccgtacaacggcatctgatatgagcgtgtcgtaggaaaaacagcgcgagccgcttcctacgaaaccgcgatctcagtaccagtcccaggatgtagcgctggtacccgcggtgataaatatgaatcattgcaatccttaaaataaatagaggacttatttaccttaacttaggttgcagctcagacagcccgagaatgcaaccgacgacacggacgaggcaaacaccaacaacagcggcagcagcggaaccaacggtctaacacccaacaccataggcaacaacagggaactaggacgaaatcctaatctttacttcacttcaacttcatcttcagagctggcagaactatatatttatatagagcaagggtgagtacaggagtactcagcaagccatgggaacttaggtggttaatgcaagcttcaaagataaggctgttattttgcaatcggttttgtttgcaagcattttaataatctaagtgtgtgctctccgcgaccagagcgagacaagtctcagctcggtcgggaggtgactagtgaccaaaattttatcaagatttacacaactcccagagttggttccaaggctggtttcccaaaccaaaccaatttttttttccaaacatcccgataatagtggtccccaaacgaccattcacttctagggactcccagtcccgctgtcacccggacagccaaatgctttccaagcatcaggtttcctgaaccttaacacattttcacaaagctgggtaaaacaaaaactacgctaaggaatcacctcacatccgcccatgaccgtgggcacggctgttcgaacagtttgttaacctctgcagagggggtacactttacccacacgacattactaacccggatcactcagcccgtgcagaacggccacatctggagaccttaaggctttcatgacaaggcatttcgaaggccgacacaaggttgccatatgccgacgagaggggtcccagaccaacaacaggttagatcccagaccatactgtgccaggaagcccgggggttctccccaacaccaccctgttgaatccacatgtctctcggcatcaaggctcccccgcttagcaatttactcagccaggggtgtcccattccacccgtgtggtcgcactattgtatgctcggatgtaattccgaaggaatcggtccttaaatgctaccacacaagcattccgcctaggaatggccttgtgtcgcgagttttatttttaaaactcattttctttcacaaggcactgactcaggcgtcgggttttccaatccttttgtaaaccaagttttacccaagaagttactcaaattttaagtttgaaggcgaccgtcgatactcgcacagagtgcacgaatatcgaggcgcaactagatggttacaagggaacatgatataacaattacaatggaaggatcaaatgcaacaagttaggtagacttgccaatctgcctcgcagacggggcaagcagattaagtgcaatcctatcaatgcataatatttttcaagcaatataattaagttcaaatataggctcaagatgttcaaaggtggcttgccttgctcagggtcttcacgaagcttcacaaatcttcgagaattccacttgaagaaaaatatccggtaaccgcaactaggcgcaaacaatcaaaaacctaaacaaagaccaaataaaatatcctatttaggctaattaatagtgccattaaatagatctcaattttacggaattactggaagtggaacgaaggcgatcggagctacggatcgagggatatgaattttggaggtctaaatggattttctggacaaggaaatgttttatcggaatttatggaaataatattctcaagaatattattgacagtcagtgaccaaggaaaatgattcaaggaattttggaataaggaattgatttctgaaagaaggaaaaaggatttattgaatttatagaaaagagaaatatttgtggaatattggaaaagatattctcaagaatatctttgactcattgacaagtggggccaacaagaagtgagagagagagagagcatagatgggctgcggtccatggtggcggatgtggtaggagggaggacgagggagcaaggttagacttcgttccacgacagctggtttggaagagggaggcaatatagactttgttccaaggatcgaggagagaggtgaggcccatcggctggcgagagagagcgagagagtagatgggccggctcgggttgggcggcccatggccgggcgggcgaggccgagccgagccaggcctgcgcacgcgggcggcgctgactggtcgctacttgacctggtcaagcggggccggcgggccagggtagcggccacgttggcacaggagagagagagagagagaggggaggagccgggccggagatcagacggctcacggcgcgcggcggaatccggcgagcggcggcaaaccgaagtggggggacggcgccgggggtaagaggaggaggagtggatcctttccaccggcgcggattagggcgccggggtcggaggagggccggcgacggcgtccggcggcggctgtgagagcggcacggcgcgggcgaggagggcgaagctagcggcagcggcggcgcttcagggaggtccgagggggggcacagggatggcggcggcgccgggaatcaaggagaggaggaaggccgatggccggggaggcacggtggaagtggccggtcacggcgcacggccgagcgcggcgaaacagaggaatggaacgcggcgggctatgtcgagcagcggcgggcgcgatgcggcgagagggggagaagaagggcggtgtcttcagtgctatttcgggcaaggacggggaagaagcagacgggaagctcaccgacgggagggaacgacgtcggcggcgatggttcgatgatgagaaggacgggaagccggcgggaagggcggccgggctccgcggaggatggtgttcgcgacggcgaacgcgactcgacggggcagcactgcgtcagccgagtggtggcgcctggcggcgaactttacgccgaggcgagcgcgccggggaggagatggaggcatgcggggatggaaggactgggtggcggcgtggcgttcttggtcgtggcggggcagccggcgacgaggaggcgacgacacttcatttccaggagcacgggaccaaatggatagataggggggcgcgggggttgggcttttataggaagatggtgctcggctggcgctcaaaggcggtgcggcggtttcgtgggcggcgtgaaatggcggatggcgcggatgcattgggcggtggatcgggcggtgcgaattgaacgcggggcgcgggagcaactgcgtggcgtggtcaaggtggggcagcaaggtgcagatgcggcgtcagcggctctgcctccgagcacaagcggccaaggagtggaggcggggcgccgttgcccggaagggaaaaagagaagggagcggtggaaaggagggctcgccccttccgtttttgggaggagagggggcgggagcacgagctgtgcctcgcggctttggacgcacgcggcgtggggcgcagggcccgagaggatgatgccggcgacgactgcaaaaaggacggggactgtttggaggcgagcacggacacgcggtggttgtcggagcaggcgacgaccgagggtggcgatgtgtcacacccagaaattcccgaatagaattccaagcagaatgtgcattaaaatccccgtccaggaccggccggggtacacaaacgacaatgttgacattcagatccacgtcttacaaatatcataaaagtcttacataaatgcagcggaaaaacgaaagacaacaggagctaagccttgactagaactgcagcgggaacaccactccacagacatcctcgacggcacggacgaagcctactcctcggagaaacctccatctaacacacactcgtactctggggttgggaaaaatagagcaagactgagtattacccactgtactcagcaagtcataccggaataggggtatgatgcagggaattatcaaaggagagttagagtggttcatttgcataaagcgggcatttataaacagaagttgaaagaattaaacagttgcaataattaattaatattgatcatccgctgtccaacgctatcccacgttgcaacaggcccaaccatccacctatactatccaatttcattagactaaactagggtaagactaatcacggtgaatctggttgaccgcccataaccgcgggcacggctattcgaatagttttactctgattagaggtgtacaactgtacccacaagacacagccccacgacacgtttccgtgcgccgacatgccaccacgacataccggaaagaggctgtgacaggacccttcgcataaccccctctaaccaagcacaccacacctcatatttcacccccactcctcgcaaggcaacgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgcgaaccggtccttaaatgccatgggtgcgaccagcaaaaccatgcacccacagcccaccatgtgattcattttaattaaccaacaccaaaacggtggtactaaaccaaccttaccaattgaacctaaaggctatattttagtgagctttccccaatgtgtgctagtggaactaagcatggctaagcaattcctagtccaaaatctattcatgttataacccaagctaacaaaggagcatggcatcaaaaatggcatggctgtaacaataggtaaacaccccatagtaacattataaaacaatgcaatatttgaagaaaacaatagagcattttcaatataggatcaacatgttcaagtgacaagcatgacttgccttgctctgctgctggagaaacctcggcgactatctcgaagtacaccggagcgtcggaagaaccggaatctagcgacatacaaggcaaacattgcaaaacaggctacaagactactgaaacagggaacaaaaccagttttaatggattctacacatttttcatgatttactgacttgaatgggcttaaacggagctcggatgaattagttatgaattttagaagattcactgtgtttattactataaaagaaaaaccttaatgaattattgcgcaataaagccttctagggctgacgtcagcacgggatggggcggcgccgacacgcgggccccactggccagcggctcgggagagggaggaaaggggcgccggcacgcgggcccactcggcagtggctcggtgggggggggagggcgtggaccaggaccacgcgggtggtccaccgccgatccacgggaccgacgaaccagatcgccctcggggccgatcggacgggcggcggcgacctggctcggctcaagaccagccaagcggccacggcgacggcgacggcgcgcgcacacgcgttgccggcgaaggcaaccggtggcggaggcggcggcgcaaaggcggcgccgacgggcggtggtgctaaagcgacggctaacgggcggcggcgctaaagcggcggcaaggagggagagggaggggaatagaggggagagggcgcctcaccgagggtggccggcgcggaggaagacgacggtgaa

SEQ ID NO: 43884 - DNA, 1569 bp, Oryza sativa
ttttaattggttaaaattatttctagggctctgaaaattccactaaaaatcctgttagtgaatttcgacatgtagaactcaaaaaaaattccacatgtcagattcgattattatttgtattactttcttagggttttctcttgatttgcaccggtatttccttagggtcatttatgaattaaattttaggcttgagaggagaacttcggggtgtgacacgatgacgtctcccagacggtcggccacgcgcgcgagcgcgcgggaaacggcgggcggattcaaacggcggcgagcggtttgggcgcggcgagggagagcgagagagaacgtccgagagagggaagggagagagacagcgctctctctctcggtggtcacgtgcggcgcacgtggagatggagggagctgaggagagatgggccagcggcaggtttcggcccaaatcatcacgagggagataaaatagactttttcaggaacttccttttaaggaatttgaggggcatttgagttgggattcgaattcaaattgaacatttgaactcaacataaaatgaaggagccaaggtggggctttaaagcgggaattttggtatttttgggatagatttatatttggcggcacgaaggattatttcagaggatttcaaaaagggaagatcattattcaaaaatggaacaagggagatagcggtagaatgccatggatagatagatagacagaaaggtaagttgataggtagagggacggatagacagatggattgacagatggatagataaacagatagataggtatagtagatagatagatggatcgatcgatagatagatagatcgagactcagagagagatgggatggaagagaaggaagaggtggaccagaaaaaggaagaaggaatccaacctatgagggaggttaaatagactttcacagagagatttaattgggaggttttagggttggaatctggattcgaatttcgaggttgatactcggtctcaggagaataggaaggagtcaaggaagggaacaatattcggagacgagtcaaagggagatggataatttagagagaaagagagtgtaacttgggagcttgagtttgactactcaacgagatatgtgggtaaggattttggagagaagtctgaatagaagggttcggacttcgagattatttcagaacggaaatcattttggggagaactcaaggcgaaagggattgaatcttggggtttagagttcaagggtggaagtgatctcgatttgcatattcagacttgggtcagaagttcgagaaataaaacaagggtagattgacgaaccgataaagagagaaagatagatgaatcaaaacctgagaggttgaattcgaatttgagaatcggtttgaaggaaccaaggagagagtttatgacgcgaaggtgaatccctggacggagttagggttcgggcattctacaaagttcacggatggggttctatgacgggattcccaatagaaggaatcgagcttcgggactatattgggatggaaattttgaggagacgatctttgataaca

SEQ ID NO: 43885 - DNA, 1921 bp, Oryza sativa
gacggattaacttatttaggaccgacttaaaaaccaatatcgaaaaaataaatggcaacaaaaaagacatcaaagtcaactacaaaaaccaaaaattaggactcaaattttagctgtgggggataacctaaagaacaaacggtgcagttgaatatattggtcaagcgtaacaaagcccctaaaatgtcaatataaattactacggtaagaggtgaagttagcatagctatctggtgaggctcttgtggtggaacctatattcgcctaggtgcaaattttatatttgatacaaatgcttgtagttatggttaattttcagtggtaaacgtgtataaccgtcaacagcaagaggcatacgttgaattcatcaatctcaaaaatataccaaacttgctaccttgtggcgccgatgagttttagcgtcgggtaggcagcctcattgtcgcttgtagctgcagcctgtaacctttgaaacttgtaactctcttctcaaatcttaataaactttggctgtcattcgcaagcccgacaagaaaagacaaataactatatataatgtgtatatgtcgcctacattatatatattatgtttgaaaaacatatataaacaaatacgtgcgggtctctctctatatatatatatatagagctaagattacgtgattataagtgcttatataggtcatgatttctcaagccagccgccagctggcaagcgcaagtgcagttgcaagacatagatcccataagcgtgccggctgcaagacagaagtgcacttgcgctatcctttttttttttcctttttttttgctagcccggctctcccatccgagccctaactcacagaatctcacagtggaccgagacagggtccgatttattggacgtgtgggtcctcctccccgtggcgtaccacgggaccaggctgtggtttggctggggatggtttcggccggggcagtgtcgcggtcgcgttcgtacgacgcgtgggggaggcggccgtcgctctcgaatgctcgatgatcgggtatctattgctgcgctacaaatgctccacttatttagtgcggcgtacgattggatacgatgcgatacgagtaccgtttggcgtttgttgctcccggcgttttcttgttaaaaaagtaccgtctgtaagctccggccccctcgtattaaatatgttgggcgtaattttgtttcttgttttcaaataataaacttgacagtagttgttgatttaagtactatacgagcgggggtgtgacatgtaccatgatacgacaatgtatcggcatagcaatgatactgaggagatgatattctgcgctttgctagggatatatgttattttatttgtcccaaattctcaatatgctggtctttctaggattaatgagctacttctctcatgcaaaaaagccaacctagtattggtgtccagattcgttggattaggaaacatcctatccaatactagattggcttttttttgggacgaagtgagtaaattagttggaggtgaaaattactaaattgctccaagttattactcatactagttgcatgtgatcatttttgcatgtgatcatttcaactagggaattagcacaaatggcaccgtcaccacgcaagccacacaagaaatattttaagcataaaataaaatgtcaagcaatctgggacggagggagtaattgtgttgcagaaatgatcgctggatacgtttggattgaaatatcatgaaaataatgataatgatttagcatatgtatattgagttatagaattaagtaaatagtatatgtaactactataattgcatcttcagttttagatattaatctagcatgtttgtatattacactttaggagtactactaaaatactattcttgcatctcgtcgagctgttctctgacag

SEQ ID NO: 43886 - DNA, 1013 bp, Oryza sativa
aggtattttgtagcgtatgggatgcggaattgattttgaagaagtcaaatttggtacgattggttatgtaaagtttctttcttgtactagagagtttcctaaggtgtttatgactcttagtatgagtttggtttgtggctttaggctgcctacctcatgtataaatagaaggggagcatgaggcttcccggtatcgcttttcatagcaatagagttgagttttgagttagcgtttcgagtttagtcgaaatttttgtaaggagtgctgttggtgcactttgtaaacacagagagaatcaataaagtcgtcatctactttaagagttcttcgatttgtgtttcaccgggtttcggcggtctaaccggtaactcaccggcggtcagaccggcagcaaggcggcggtcagaccggcggcggcgatagcgaatggcagctgatctcggcggtcagaccggagatctaatctcggtcagaccgacggcaaccaggcggtcagaccggcaggacaacttcggtcagaccgcgatctatcgatttcgagggtaacttttatttccgctaaacgttttcggtttttgggtataccaaccattcacccctctctggttggtttagttcttgtgattcgatcctatagtcgaaagagttttccaacaaatttggcaagtttacttggtttctatccttctgaaaaaaaatttagaaaggtcaccaggggaatctaaaggtcacccgggggggattcctcgcctgaatatcattaactagattaagaggaaggttacagttacacacagtttaaggttacacacgtatccttctgaaaatgactctaaagtttgctattgattggggtgaccctgactgaagatgacactacaaatagtatttgttctattgtagcggttgactgtaaaggagtatatagatttttggttagaatactctgactagtcaaaagtctcttacacgatcctttatggttgattcactgccatggaagataaagttt

SEQ ID NO: 43887 - DNA, 5276 bp, Oryza sativa
  unsure (1)..(5276): unsure at all n locations
agtaaatacaaatggcatgataactgtgggcaaaaacagtctgggctatcacaaaaaaaaagaagggttcaatacatatcagaaagaaaaaatacctttcttttcttgacaataagattatatgtatcctcaagctgccttttcttatgtttcctagccttatcgagagcaccatcagcctctgtttcaaccaaaaagtaattttactattcaggaaaaccaaattagctaaaagttaacaaaaaaatgctacacatccactgttgcacagagttcctccaagcaagcaaataaataaaaaacaggcaaaaatgctgcagtaacacatatagtgcgactaagaggcaacattagttgtattccagtgcattgcaaggggaatttgatcccccccccccccaagtatgtactaggcaaagaatcggatctgtaaaggtagggcccacatgatggtgctgacggctgactcgctgaatgataaggatcaggcctcctaaaaacaaaatccactaaaactagattgtgagtgaaatgccatccagtaaatagaacagatgaaaactggaagatagatatcacataatcaagaaaaattccacccacatatatattgggtaaaacaccgcttatatttatatatattgtgagtgatgcattaagatgccttagacattgaacaggtttgacagagcatcctagaaacaccagtggagctaataataagaatagataccacatttaccttgataaaagcacagatgaaagttaaagaaaaagcatacagaccatgaattacaatcatgtctaaattaatattgcctaaacaggtatgattaatataactacagagtaaatgaaacacaccaatgtgcaaccaaaacagaaacaatatgattatttgagctttgaaaagaagtctgtaaaacaagaaagaataacttttttttctagaaagactagtttcaataattttgtctagatacagatatgcactaatacaagttattgcgcaatatacttactcatcttttccagtttctcaatctgctccagtatagcctctggatcctttttcaaaatcccaacctctcgtactttcttcctttcttttttattctggcaagtaaaaaaggtgatgggaatttagaatgtgaggacagaacaaactaattggtatctaccgtatttatatcagcaaccataaaagaaatagaacttaacaagagtacaagattaaagaaaatctgtaaaaggctagattggtttgctacacttaccgaaatttggtaataccgaaattttggcaaggtagcaaaaaccaaacactccaacaaaaccttcttccacaaaaatgttggcaatgcccatatatgtgcctcataatagcccaattttagcaccaaatcaaacctcttagccattctacactaccgaaatgtggcaataccaagattttggcaaggtacagaaccaaaccaaccctaatatacaagcagtcatacagatagtgggtacacgtgcaacaatcatggttgtcaagtcgtaaagtcaagtcgaggtacccctggaccgacttgtcgactagttgacaacttgtccagttgtccatgacttggtcatgcaaaaacaggggatgcaatatatagtataaactatggactatggagtagcaaagcaagacaataagtcaacaagaaataaaacaaaagtactaaacacaataagccaattagcatggtgaattagtgatttgctacgactaatttacaaccaactttacgactaatctatgactaaccgacttcacgactaatgctattttgtcgagttgtggctctctagtcgactagcttgaccgattttacgactaatcgcgactagtcgggtgacttgataacagtgacaacagttgccacatttctagataaaatggcatgttataacattatatcaatgtgcatatgaagatactcctggtctcctgctcagcagcatagagcaattgcagtaaagtagctgatcaatatagtcactaggttgctcaagtacaggggaaaaaatatcatgggcactccacaaaattttccagctaaccaggagaatcagcaaaattatgacgcaatataattggtatttgcagttgtaaatgcaagaggaaaaagttccattggtaatttggttccattggtaatttggtactatttgcagttgtaaatgcaagagggaaaagttccataaaccaaaaatctgttttcatcccaattacacctgaacacctaatattattcaaacccgctacatatagggctaggtgaaaagaaaatcacgaatccaacaatctacaatgcaggctgccaagcgaatcaatttacttgcagtacgcaccatttacaccaccatggatattcaagtaattgcttagattatcagttgcattgaaactcttaaaccgcaatatcttagtgatgcccatggaaatatgcttaattgcttattgcatgaaaaaaaaatcccacattggaactgaatcaaaaccaccatatttcgcgtagaaccgatcgcacgaattaatttacgatgttttcctacctcagatatagcccaaatcgacgaaagaacagtaaacctgacgaatcaaatcaccaggcgcatagcagtcaacgaagcatgaggaacatcacaacgcgcctctgcccaaggccaaattccactaccccccccccccacacggacccggacccgcgcgcgcggggtgatagcatgatacgaaccctagggtttgagaggaggaactcacccgcttgagctccttcttccgctgctccttgcggaaggcgtcggtggggttcatgaccttccctcccttggtcgtcttcatcctgccccacctaccctcctccccttctcccccaccggcgacgtacggcggcgagcggcgagcggcggcggcggcggatttagccgcggggggagagagaggagatggggttcgggtcggagtcggaccggagtggtgtggtctggtccccttggcgagtcgcgagtggaagcgggtgggtcacagagacgagtgggtcggtttggttaccgccgtgcagccggcccaggcacgatactgcccgtttacgcgagcaaggcccagtcggtccacctaattcttcccaatttttctaggaaaaagtacaccgaaggtccctcaacttgtcatcaaattacaaaatcgttctccatccacaaaaccagatatagggcatccatcaacttacagaactgttcattttaggtcctttggtggttttgaccccgttttgtccgacgtggcggctgagtcagcatgaaatccatgtggggcccacctgtcagactgtccacgtcatcacctctttctttccactgttttctcacctccacctctctctcacactcttcatctcattcgggcagggcggcggcaggtggggaggaggcggggcgaggcaggagaggaggtgctgcatccggcggcggagacgcgggataaggggagggcggcggcgacgggagaatgggaaggcccagctgcccgtctgccttgacgccgcggtggcacgccgtcgtggttgcgggagaggcgtcgacgacgaggaacggcgcggcgtgacacagggccggaagcgagcatggtggtgggaggaggagggcggcggccgtcgagctaccaggatgacagccatcgcgccacagtgggatccggtggggacgagggggacaccgacgccgacgccgacgaggaggagaggatcccgtcaggaggagcagacttgggcgaatggtatacggtgcaaaagcggtggaggtggcggtggagtaggggaaggtgcgggcaagcgtggcggcatttaccctacggggcgggagaggttgagcttggactcgtctctactgcgcttcttgcagcggcggtttctggcgtcaacggcatcatcgtctgagtctgaatcgtaaacagtgttctagagaaatagatgttatctagattctgtcatcaaatactccagctttatgtgatttggtatggatatctaagatcaattaagtttagatggagagtttgctcgttctgtgatagggcaatttcatgacatttcaatatcgtccatggcagcttcgcccattgatgtgggcaggagaggttccctgccctctcagccactctagagcgttgtaaatgctctgacttgaagaagcttttcagaagaaaagggggttgatctgaagaggactgaacgagtcgaagtggtagagctgctttcttctgaacaattttgttcttgttctctttttgggtgaagccaacccaagctaagctagctgccgcctacacaagccaacgctaccatgggcaaccggatagcctgatgaacagataatagagacaaagggcatgtttagatcccacaaatttttttaccatatcacatcgaatgtttggatacatgcatagaatattaattatagacaaaaaaaaaagaaagaaaaactaattacacaaattacatgtaaattgcgagacgaatcttttaatcctaattgctccatgatctgataatgtggcgctacagtaaatatttgctaatggtggattaattatgcttaataaattcatctcgcagtttacagacggaattattagtctatctatgtttaatacttcaaatgtgtgtccgtatatccaatgtgagatatgttagaacttttcatccctagatctaaccacagccaaacatgctgcaaagttcagttcgatcgactggctgagctgtgatggatgcacacaagagcagagattccttgcagcatttcacagacttgatgatctgaaatttcaggcataaatattgtcctttatttactggatgccattaacttttcaacgaatccttgaagatgctaatggcaatgtggcatagcaaggcttaggtaaaatcattgtcacaactcacgactcaagcaaatttaagagaattttaacatactttttttttgaataattgaggtatgtgatttaattcgttggaagggaattatgctacaactgcatctgcaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43888 - DNA, 5236 bp, Oryza sativa
  unsure (1)..(5236): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcatctcataactgggcattcttcaagacaaagttggaacatcattttttgcagcagatctagtttcttgtgatacaggaaaaagacttgtacttacaattaaagttacactgaagatctcttctactttaagagtgtagcgactttgcttcatggtgatgtctttggtctttcagttgatggccaacttaagtgtgagaaatggattcgtgacgacgacaagaagtctgaggaatcgaagatgaagtggtgggtaaagcgtctaattggtaggccaaaggatgtgcacatcagttggccataccccttcgcagaaggcaagctgtttgttttgactctaacagctggtttggaaggttaccatgtcaatgttgatgggcggcatgttacttcctttccttatcgcactgtaggtttttcttaaagcatcaaaaagtcattcagttgcatgagttcttgagcaccatcctgagatctccataactaattttgcccaactaatggtctctgcagggttacactcttgaggatgcaaccggcttatctctgaatggagacatcgatatcgaatccatttttgctagttccctgcccaattcgcatcctagttttgccccagagagataccttgaaatgtctgaacagtggagggcaccaccactaccaactgagcctgttgagctttttattggtattctttcagcagccagccattttgctgagcggatggctgtacggaagtcgtggatgatgtatacaaggaaatcgactaatatagtagctcggttctttgtggctctggtaactatcgattgacttaatggttttactactcttttgagtaaattcataatctaaccaattaaagtaaatttacagaatgggaaaaaggaggttaatgcagagctgaaaagggaagcagagttctttcaagacattgttatagttcctttcatggatagctatgaccttgttgttttgaagaccattgctattgctgagtatggggtaagtgaattgaacatgtaggactgttttgttattagacattagctgctatcccatctcacatgcttctctgcgttccaatttatccatatttatgctcatttaatttggtctgtttatgcaggtgcgagtcatacccgcaaaatacatcatgaaatgtgatgatgatacatttgttagaattgactcagtactggatcaagtgaagaaagttcgaagtgataagagtgtgtacgtaggaagcatgaactacttccataggccactaagatctggcaagtgggctgtaacttatgaggtaaattgttctttcccttattttaaagcaactactatgaatatcacattagacaagtgcaacttgaaaggatattgtgttgtgaaacatgcaataccctatttgccttgcagttgtgttttcatatgcttgctagccaatcattagatattcaccaactagcacatgttgttcttattttctcttcttcttttgatgaaatcgtcgacatgcataccattgttcatgtttccccttttatatgactatgaaccattagccgtgccactaaattatattcaaatatatagtatcttcacatatttaaaatccatgttagcttggccctttgaacaaggcaaacatgccggttgttcaaattgtacatatctcatgaaaaagctggcgctcaatcttctgcactgtccttagctgtcagcttttagcataagaaatggatgagacctcttcttgtcatcatattggatagcttcttttatttttgcaatagtaatattctaatgttgcaatgataactcctcttggcaggcatcatattagatagtttttttttttggcaattgtaatattctaatgttgcaattctgattctattttcaggaatggccagaggaggcatatccaaattatgccaatggacctggctatgtaatttcagccgatattgcacgctacattgtatctgaatttgacaatcagacacttcgggtaagcatcaactggacctagtatgtcctaccgtacatcctgctgtaacttgaactaaactgtagtgtatttctgtttcagctatttaagatggaagatgtaaacatgggcatgtgggtcgagaagttcaacaacacgcttcggccggtcgaataccggcacgatgtcaggttctaccagtctggctgcttcgacggctacttcacggctcactatcagtcccctcagcacatgatctgcctctggagaaaactgcagtccggaagctcacggtgctgcaacgtgagatgacaatggcagcaaaaattagccgtattttggagcaaatagagacgatgttaactcgtaagctcagctcgctgttggaacaccagaaaatcatcagcattcagcgatgctgacggttcggaggagcgctcatcttctggactggacctgatatatgattcgttcattcttttggtcggtggctccgtttcaagctgctgatttctgacacctgatcaatgatgttcttgccttcttggggattctttcgcctgttgatatttatactcgcgtcaaatttatttgacctaggaatttttgaggctggtggtggtggtggtggcggcggtggtatgccggcggcatgttttgtgtataaaaaggattttatgagttttactgtttgtgagtatatattcggtggactcctattggctgacactcttaccattactgtttttatgagttatttttagctggggagtgttattagagagatccttttgaacgggcagtacattcgtgagggaattcaatatataaaaatataatttatgcttaaaatactcttaataataaaataaatcatgacagaataaatcatatacatgtaatttatttaaatatgatgaatggtaaaacttaattaaaaaaaatcaatggcattaaacatttaagagatgagggagatgagggagtatgtttgatgaatgtagtccctatgcttaattcattgctatgtcaaaatacgtccaattttttttattatgacagcaagttgtaaccctttctattatttaataaagagtaaattgcacttatggtacaacaacttgacatgtgagtgtgatatagtagagaattgaatgtctgggtgcaacaacttaacaagtagcgcgttatagcataagaactttgacaatttagtattttggtgcatcaacttggctaagtatatgctaggtaaatttttttcaccatgtcaatatgctatgtaatcctacggatattatcatattaccttataatattgaatttaatctttaagaattatactgcacatacaatttacatccaattaccttttaatttttttttattttcttcaccttctcaaatatcaatcgaaatataataatttctacatcagtttaattgacttttaggaaaaaaaatataaatatgcttatacaaatacactactgtatattgtcaaagtacttaaaaattgaatctatataaaaaatgctctaaataattaagttgccgcataacttgttaatttattgtatcaaaattatagctatcttgcaagttgtcgtatttatatgatcacttataaagttattgtactaaattacatctacatatcaagtttttgcactagaacactcatttcttaagtttttgcactaaattgcacccacctgctaagttgatgtaccgtgggtacaatttactctaaagaataaatctattctgtttcgataaaaagaaactcctattctgagttgtttcagaattctgtttgttgatatcaattgaatctttttatattttattctctccccaaaatttttttttgtatagtttagccgaatttaacttcagtggaatggattttccaaaaaggttcaacggaagggagtgaaaaataacgaagcagcacgcatggtatcatatgatgagttgcactactcttctcagttcagacttcggactgcatataacatggactgggctggacaacatactcggcttggtagctcacttggcttgtgaacagctcggctcgttgagaaatgctaacaagctgagcaaggattgattttttttattttaaattttatttattaaaatattaaaaacacaaattttttaaaaaaggtttacaaatctacaccctaactctccttgagagggcttttttaaaaacgcacttccagagagcattttttataacgtgcacacatgcattggtgtggtccaacggttgcgtaaatattttacagatgacccttgcaactctctaggagggcggcaaggggtccgcctgtaaatggccaaccacgattgttttgcaggtggctctctttataaccctttgggagggcagcaccgcggcaaggaggttgcctgcaaaatgaccggcgaccctccatgtggccattagaatacactaacggacgtgtgccacgtcacaaaaacatcctcaggaagggtggcattaggggtgtagatttgtaaaacttttaaaaaatatattttaaaaatattttaataaataaatttaaaaatttaaaattcagatttagctcggtggctataacgagctagctcgcaaactgttgacgagcccaatgagccagagaaacattaggggaataagttcactttcggcctctctatttgtcgcccagttcgattttcatccctagaccacaaaattgggtacgacccgtcccccaacttacgaaaaccgggcaaacgagatccctcggcggttttggctgacgtggcgcctatgtggcttgtttgactaggtctccatcccacgtggcattgatgtggcgcttacgtggcaattatatctcgaaaaaataataaaaaccgtgggcccaccggtcagctacacacagaagaataatttaaaaatagtggggcccacgtgggcccacatgtcagcgacaaaaaaataaatatgggcccca

SEQ ID NO: 43889 - DNA, 15587 bp, Oryza sativa
tgccatgagcgcacgcgacgatggtggtggaggtgggttacggtggagggtgtgtgccgctccctcctctcccgccggcgccgctccctcctctcccaccactgacgccgccgcacgtcgctccctcttctcccgccggcggccatcggggagaagggcggcggacggctaggcgagctccctagcctaccggtgagcgcgcgtgtgccgttcctttttctcctgctgctagctatcagggaggagggcggcggacagctaagcgagctccctggcctaccggcaagcacgtggaagagagagatggctggcggccactcttctccatttctaccgccgtcgttgtcgccggccgcatcccctccccccaacgcaagaaagatgaagaggggagaagggagagaggaagcagaagaggaggggtgagttagactgacatgtgggcccacatgggccccgctatttttaaattattcttttgtgggtagctgacaggtgggcccacagtttttattattttttcgagatataattgccatgtaagcgccacgtcaatgccacctgggacggagaactgttcaaacaagccacgtaggcgacacgtcagccaaaaccatcgagggacctcgtttgcccgattttcataagttgggggacgggtcgtacttggttttacggtcaagagacgaaaatcagagtaggcgacaaataaaggaacccaaagtgaacttattccaacagtaggagtccaggaccagggcccaagcaagaaaagcccattagtgaggtggagtcaggtcagccgagcagcccctttcaaatcagctttgtttgtccttatgcctttgatatttatatacttgtatttaatgaactaatgctaatttttaaactctttctataggaggtagatgatgaaaatcattgagtttgtggagttcccacattgtgttgtggcaagcagctagtaattctgtgatggtcttgatgctgaggaggatggtgttgtcttcaactcttggtgttgcttgatggaagggagatgttacttgcttgttttggtgttgaagttggcaacttggcatgtaacttgtgtgattctatgatggtctgatggacctgaagttctggattgtaatatagtactatctaatctagttgcatggcaacttgcattgtggcatatttgcatggaccatggacatgttattatgttaaccatggacttgaagttttccctattacatattggatggacatgtaatctgcgcacaaatgttgatatggctgacgagctaaaggagctggctgctgagccgagccgagctaactcgatatccaccacccctatatatgatcaaatgcatgctaactgctaatgactgtttgagtggtacatattcagttaagcgctcattctgttgagggaatagtaacatttttctaatattaatcaattagtaacgtccaattaagcacagcagcgtagaattgttgataaggaaactctggttttgtttttgtgtgtgtaggtgggtacggagtaactaataaatggaggcccaaatgatccatttgatggattgagatctgcctgtagcctaccatttcaagcccattgcacgtgagagttctgaccacttaattgtttgatttctatcctcatacgacgcctccaactgaaagtaaaagtttacttcacaaattgtgccagccatttggttcatctcctcctgcgtggcaaccacaaatatgcaagcctccttcgtcaccgacagtacatcttcagagagaatctgagttttcatggttttgtcatggaagcctcaacctccaagcggaggcccttttgagtatacttccttgcgttttcatctgcagttactcttggttttttcgtcaccattgcagccatggatctagcttgctatcttgtggagaagagaaggacttgattgaattttctagtttcttaggagtccttcctagcaaatttcaggagcttatgttaatttggctatcttcgtggggcccttttgcaaaactggttgtacttgcaattgattttccgctggggataagtcatgtgatatgtacttagttatctataatcaataaaatgcatgagtttttttttaaaaaaaatgttctccttaatagttaaaaagttaaacggttcattctgcctccttcgtgattttctacgctgattttatcttacatgatatcgttggctttatccacttttcatggacagagcagaaatataaggcccatctattaatgagcccttcgttctcttccatttccatttccatctccctctcttctccctccagcaaaatcctgctaataccgacctccaccaccgcatcggggctagagacaaggccgaccgttggcttacgacgtgcacccatggctccttagctcacgtagcggtgggacacaagagcaagacaagtacattgacctcgtccacccacatatggactcaacgacgttgaactcacgaagcgatcttggcgttgtctgccacctctccttctcgagctctggcagatcgatgttgtgagagaggagtgaggatgagggagagcatgatacgtgggccaatacgatatttttaattttgctaggagacttaggctttagttcttttttccaactcgaaacttcaacttcctcaatttccgttagcacgctttttaaactgttaaatactccctccatttcaaattgatcatcatataatttttttgaaaatattcctaaatgatcataatatttgtgttcactcattaagtctattcgttatttgtgcattggggtaaatgagcattgatgtatacatccatacacacaagtgttttgatttgctattggctaagaaatagtggggattgtgcatgtatcaagtttattgctaaagtaaatgtagcatgagagagttattatatttttttggtcttgtgcgctcatgtaatatgaagatcaattaggaatggagggagtaatgtgtttttttgcaaaaaatttccatatagaaattatttaaaaatcaaataaatttatttttcatgtttataataattactccctccgtcccataatataagagattttgagtttttgcttttaacgtttgaccactcgtcttattcaaaattttttgaaattattatttattttatttgtgacttactttattatctacagtatttaaagcataactttttgttttttacatttgcaaaaaaaaaattgaataagacgagtggtcaaacgttgcaagcaaaaacttaaaatcccttatattgtgggacggagggagtaatactttatactaatgagctttctcgttctgtgctcgctaaacatctctctccaaaaggtgagaacgaatgcaaccatatgtggtcatatatactttttattttttaaagtaaatttcacaaaactatagaaatattaaccaaattatctcaaaactatatatttaaaatattgtatcacaaaactaagttttttttaacattaaatataccacaaaactataaatttagtaacaaagttatcacaaaactatgggtttagcactaatttaattagaaaaattggacgtttataactcaatcatactattagtgctaaacatttaaaccctaaagatgtgatttttatgataattttattattaaatctttagttttgtgatacttagccttaaatttgtagtcttgtgataaatctattgttaaatatgtagttttataatacatcaacttaaatatatagttttgtgataatttgatcaaagtattcgtagttttgtgaaatttacttttttttttagctagaatgccacatagccgttacgttacataaaagaccagattaaagtgtcacttagatatcacatataacaaaaccaccatctcaaaagtatacaaggagataaattaatccgattttaccagttgtggaagcctttatagccgatagtacggtttgtgaacgtggatcaaactaaccacatagtttaaggacgcaaaataaaccttttccaacgggaaactctctgatacatcgatggaacacgcagttgagacttcagggacatatgaaggagttcaccggaggtccctcaacttaacaacgagatttttttaaagatcccttaaacataaaatcagaaatgtgtacccctaaactcacacaaaccatgcactcaagattctatggtagtatatatgggtggtttcgctgacgtggctcctagtcagcaaaaaaattaaagagtaaattgcatctccggtacacgaacttgttaggtgagtgcaattcagtgtacaaacttgtaaaatgctcgttttggtacatgaacttgtctgctgcgtgcggaggaaggcgaaaaggatactacatagctaatcttattgatttaggggttgattaggatactagtaaacatatatctgagaaggttgatattgacatacacctcttcaatgaaaaatagaataggatatagtgatagtataaaaagtttaaaaaaactgagcaataatataagggttagaaatgtatgaaagtcatcatttccatgataaaggatacaattgagaccaaaattataaatattgcatgtcttatgcatactcactacacgtatgcatgtcacatcctaatcaacatcagcttattttggtccttgttcgcatgaactagacaagttcatgtaatgaaacaagtattttataaatttatgtactaaattgcacctacctaacaaatttgtgtaccaccaatgcaatttactcaaaattaaaaaaagtacataacgcccacatgtcagctgcacatattttttttcttctcttttcttctcttttctctcttctctcttctcttcttcaagccggcggtgggcgagcgccgcggcggagcgctgctgcagagcagcagggagcgagtgcggcagcgaagcggtggcgggctgcgggcggagcacacggcggacgagcgcgacggcggcgaggaggctcgcacgacgacatcgggcgtcactgagatgcgcgcagctatggagtcggcaagctcgtcggctggtgcggccttcccgcggcagatcgggcacgaggcgtgggacgagagccacatgtcgatgcactcctggtggagctgcctcaccatctccccctcgtcgacagcgctgaggcaaaccgcgcactcgaccgacgccgccgtgtccgagatctcgccgttgtcatgggctcgcacgtacgggaacgacgggaggcacgcgatggtggcggcgtctaggccgaacctcggcggcgtcggccgctgctgctcctgctccatgacaagtggacgatcacgccgacgacgggcaatgcggagagctcgagagcagatgaagatggtgatgaggaagaagctcagggcgaatgacacggccaaggcgccgaacaacatcgtggtgctgtagcatccggaggcgcccgccgccgagctcacctgctgtccgctccgcccgtagcccaccgccgcatcactgtcgcacttgtccactgctactctgccgccgcggcgctcgcccgccgccggcctgaagaagagaagagagaagagagaaaagagaagaaaaaaataggtgcagctgatatgtgggccccatatattttttttaattctttttgctaactagattccacgtcagcaaaaccacacatatatactgccataggaccttgagtgcacagtttgtgtgagtttaagggtacaaatttttggttttatggttaatggacctcaaaaaatctcgttgttaagttgagggacctccggtgaacttattccacatataaatacattccataacatgcatatgaccttccacaatacttcaaatctaggcatttctttcgattgaagaaattttaaaggattttccttaggaaataaactaatttatatcaaatttatgtaaaattcatgcggtttaaaggatttgaaaatggagctctcaactcaaataaacaaaccattttctaaagaaaaaaagaaaaaaaatgagcatatgaacaaactcatgcaaaattgatgctcttaacacaaattagacaatcgcaaaaaaagaaaaacacacaaattaggcgatctactccggtcatcaggtcaatgcccctgatgccaacgcaaagtccacgaaccagttaaaatccacaaatttcactgcctccatgtcagtagaaaaaaaggataaaagaaagcttcgagtcaactccctttatcctgctttgtttccttaagtttccgccatgcgagcctaaaaccatacgcatatgtatataaccttccaacctaaattcaaatctagatcttcggccgagtttagttccaaactttttcttcaaacttccagctttttcatcacatcaaaactttcttacacacacaaactttcaacttttccattacatcgtttcaatttcaaccaaacttctaattttagcgtgaactagacacacccttctttagattggagaaactttatgggactttcgaacaaattagactaatttatatgaaatttatgtaaaattcatgcattttaaaggaggaaaaaagtcagcataggaacaaactcatgtaaaatcgatactcctaacacaaattagacaatctactccggtcaacgcatgtcagtagaaagaggattaaaagcttggagtcaaccccctttaccccgcccgtttcctcttgtttccgccatgccgtgggctcaaaccgccggcgccgccgcgcgccggcgaccaaaaccaccggaaaaagaaagtcagaaaaaaaaagtaaggctcaaatccaccgtcgccgcgcgccaccaccccgcgggcgcctccgtctccggatttcacccggtataaatctatgaccgagccgacgcgagctttcttgcgtgttgtagctggagtgttcgaaggaattactggctggcacgcacgcgcgcacgggcatggtggcggtggtgatgatggcgatgaggaagaggatgcgcggcgcgctgctggcgctcgcgctgctgctcaccgcgacggccgtcgtgccgctgctcctcctcggagaggccggggacgacggcgtcggggccgtcgccgccgcgccgccgttcaacgcgtcccgcgtcagggcggtgtcgtggaggcccagggtcttcgtctacaaggggttcctctccgacgacgagtgcgaccacctcgtcaagctggtcagcacctgctgcaatcatagatgccaccaccatggctgaatcctatctgcgtctcgattgattggtgtgtgtggttggagcaggggaagaggaagatgcagaggtcgatggtggcggacaacaagtccggcaagagcgtcatgagcgaggtgcggaccagctccggcatgttcctcgacaagcgccaggtactacatttttggctatatatctggacgccataaatgcttatattttaggacaaaggcaatagtatgtcttttgctacaaatgacaatgatcttttagatattgtgttgtaccatgttcatatagtttgtgggaaattagtatttttggtggccacaaattgccatattaattgggttacaaacaatttttgaaaagaatttaaaatggttgcacaattgcagcgaaaaccgataatgcatttgtattgtggggagacaagtctgccagattaacagctacagttgcagtgaattgatttctagttaatcttcacgagttactactgcttaaaagatagtatttgaactgaacaaaaaactattttttttgtgtgaaattcactgttaaatggacctcatcattgcaactaggttctgacttgctgacatctctcctgcacacaacggtccatttccctgcatttcttctccaacttttgtctctaaattcatcccatccaatcgcaattactggcaactgttcagatcaacatgttcacaggatcaatgcaattcctgttgcgatgcaatgccgcaattactgaacacatttagatcaccatcagtggtctgctgtactaatactgaacctgggtatccggcaaccggtgaacatacaggccggcgtcagttactggaccactggctctcctctgagcagcagttactaaggatgcagatatcagtagcatccatccatccatctattgctgcaggaactgatactttctggcttagctagcattagcaattggaatagtagggaccagatttggtagtaacagtagttaggagatttggtaataacaatggtttgatatgcagtaatttgttttgttgcttgctctcgtactttctaatggattctgtcattctggggtgtaatgtaatggaaatgcgtttcttgttttgtgaaggatccagtggtgagcaggattgaaaaaagaattgcagcatggacctttcttcctgaaggtaactcttctgggcttcctcagattgtctcattgtttggttctattgattgttcaagtagcaaggttttccaagttaatgttactgctattttttttcatcagaaaatgctgagaacattcagatactccgatacgagcatgggcagaagtatgagccgcactttgattatttccatgacaaggtcaatcaagcactgggaggccaccgttacgcgacggtgctcatgtatttgtccactgtcgagaagggaggcgagactgtgttccccaatgctgaggtaaatttcaaatatcacgtccttcacttttccaaatccaaatgatgtatgagtttttgtaacattgctggtgctaatcaatttaggggtgggaaaatcagcccaaggatgacactttctctgaatgtgcacaaaaaggattggcaggtaatggttaccttttgaagtgttttaaatgtgacacctctctaggctctagtttctcttcaaaaactgaaacataacacacttggaatataaccaggctagtttaattgcagtgaaaccagttaaaggcgacacggtgctcttctttagccttcatatcgatggcgtaccggacccgctcagcctccatgggagctgcccagtgatagaaggtgaaaaatggtctgcaccaaagtggatccgtatcaggtcctatgagcatcctcctgtctcaaaggtgacagaaggatgctccgacaacagtgcacgttgcgcgaaatgggctgaagctggagaatgcgagaagaacccggtatacatggtaggtgccgagggtttgcccggcaattgtcggaagagttgtggcgtttgtgattcctaggatgtgtttattttcctaaatctgatgtttgtgtcacttgctgaacacttgatttgtacatacttagagcattttcagatgaaataggtagcatttgaattttcagacagtgaacagtagcatactatttcttcaaaaacaacggcttacatcctttgcacatggttttgaaatctcaagtttacttctagtggaggtgaagactgtgaagtaagttttggtattttactgatgcagaaatggaatctgtccttctggcaacaatgctactgcctgttccactttaattttgttggcttgcataacagtggatttcagtacagcagtgtgtcaggctgtctcaaaaataacaaactcctttggccctttccacaatatagaagttctatggtctttatctcctgcatcagcctggcttttagacaaggaaactttgtttgttgctacctcaaaacatgtttctaatccacagagaacaagtttagatcctaacaaaagttttgttctactgcatgcgaaaaatcgtcgaattagtgtacattttcaacagtagactgaaaatgtccttgcaacgatcatgtaatccatgtagggcttatgagaacagtgtgatccatgtagtcacaatctaataataaggacagtgacatatcacctgaaagtggtagatgtgtgtatttcttcagggtgcttcacactttgaaggatctgcttttggaccttgctttaccagagcaatctctcatgtgtcatgcctcctcctagatttactcaaactttaccttaaacacttttgtgtaaactaaattatcctctaacttggttttgctccaagggtaactaagtaatccctgatggtccatcagacagcattttcggtttgccatcttaaaactccaattggctctttttaccaatcaagatctaagagaaagaaaaatgaaacaaaagaaggaaaacaacataactcaaaaagcaaaggacaaaagcaagcatggcctcacctcctttgatttctaccatgcctcttcattagctaggcccttcaaaagcacatcagagccagcagctcaaggaagaaagaagctgagaagaaaaccagaagcaagaaacacataccactgcctccacaacaatataatgtgctgagacaagagagaagaagcctcacatttgagggggggctttcctcacttgcaccactctatgagatgctcataaaggggtggtggtggtggtgacaataccccaagatatagaaattagggtattatgagcaggtttgccaagtcagcgaggcgggtatcaacgacaacattggccattctatttggaggcctcattttggtgtcattgttggtggagacaagcgcgaaaccgccgtctccggagtagtgttcttggtgttgggggtagaaggatgatgatcaatggaggactagttcacagtcacaggagcttggaagatttcaatgctggtgatgctttcagcagcatgaagaggagggtgccaaatggaccagatccaatccacaacaggtaacttttatagcgtgcaaacatgagatgtactgctctttttcttgttcctcttctccttttttctgtttcaccaaatttagtcagaatgttagcttgagatgtgtcaactacaagtttttttaatggccttttaactaaccttccatggatctctggaaattcttattgataataaaagattaatatagcagaaaagtattgtcgatgcctaatcgtgttatctgaggtgcggtcttgttcaagaacaccttaagttttatactgaaatctttctatcccacttcagtctaatttaaagagcatatatgtttcaaattatgttcatgctttttgtttcatcttgctgagtataagctggattggcttttgaaatctctatttgttcaatataaaatgaactatatctatgtcattccataatatgacttctttatggaattaagcttgcttgccatatcgaaatttaatactgtacaagtttgaaaggcatgacttaaatttgattgcacaatgaaaacaatgtataagatggtcacactatttgtattcactacacaaacagtgctcatgatgatgtatgctaaccttttaataaaggaaaacaattactccacccaatgaacaccctgcatgaaccttatcatatctgaaatgattagccaacatgcatctagcacccttaacgaactactactcatcaatcagagcaatatatgtgtgtcaccttgaacattatacttgcaggctttcaattccttcctttatttactctggttttctaatggtcttcaccttgaattcttcagaggaactggagaatcaggaagatcaccaggccgagcgtaggtagcacgcgccccgatcgatggaagcttccgaagcacttctgtggattagatcattgtgttggaagaaagggagggaaaaacaggagttcagcatttgtggtgggtctcttgcaggatgctggtgtaactaggggaaggtggcctatgctgttctaagcactggtatttaagacaattttaggcataaaactttagctttcttgaaaacaaaagctatcctactgattgggtttttaaagagagcaacatcaagcttccatctcacaaaattcagcatcaaaggttcttggcaaagggatatgggcaagagctcctttctttcagtagtgactttgcacatgtttgtagtagtgttgattcttctttttcttttaagtctcatttttgttgtattgattagaaaagcacattgcaagtttgctatagaggaaaaggtaaagataagatgagcaataatttcctggctttgtttcttatcttgtgatgagatgtgaaatccattgtagtttgtgccctagaaccaaagcaaggtagacccacttactaaagatgcttttggtttgccaattagcatgctccacctgcaaatagcattatcacttgagagcaactggaattgtctgcacaatatacgaacaagattataaaattaggtatatttcaattttacattacttaattgctagttgatttcctcaaaatatcttttcaagatacatctccttttcattcttcatatccatattttgtaatttctctagttctacatcaagcacttccaacaaaattactgtggtaaaaacagcaagaagcattggtagaagccaagatgccaagctaaagaagagaaaagaacatccaagctgccaaagtaaccatggattctctccaatgcacattttcttttctttcccttcctctgttttctctcttcttttcttgcaggagtgtagctttgaacagccaaagttgcaccctgaatgtggcctaaaagcaaagcttgtgtgacagtgtgaggaagactgataagaaactctgtccttggttaaaagatgaaccttcttcttcttggggctaatctattcttttcttgaccagtcttcttgtgtactgcatctgggagaataagatgtgtaccaagtgcctttctctgtatcagatgcatactaaagtggggacaaaagtgtgtgcagtttgtactgcattttacagccagcttagggaaaagtttagttactctcttgatccaattacttactatacttggatccaagaaatagtggggattttcagaatttttggggagttgatgaatctactaaaatttgaaaataataaaaccaagcaagtacccaaggctattaaacatcctgtaatcttgtaatgttgtgtttaccttgtgacaaggagcaagccacaaaatttcttcttcttaagaaaagaaatactacatttcatcccatatttattgtatattagttttcaccatgaggactttcacatatttgaactaaatcttacaaaatccctataaaactcctggagttccaaacaaaccttaaaatccaaaccatatatactcacatttcccttacatagaccaatgctttcatcctccctggcagttctgagttccttgttggcacaatatcatttattgtgcagcatagaccccacgtccccacctgtcaatgaaaaatatcacaagaatcctctatatcatcaattttttaagagaccttttaccatgtgcagcttctagcaaaattttccgctctctaaacagattacgttctcacctaaactttgagaatatgtgattatagaatgaaaaagtaaatcagaaatcagaaactaaaaaacttagcttttaaaaaactctcaccaaccaattacttagcggttacttattagaatctagatctcttcggggaagcatgagaggtatggtgaagtcgtggtgcatgactccacccaccagggtttaaatcctagtgcccacgaatattacgcacatgtaggtaggttttcaacggaactttagtgagataaggaatgcgccgttggtttccgtctctcaaagcatatgttagggaatacattcgcgggagtgtgagtgtagtgttacatgtgtagtggtgtgtgttcgtgtgcgtctgtcgtgtaatctcagaaaaagagtctaagatctcttcaaacaagaccaaaatttccatgtacaaattaaattaagagctatggctactgcgccatcgatcgcgtgaatgccccaaaaaaacaaaaaagaaaaagagaaaaagaaaagtgcagcccgtgagtaaacctgtactatgccttttgacctggataccaacgacggcaggtgacaactaatttcacatggctcttaaatttgcagctactccagacgatcagacgttagaaaattaaattttggtgtagatttcagttagtttgcttatatgtatggtgtagatttgcagttggaattcacatttagttaacgagattagtaaattttcactttacatgcatgcaatcatctcaatttttttctctcctgtgatgtttttttatgttggttgtagatggaaaatctaattaataacacgcacagtggaattctccttttgtgtgtgtgtgttagtgattgtatttgtaggccttcatgcttgcaatagaagtttaattgcaacttgccagcaaatcggcgatgatattactaactaaattctcttgctgcagtgaatcatagatctaacagccaatcttttttatgagaaaaaaaaaagaacagctagcattttgtggggccgcgctagatcaaaccaagaccagatgcatataacacatctattgcagatagtattgaaattaatagctgacacgatttttctttgaaaaaaatagaattgcaatcatcctcctaccgtccccttttcaccgtgcgcatgaggtgtccactcattcacaggtacgtcactgtaggatacagtattttattcccaatccatccaccaagtcaatctctaattatatggatctagccaatactttatttttaattcacgtacctagttagtcctcaattatttaggcttggtccgttgcaaaacacgaatatattactagacactgaaagaaaaagagttataatatttaattcacaaaaatatacgtacagttgtgatgcaaaccaggttttgaaaacctgtttcaaaatttcctaaattgcgggtaatttaccaacgtgtccagagaggaaacacctttggcctgaaaattcgaatttgtctgaatttagacactgtaactgtttgaattcagtgaaaatacgttcaaatctcacaaacagtatcctaacctttttgcattgcgaaaagaaaaatcctgatccaaacagcaaaaaagcaaggcaaaatttagaaacaacttttgaattcagcgaaattctgttcaaatatcatgagctgtccggattttcttttgcattgtgaaatgcaaaactctgaatcgaacatgacaaatttaaggcgaaattggggaagcaccaagtggtggaatcctagatgcatgcatgacttcatccaacatatttaaatgatgcccacaaatactatgcatatataagcatattttatatataacaagattttagtgggatatctcattggttttcgtctatctaaacatgtgttagccaggggacgtatttgcggtggtgtaatcattggtcctgtttggatcctccgggctattaaatagccctccagaatcttgctatttaagagtattaaacgtagattactgacaaaactcattccataacccctaagctattttgcgagacgaatctaacgaggtatat

SEQ ID NO: 43890 - DNA, 32766 bp, Oryza sativa
  unsure (1)..(32766): unsure at all n locations
aatcctaaatagtaagattcttgagggctatttaatagcccgaaggatccaaacaaggccattgtgttgcgtgtgcagtgacatgtaatcgggaaaaaaaatttaagactaaaattttgaactagtagtatgaagctacagtgccttcttcctgcagctagctactacctccgttccaaaataagtgcagtcatggatatccatgcccagcgtttaaccatccatcttatttcaaaaaattgtgaaaaatttgaaaatatttagtcacatataaagtatcattcatgttttatcatctaatagcaataaaaatactaatcataaaaaaattttaaataagacgaatggtcaaatgttgaatgtgaatagtgtaaaactgcacttattttgggacagagggagtagatgcaatggcagagatgatctcgcattaactaacttcccccctccatggatcgatctcatctaccccctcttcccctcccatttattgcaaccccatgtcgatcgccatggcagcagcagcagcaacgaaccacttgctcccgccattaatcgcttcctccaactccccatcgtctctcctcctcccctttaaaccccctctcctctcgcctcccgctccaccaccatcgatcgatctccacctcgccggagttgagagagacgacgctgcagggatcgagatcgagatcagagaggttggcaatggcggcgcgcgtggcggttgtcctcctgctactgttcggcctcgccgccgtggcggtgacggcggcgaggatcatgcccgacgacgactgcggcgacacggcgaacgccgccggcgccgccggcgtgggggaagccaagacggcgttcggcgggagcgacggccgcggggggctcttcggcgggtacaccggcccgctcggcggcggcgccgccgggttcggccccttcggcgggttcggcgccggcggcgggccgttcggcgggttcggcggcggagttggcctcggcggcggcggcggaggattccggccgtaagacgatgactcgtaggacgacgtgtgcgcatgcgtatagtagtatagtgcaattaatgtgattccacgtgtataacgttgtgggttaattgtgccacgtcagatatatgtactaatgtacggtgagatgtatctaccgtacgctggagtttgtacggctatcgttgattagagatttctcttgtgttgcttaagtgtttgtgtgtgtgttcattgagttgttttgtgttgtaatttgctaaactttcaagtgcttatctatgattgacagaggtaagattcatgtggctgactatttgggcccaccagtcagccagtggaagggctgatggttgggctcagccaattgaatgttgacacgtaagcagatgcagcctcctaagtcatacctccgtgttcaacttatatgcaaaatttgccacgggacacgcaaaaaatgtgtaattggctggaagacaccacgaaaacgttatacggctgatggacactaaaaaaatgtgaaatttgctgtagaacaccggtcgcattattttattatttccggtcaaaagaggtgagatatttttctaagtgtccagattacccttctctttccttccttttctcctactctttccttcttttccccttcttgttgatttcgctgggaacggcatagcaacctcaaagcagcagtggggcgaggtcggcgcggcgtggtgtggcatcaccagcggccggggcggtcaacggcatgggcgaccatggaggcgcggtgttcgaccagatcgatagcgggcaggcgacgacactgctggtgcagcggggcgcggccgggaggcagcaccaagcgcaggcggggaggctacgattggtcccggcgtcaccactgctacgatggccagtgccctcgctcccttcggtgcgcttgatgagtgccgacgacggcggcgggttcagatcggcgccgacgaagaaggggtgtgatctccctctccggtgcaccatttttcggggtccttgaggggagatggagaggaggatgaagcgaagatgctggtgcaacagcttggcccggcttggtccagataagtgggaacggcgataatgttgctgcgcggtgcacagagcgcgctccagagctccggtgggcacgacagcgttcccgtcgattggctacacgaatcgagaggttgtcaaagcaagatttgattggcatggagagaagataatagaacatgaattagataggaacggagacggctcgttggtgatcggcagtgtcctccttctcagcggctgacaacgaaagataggtggagagggagagctggagctctcttcctaggttcgctctgtgtggaaatgaagtggagtagatggcgatgcagcagggacgagatgaagacttgcctcggcattttgaggcattgacacgtcgtgcacacgcgtcgaactcagccgacgccgatctctctctcggttgtctctggtcgatctctctcacgtcgcgtgctagctcatgtcgcttggcccaacctcccccaaacacgacgagctgaggaggctattctccaggttcggcaagatcgagagggaaaagaagataagggcaaaactatcattttacgttgtttctctctcatcaattgaccgagtattatattttaatgtgtccagtgttctgcagcaaattatcacatttttggagtgtctttgggcaaattcacgtctttagggtgttccagctaattacacattttttttgagtgtcctgtagcaaattttaccaacttatatatacatcatctgtgccataaaaaatcaatatgtgtagattcattatactaaaatgtgttaaattacatatactgtgccataaaaaactaacatgtcaagattcgttatagaatgtgtcacgtccgatcctaagttgttattttgggacgaagggagtacatcacagtaatgtataaaatttactgcaagtaccgtgtatgacatgactttagatgagatgtttgatattttaacatttcataaagcgggtttcgattatttaacatagtaggcatagataaaaggagacaatctaaattgataaatcctgacggatttaattagtatatatttgtataagttcatctcatagtgttatatgtatttttctttaatttttccctctcatacatgctagcttttcctttcactaaaaacaaaaggaaaagagggataacctaatatttcctcagattatttcttccttggaggagactgttaatttctaccgcctcagttaattgctctcaacttggagcttaactctgagcatatgttgaggtattgaagctgtgggccagaaagcctcttcagatccatcaggtaattcccttccccttctgacttgtacagctacaataagcacaagaggtaaaatttttatcatgggtaaaaaaaaattaaaggaacggttaaacacatgtttttttttgcaagtattaagatttggagggagtaataattgtcaaggggagaaacactatcagtctcattgtttggcttattcgaggaacaagccaaatgatatatttaaaaatgaaaaatatttttttaataaagttcttatatacatgttcttaacgatataaatgaaaagactaaaaaataaactacgatgaaaaactttaaaatcacctctaaatttaaagttaaatatttaaactttaactgataaatataaatataagcgaaaagatgaggttacgagagtgtatgaatgatgcgcttgaggagaatacctgaatttcaaagaacacagccgcagacaagctctcgaggacagcatcatcgacgggagctccaccgccatggccagcctcacctctgccactgccaccaccggcggaggaggaagaggagggcgcgtcgtcggtggcggcgaggtagctgcggatgatgcggcggacgccggcggcgccggcgaagcgtgcgcagagcagcttgccgtagcggccgcggtcgtcgtcgtcgtgcgcgtagacgacgccggtctcgcgcagcgccgccgcgatggcgcgcatcgcctcgcgggggcactcgtggaactccacccctcccagcgcccatccgttgttgcgtccgtcgtcttctccggcgacggcgaccggcggctctccggcagcactgctgccagttgcttctgctgctccctgtccagagcaaataggtgtatgatggtgttgaatcagttgatccaatacagtgttagattttttaaaaaaaaggaaaatccactttgtttagtacaaagaaatttcttgatcattattgtgcaaataaaacatttttgtctataaacattactccaggttgattatacttattgttttggataagagtattgtcaaactttaaaaacttttaattataaataacatctaaaatgtttgtcttagaaatgtggtgaccatatatatagattggtcttaaaagtgctccaacaaaatcatatatttatctatacatattttaatagaaaatagtggtcaatgttgttttttttgaagaccgtatactttttaaaacgataggtattatcagtctagatggatggagtactgaattagaaattattcaacattaattctagattggtaaaattgaacatcgtgaatatacttttatgtgctcaaataagaattttatggaaaacttttactgtcatactcaaaagaaaacaatccaccagagtcatatgtttgaactttgaagtgcatgtccaattgcacatatccaagatatttgtccttggacatgggaattttagtattgccatgaatgaagatttattttctgcagaactagttagtttctatacgtaccgtggtgttactttgtccagcttcttgatagacgtcaattgtccaaacataacgtgttggggcatcgaacttcttattgaggatcaggttgtaggcgaccgtcgcctacaaacaaatccatacatgcatattttgaaccacaagtgaattgcaattgcatcgatccatctgtatgtatatgttgccaacatgtcatgagtggcatgtcattaacctttctatgtaccaatactcttatagttgttactttcaaaatgtatgatgacgttgacttttcacaaagtttgaccattcatcttattcatttatttttgttatgatttgttttattatcaaataaaatacaatcataacatataattttatatatgcatactaaatttgtgaataaaacgaatggttaaacgttatgcgaaaagttaatggcgtcatatattttaaaaatgaggtagtacattacatacctcgttttcgactctgttctcaagtgattcaaccaagtacctcctttcaaagccatggccgactaccttgtcgacagtctcagcatcaatctagcacaagatataaacacaattaatcaaaaaaatgcgtaatcaattaaaattaagcacccaaatagcacataattaatcaaaagtaattaattaagcaacacttgccctggtgatctgtgtgcgagcgttgagaggaggcattgcgaggtagcgagggatggagtgctgcagccaacggtgcgtcctgacctcggtgatggtgaggcgcttgtcaggtctcacgatcagcatgctggagatgagatccctcgcgtcgtcaggcacgtacggtgggatactgaactctcctctctgcaacgcaatacgaagagaggaagaagaaaaaaacagatcagctgtttctcaatctcattgggattttcagttttgaccactgataacttcttcttccatttgcttgtctacagttgttcagcagctgaataatatatttttttgtcatatgttttacagttggaattttataccttcttttatttgctggtctagagtaattcagctgaataatatatttttttcagatgttttacaattcacagtttataacttcttattataccgtatttgttggccggtctacagtcattcggtcgaataatttattgtcagctgttttacaattgacattttagtatccatgatgttgaacttctaattcagatttttttttagataagggtatttttttacccggcctctatatccaaccggatatatacggccattgaaatagggaacttagccccgaaaacaacccaatctgaaattcgctccatagaagatttgaactcaggaccttggggtactactcaggtcactgtaactactaggctatatactacaagatttgaactcaggaacttctaattcagataacttcatatacgttgtttatgtttatatcaaagtcattctttttgttaatattaacacggttaattagatattgtaactattgtgattagaattcgaagagtaatttcctaccttgatgatcctgtgcagctctgatacatcggcgctgtcaaagggcaagcgtccacagaagaggatgtaaaggattactccacagctccaaacatccacaggtggaccaacatattttctacccgcgagtagctacaatacaaattacaataagcaacataaacatctcacatatgaatttcaatacattccccaagttactatatgatcgacgacgacatgtaactccttttttttaacacttaaatttcttctaattactaggcgtattgacattgaactatgtattctctccggtccgttccaaaatataagcatttccgtctatgtattttggaatggttaggaatatttcatatgagaaaaagaatatttgtgaatttgtggctgacctcgggagcggcatattctcggcttccgcatgacgcgctgagcaccttgttgtgcctgaagaacttgctgaaaccgaagtcgacgatcttgacgttcatctctgaatccatcaggatgttctccagtttcaggtcacggtggacgaccatgttgtggtggcagtattcggcgcctgatataatctgcctccatcgaattgaccaattaaaaaaaatgcattcgttgttgcatcatcaaattaacaacatttcattaaaatgtttatgtcgtctgactttctttctcctctttctcagagtaaaatttttcaaagtttggaacatggaaatcggcgttcatcaaaccataaaaaaatctcgtagactaacacaaatcattgtcgaaatttcagttcaaaatggggagcaataaatcggtgcaaaaatgcagagttcttcttcttttttgttaactctgaacttgtgaagagctgaagaaagcagggttttcaacctgctggaagatcctgcgagcgtcatcctcgcggaggcggccgagctgggtgacgtaatcgtagagctgcccctgcgtcgcgagctccatcacgatgtacacgtggccgccgccgtcgccgccggcgatcgcctcgtggaaccgcacgatgtgcgggtggttcagcagcctcatcaccgcgatctccctctccactgccgccgccgccgccgatcgaaaattcaggagagaaagaaaatcaagaattcaagatgagagacggatcgctcgagctcgacgatcggagaggaagaagaagaagaagacgaaggcggtggctgcttgcctttgcggatggggatgccgctggcgagaagtccggcgaggttgaggatcttgacggcgacgctgaggccggtgcggcggtggcgagcctcccacacctgcgcgaagctaccgcgcccccgcacccgcaccagctcgtaccgctcgagcagctcccggtgctgctgcgtcgccgccgccgccgccgccgccgccgccgacgccgcgccgccgccgccctgcatcctcgatcgcctcactgagcgtgtgtgtgtgtcaagtagtagtagtaattagtatgtgaaactatgggtagcttaagctactagtactaggattatggatgtattagtaaagctaattaggtagtgattattgcgagattaagaacgagattatatgcaaagtagtactccctccgtctcataaaaaataaatctacaactagatgtaacatattctagtacgatgaatctgtacatatatatctagattcgtaatattaggatgtgtcatacccggtattaggttggttttttatgggacggatggagtacgtagcatcactatgtggcgtctacattatgtgcattggaatcaccggaggaagaatcaattctaagacggtgaaatcaacaaggtaataaggtaattaaaattgaaattaaacttgccagtgaaagcaacacactaagctgggggacaagggggtgcatatagccagacaggcaaataaacatctttcgatgtcatagaaccaaatggttttctcaaatatgtcgacagtattgtgagacaggttttaccttattcgtcgatgtcatttacgccggcctaaatttaactcggtaatttgttgcaagccagccaatcttaatattttttaaagaaaatatatacagcaatttggctgtgcttctttggtttctcatgggtgatgttggctagctagcttgatagccccatgtatgctgctttgctttctcatggctgacgttagctagcttgtccagcttcaagtacttggaactttcaaactttcagttcagtttcagcttagttttttttctcttttttttttgcgggtaccacatgtatatactttgcatctgcatcacaatatattgcactttcatatattcacatagttacacatgtgcaaccatatatggccgggccggggtatcatcgattgttgaaattgacattttagggctccttcggaacaaaggatcaccagaggatttcgatcctatggaaaattcttcctatatggttacctgaatcaaaggaatagctatcaaaaaatcttatgaattttctttggattagctcaaaacataggaattttaaaggaattctaacatgagttccaacctcttaaaaaaaatcttggtgtctatctatcttatataattcctgtattttttcctatgctacatccaaacggccattcttgcagttttcttgtgttttttcaattcatggaatttgaggtgttagagcacttcaatccaatattatttccttccctagtgtattgagaatcatgcgttcatttccacctggaactgttatagtactgcaaggatcatcatatttatgtcaaaaaaatacgaatatattggttttttttaacgaaaggcaaagcttacctattcattgaatatagagggtaaatttagagctaacgaaaaaatatttacagcatcacggttggggtctacggtaacatctctgctaggcgtttggctcccgccatagcccaagattttgcctcttccttaatcttcgagattagggccaccatggttagttccttgtttcggaaaattcgttggtttcgctcctttcaaatttcccaagagattagaaggattaggaatcgagtcccatgcttgggtgcaccttgacgtgttgcaagcgattcccaccagtagtgtaccgtggttgattgcgcccagtttatcggcttgatgggttcacaggcaacccaggtagcaattgcatcctagattttccttgaatatattggtataatttgtatgcactaagcttattttaaatttcgcttattattggcaaaactctacagtgtttaccatttcggaatcacagttagctagctgagtttgagagaggggagatagagaagattagggagatacgcaaaacgaagtaaaccattagtgtataattaattgagtattaactattttaaatttcaaaaatggactaatatgattttttaaagcaatttttctatagaaaattttaaaaaaccgtaccgtttaatagtttgggaagcgtgcgcgtggaaaacgagttagagtctccccaatctctccccaatggcctttgaaagaacgccgccagtattccttgctccttaatactgctccctataactaggataccttcgcagccaaaatagcatctacacactagagagtcacaatccctggggttaagtgcttgaccattttcaaaacgtacagtcagcactcagcatctaaataattggacagctagtaagcagcaccgaccttttgcagctggagcttgcgaagaaatagaatgtgatcctaccactgaatcgtggaaagcagtagcaaaagagcaaatccgagtcacaaggagggttttagatgctagtgttggcatatactggtagaaaggttaaattaaaggttgccatctctctaaacttggacggcagctgcaaggggaagagaatgacatgaagaaaggtaatgcaacgcagagtttacgattcctgatcaatttcgtgaaacggctagagaagtaccctctccgcaaaaaaaaaaaaaacaaaacaaaacaaaaacaaacaaacaaaccaacctaggacaagaacatcaaatctcgttttatgtagagtacgttggtttggttttttatgaaatggaaggagtagtctaacggaaggagtagtctgttttcctatgtttacacttcgaaaaacgtaaaggttacgccctttgcaacgtcagtgtcactaactcaccatagcgtacgcgtgttgccatattagcttaatgtgatcaaaggcatctcttgttctctactggtgtcgtctaatggaaatcctgtaaaccaggggcaaattcacaaaaccagccacgaattctagatgcaaaagaactgcctggccttaaaataagttagacaaatcaagaaagtggtccatcttcagaagcaatttccttgatggacctgcaaccagaactaccatcgatcttcaaggtcatcgagtaataatctctccaaaatcaaaattatttatgaagatcacaggtttgaaaatgcaagttgttccttcttactaagatttagctgtggagtaagagaagatataaagtgggggaacaaacgtagtaacacctactactcatatagcagagcgaaaagagggtagcatacaggctatacatgaatagcgtccaaaaatacacgggactccgacccataaacccagtcactatccgacaccaatcaagcgcgacatcagggacactcgaacacccaagaatcggggcaggactcatgactaacagaacaaaaaaaaacatatggtcttttttttcgccaggaataggcggtattatggggggcaaggtgaatgtggaggactgggaagccaacaccctcacttgcacttgaagccatggcacacggacaggatgatgatgaggatgagcgcgatgatgatgcccaggacgatcagcttgatcttcatgttttgtaaccacatctttcgccgcacctttgtaccctgctgtctgaaatcttgtgcctgcaacccatagttttgatttaagaacgaagaaagctatgtgcatttccaaaatgccaagacagaataaagtgcataatccataagtgccaccattcattggttttctttaacagtatcatccaaagcatctatattgtgtctcacactgtttaatccagttaatttcaacagctgctacttcccatcgctcataggagctaaataagcaaagctcagatagttgcatatcattacaagcatctccaaccactacaagcatctcattgtgcatcaaattattcagcttgaacagtataatagatggtaagaaggaatctatatgcttgttgtagcatagtaataatgtattatacatcaaaagttgctgagttaattaatgagttaaaatagttcataatttccttctgcctagccgggtgcacatcagttataacagcagatggtgtggaggattactacatgtcagtcgcagcacagtaataatgctataccatatcaacagtaagccagatcacctttggaaccataatgcggtacttctacatatgtacaccagcatcgacatggaagctttctagtcagctcaaaacagaaatacataggctaaaacagaccacgagatatcttgttctttagggcaatcttgtatcttggcatatatgttccaaaaattctgaaaaattattctagagatgataacatttcaactaccatagaagtccagtaatattgatgtttcaattaatgaaaccatcccttccctactaacaatgatgcttcaactaacaaagccatcaaaattctagtaacaatgctttggatgcattgagtaaaagagactagatttgtcctacttaaatcttattcagaatgtttttattataatgcactaaattctagaacataccattaccatactccatactctcatgcgatctacactaacatgtatcagtaatttctccatagcaatccattgtataaagattcctgagttctataagatgatttgcagttctaaattctctgtgttacacaacagtaacttcaaagataaagaaactagtacagcacatcatgaaggaaaacgttaatacctgagatctcaggttttcagtcttgtcgacaagcagttcaatcttctcaccacggtcaagaacctgaatttcataattgtaatatagaatcagcaacaacctttgaagagcatcatggtttttaaagaacataatgtgcagaccattggatgatttaagaatgaaccttctcaatgttttccatcataactcctttgacctctgagacttgtgctttgacctttgcaagcttgctgatttcctcagggtggtccacacaatactgcatgtgctccttaagttttgatctttaaatagtagagacaaacaaatatcagtcaaaagaaagaaagcccacaccatgctcgaatatcacataaaagcaaaatgaacatacccgaattctcggttgaggctgtttgctgcagcagtagctgctttcccaccaccatatcttttggtgaaatcttccttgactctgtcaaggaaagcaatggggatttgtcgcccaactgattcaacagcaactacacagtatgctgcacaaagggggggaaatggaaatgataattaatctcaatgcacatcatgagtttgtgttagaaagtgaaaacatcaaagtaccaaaagatcaaaataatgaaaatagttgttttagggtgaccaagcaatttagaatggttccaaaaaatagatgacgcaagtttgcaaaccaatttagactgtttaaattgtgtaacatattcaatttaccataaaagggtgggtgctaccttaacagtttgcctgtgggggaaaaaaaaactttctaaccacccatcttcctgctttttttgttatccttcataaccttccactaattactcaatcatgcacgccacagcctaatacaagataacagttatgaatcttcccttgactacgtaatgttagccccacatccaattcctcttgcactatgaaaccatgtcttgccttaattgtttatttgttcaaaaacaatgcaaacaattggattgggaacttgcatcctacctaaaactaaacagcatttattccataataatatactgcaacctattcaatgaagtaccaaatgaaatttgaagtagccttttgatgtcattttcacattaccataataatggaaatatggtcacccagtttgaacataagaaaaggcaaaatatgctagactgccccgatacaatacttgtgcccgcaagaatgacacaattttaatgcctattctgatcatcacaaagtagaatatgaaagataagtatcacaccattttgatttgataagttagttagatatgtccatgaatcgtccagaaatgcaaaatcgaaaaacgcaccaatcacctaatccctgaatccccagtatgccgatgcggttagagcctaaaaaatatttgatatagtcaaataacacattcaaaacgcaaacacgtctataaatttcctgattctagcatgcaatcacacatggaaacacccgagcctcctctaaatatagccaattcccaacacctagcctccctctctagcattcgtcaactcaaaccgaagcacaagcagcacacgctagatagcactagcacgccccgcaagtcagctcggagtccaagcggatccaaccactcgaggccccaggcctaccgaaacagatcgaacaaaccccgcgagatctacacgcatggagaaccccaaatcgagcacgcaacgttgcggatccgaggcagatcggcgtccgcgcggcctcgccgaggagggagaccgatcgatcattggatcgaggaggaggaggaggaactcactgaatccgtcctcgacgaggtagttgaaggtgtggccgtcgcagttgtaggtgaacttgttgttgctcgcggggagcttctggaggcactgcgccgcgatggtggtgaagttgccggtgaactccgtgtactcggcgagcaccaccgtgcccctcgccacgaacgcgtagatcagcgactgctgccccatcgctggcggtcaacctccccgctttncttcctcgcgctctccgccgccgccgcaacctccctcgctggtgaatccgacggcgccgacgaggatgaggtcgtcggcggtgaggtggttggggggggggggtggaggagaagggaaaaggggatgaggatggtgagcgagcgaaggtgggcgtggaaaaaggggagaaagaaatcgaattcgaggtggggttttgcactttggtccttgggagggggtatatttatgtactgtataactgttgctttgactggtgtccctaatctttgacgacaaatcagggctatttgatttgaagaaaaaaacatataaattttgaaggatttctagttttatagaaacttttttatgaatgtcttttgaaacaaaggattgggtcattttatatcctttgaaattcctatggaatggaaaattctatagagattttggagaaaaattagcaagagcttcaatcttttgaaaatcttcctttgagtataactctctcatacgattcttatattttttttcatgcggtccaatcaaacgtttttcatgtgttctgtaattctttgtttacacttgcatttctatcataatcctaattttccctattttttgtttttttattcctacgaatcaaggggctcttgaagttttagcatattggaacatttcaatgctgcttagggtctgatttttaatctccaacttaatttagattttcaggggcacataaaataagataaaccattagcacataaatcattagtgttaattattacaaaccttaaataatgggtttatttgaattttaaagaaactttatataaaaagcttttgtaaaaaatacgtcatttaaccatttgaaaaatgtgctaacaaaaaataaggatggagttgacaaaaagaacaaggcataaggtaatgctctttttaattatgcaccgaattattgaaatgtattattctgctctctaattaaaaatacatttaagaaaatcttctgttgtattgcttagatagcttgttttgaagtttactttttaaatatttaatttatccatataataataaagataatatatgataataatccgttcgataatctaaatcaaacggaagcttgtgtcatggttgcgaggacgtctctacctctgtcttgataattatatttttttaatggagttatttttgtgcgaactgaataattgtttgactcggtacaaaattataatagtgaaataatgatacaaactacaaactctcaagtaggcattaattttccattcattttaagatactttatactttatatactaagatattgaagattagttataacaaccatgttgcctacatcagtatctaggtgttttaaaacaatactagtagtattattcaagtgataacataattagtagagctttagacgggttgtcccttgtggtttctactttctagttgcaccaactgatgctcaaccttggagggtacctgtttgtgatggagccataattgcagggtgttaggtcccatctggagccaacaaattggattgccggatcatgaagcaagatgatcagaaaaacgagcagatgactcgtcaatttaaatcgcaaaggaattcacacagtgacacagaagggaacacacatcgctggtcggtaccaacttaattaattttttatgggaaaggaaaaagggtataatggaaaaatgagatactggtgttcttttaattctgaacctccgcatactgtgatattgcagatgacaccttgatgatgggattttggggttaatctcgctagctctctctgcgatgattcctacgattcgggaatagaaacgaggcttaaacacgggtgctaaatagtttgataagattggcattggtgccagcaaatttttggtggtgtttgaatctcctaaggatgaagattaagtatttcacgcaaaacgaggtggtaataacaagtgattaattgagttttaattattacaaacttaaaaaatgaattaatctgatattttagaacaactttcatatagaaagttttcgcacgaaacgcaccgtttagcaatttgaaaagcgtgccattttaatccaaaatttaatccactctttccagtggattcgaacggggtacatgtaccgttctcttttttttaaagaattacgcagtacatgtaccgttattgttaaaaattcgtttgaccaagattttaaaattaaaattaaattaaattttgcaaggaaacttcaaattgattgagcttccatgatccatcttgtttgggactacttctagattctctttttgcaatgtaagatactcatctccctccgtttcaccattataagatggtttgatctattcatctatcgtctggatttacttagatcaatataactttggacatatttgtatataaatctagtcaaaaccgaaaacttctcacaacataaaacataggaagtagtaatatgctcaagacaatacctaagaggtcctttgttgcatgaactgttattatttacatactgaatattctataaaaattcatgccttccaaaaaagctaaaaaagataatacagttggcaaacactggttaatagtgatttttttcattgtttataataagacaaattttgctacataacattcaaaacttgtgtaatttgctaatgcacattgaataatgtgtcacgactgaaagacatcctaaaaattggtaatttgctagagaacactttcggctcaattggagaaattcttaagaacgacgagaatgctcttaacatacatgcttcaaacataacgttagagtaaaatttagaaattatgcaaatataaatttaccatcaccccagtacatcactatacatcataatccatcttcactctagcctagctcaaaagctttttgaccggcattcttttttttaataatttctctctacaatgacgagtgtcctccagcaaattatcaattttgtaattgtctttcagccctaacatgtttttatgatgtctcccaacaaattatataaatttttgagtatcttgtagcaaattttgccttatatttaaggttagatccatgtttcatccttaaacctttgataaaatccattttcatccggaactatatatagaactgatttccttttcatccttgcttttcaacaccggttatatcgggtctgtttggcacagctccagctccagctccacccctcctggagctagagctcagccaaacagtttcagctccaccaaaactggaagtggagttgggtggagctctctcacaagatgtactagagttgtgtagctaggtttaggcagctccacaactccactccagactcaactcctggagtaatatttaggagctggagctgtaccaaacagccccatcgtctagagtaaaaatggaatccgtgaaaagtttcgagggtgaaaataaaagactactgctttagaactgcaagcaggagaggaataatagattgggcaaacaaatgctagggctagtgatattagaattagtatagagataatgtattatatagattatcttaaaattatgagtatgtgatatggataaaattagaggtagcaaccgtaaaagtagctcttggaattataccttgattcacgagactaatcaaagactggccggccgaccttagcaaactttagggtagtgtttggttggtgggatggaacgggatgagttgggtcgatcccatttttccagttgtttggatggagggatgggtgggatggaatgattctagatgggaatattctctccagatccgggatgaagtgatccgccaaaatcggccggaccaatcgatcccacttggatggagagaacggcgtcactcgctccagccacctcccgctcggttctgtcgtggcgccgcccgtaccctgccgccgctcgtcccccagcgccgctcctccgcctggacgccggtcgtctacctcgacgtcggtcgcgctcctccgcctggacgccggtcgtctacctcaacgtcggtcgccgccgctactccgcacgctgctcctccgccgagtcgccgccggtgaagctgcgcatgctcgtgcccgctgaatcgcctatcggcgacgctccttcgcccgctcgccgagtcgccgtccgctcgccgagtcgcgccgcccactcgcgaagctctgcgtgctcgcccctgccgagtcgcttgccggcgctgctccttcgccggcccgccgagtcaccggctcctctacctgctcgctgccgtcctgctcgtcgaggcgagctccttcgtcggcctgctcctccgtccgggctcagcagcggcggatccggggatggggagtgctgcggcggcggatccggagatggggagggctgcggcgacggatccggcctctccctctccgccgcggacctcgccgatgccgtcgtcgccgagccacggctgctcgcagtgaaggccgacaccattgcccgccgcagatcggcagctccctcctgtctggcggcgcgacgcatctcggtggtggagagggaggtgagggcagaggcggaggtggccatggttattgcaaacggcgtcgtcagtggttgcaaacggtattcatcccattcctccctcgtcccttcaaccaaacaaaaaactgggatcgtcctattcaacaaaccaaacacacaggtggaatcgtcccaaccccaaaatcaggaatggtttcatcccatcccaccttgtcctagaaccaaacacacgctaggagaacgaacgcgtttcagactcttcgatccagtgttgtttcctcctgtagaatgtacgacggtcacagtaaatacgaatggatcaacaagcaagcgcgtgccggcgtgcgtacatgtgtacaccacttgtgcgagtcgtagtacgatttctaataagtcgcgcaagtgtacatgcgccgtgagaggatgatgagatgagaggaggcgagcgaggcgacgggttgctttcgccgcccgcgtaaatcgtatgacgccgttcactttttatttaacgtttgaccattcgttttattcaaaaaatttatgtaattatcatttattttattatgacttgattcgtcatcaaatgttttttaagcatgacataaatatttatatttacataaaaattttaaataaaatgaatggtcaaacgttggtcgaaaagtcaacggcgtcattaaaatatgtgagggagtgtaattaattaaagctagacatcttgctaaatacggcacctgcctcagaatcagataattaaacacgctcgtgaatcagaacagagacagtatgatacttcctctatttcatattattagtcattttaacctcttttattgaacttattaagtttaattaaatttatagaaaaatagagtgatatttttttacataaacgaaactaatttactattttatatgtgactatttttttctataaatataattaaaatttaaacaatttaattagaaaaacacagagaaaatatcacgtactccctccatacttgtaaaagaagtcgtttaggacaatatttaagttaaacattgggaatataaattataaataactctcaatttaatcattttttaataaatatttttatataaataagaagccaaagctgtgttttggaccgtgtcactgtataaaacgactttcgtaagtacagagggagtatacgtacgctggccaagccatttctcgtctgggtcggtcaatcgaaagagatggagacaaccgggaaatgcatgagcacgctttccgtgctcggccgcttgatagccggcgaccaacaggggtggctgtcccatttgctctctctagatggaacggcatgtcagtttacttttactactccctaggttccataattcgtgatgttttagataataacacggacttaaaaatacatacttaactataattttttaatataatatatatacaataaataaataaatttttatttttgttatagtactttgtaagataaaacaatatgtatgttgttataggttttttaaattaaatatttttaaagttattaatagtcaaagttataaaagtttaacctcaatcttatctaaaatattaagaattatggaaccagagagagtactccttttcatattttaattatttgtgagaaacacgcggggttttttggctagctccataagatagtgggctaaacgatctgggtttgaagcctcacctcttataattatttgatattaggtcatttcctaatattcacgtttttatattttaactagcatggtgacccgtgcagattgcgcggctagcatcattatattttctctcatataatagcatatatgttttctcattatattattcaaatatattaaaatgacaacataattttaaattttgcaataactttacaaaattacaaatgtgtaatattcatattgtattttatatacgtgttagttattaattatttttaatatcaaattttagttatttgtaaattatatatattcctatatagactctatgatcttcttccaatattatttatttttatttctgaatttttattatttataattgtatttttatgtggactctaaactcatatttcaatattctttaatttttaatttcgaatttcagttacttctaaattatattcctatattaactttaaactcttcttcccatttttttttcttaattttaaattttagttatttgtaaattattttttatacggactctaaactctacttttaattttattatgtttattccaaattttagttagatttaaactcttatatggactctatactctacttctaatattccttatttttttaattcccaatttctatttttttttcttaattgtatttctttatggaatctatactctacttctaatattccttatttttaattcccaattatagttatttcctaattgtatttatatatggattctatactctacttctaatattccttatttttaattctgaatttcagttgtttcctaattgtagttctatatggactctatactctactgctaatattccttatttttaattccgaatttcagttatttcctaattgtatttctatatggactctagtctcctcttctaatattccttattttttagttccgaatttcatctatttctaaattatatttccatatggactctagtctcatcttctaatattccttatattttaattccgaatttcagctattcctaaattgtatttctatatggactctactttttcttttttctccgattaatgtgagaatttctaggccatgagagtgaacgtggaggttacttataaattgtattcctatattgactttaaactcttcttcccatttttttcttaatttcaaatattagttatttgtaaattgtatttttatacggactctaatatctagttttaattttattatgtttattccaaattttagttagttttaaactcctatatggactctatactctacttttaatattccttattttttaattcccaatttctattttttttcttaattgtatttctatacggactctatactctacttctaatattccttatttttaatttcaaatttcagttatttcctaagtgtatttctatatggactctagtctcctcttctaatattccttattttttaattctgaatttcatctatttctaaattgtatttccatttggactctagtctcctcttttaatatttattattttttaattccgaatttcagatatttctaaattgtatttctatatggactctgctttttcttttttctccgattaatgtgagaatttctaggccatgagagtgaacgtggaggctcatttttctattcctttaataatataatagattacttgtgatatgctcatgtgttacaacgagatttaagaagtttgatttcatccgaaaaatatttatagccatgttttttttcttgattttgatcaaatatttatagccctgtttttttttctcgatttttctcacaatgttttcttataggtggggatgaaagtgtttttatagagaaggaatgttttttttaatacgtggagggtgggataaaaaagggaaggaaaacgaatctgcttttatactaaacgtctactttaaaaagaactttattatcttaaataatgagtaaagtatgttggcggttcttaaacttgtagggttgtgtcatatatgtccctaaactctcaaaatgcatatccaggtcccagaacttgtcaaagtgtatcatctaggtcccaaattgatacatcccctctaggatcctacgtggcgctgatgtggcaatgccacatggatgtgacgtatccttttcttttttttcttcttcttttctttttcttttccgttttcttctcattcttctttttttttcgaatcttctgcacggatcacagagaaaggagaagaaatgggaaaaaagagaagaaaaaaagaaaaaaaagaaaaaattaaatgggtcccatttgtcagtcaaaataatgccgcgtcatgtccgtgtggcatgccatatcagcgccacgtaggatcctgtaggggttatggcgatttgggacctagatgacacactatgacaagttctaggatttggatatgtattttgagagtttagggacctagatgacacacccttacaagtttaaggaccgccagtacactttactcttaaataattatactaagatgatacggttaatctaagattacttcctacctacgtaattataatgcacacatcgtatcatcattaaaaagcgaaaaaaaaaggagaacgacataataacaaatactttaggcagtaatgagctacaaccacaaacgatcttcatcctcatgctttaccgtagtgacgcttggataactgatgtaacatactcttcatgctttgatgttttatttttgttttgtttgtagtatatgagttagaaattatggtataatgtgatacttatttttgtacatactccctccgcactcacgtaaaggaagtcatttaggacaatgtttaagtcaaaccttggaaatataaatcatgaataactctaaatttgttgagttttaaaatgtaaaaattatatgaatatatttgttttgaataatactttcataaaagtatacatatatcacttttcaataaatatttttatagaaacaagaagtcaaagttgtgttttggagaccgtgtcactgttctaaacgacttcctttacgagtacgaagggattacttccataaagtagtgcacagtttggaatacttctaaacccataatagtggtcaaagtttgtactacaactcatgatatttgtttttggtttttaatatgcagcgagagtgcacggtgaaattgatttttaaggatgtttaattaaagtcttcaggatcaaaagtaggttaccttgaaagcagacatactgtgtgtgagtaatactaagagcaagtttaataatatagcccactactagctccaatttatctatagccaatctaatagctaattcatataatagttgtttactatactattaatatatggtcacacttgtcatacacacactgtgttttggagtccatgctgcagctagctacagatttatagtccgcttctcttctctctcatcttttatctcattaaaatatgtttatagctggctaatagtctgctattgtacctgctctaaagcagtagggtgcaatagtgcagatccaagcgtgcaaagccgctactttcctactatacccggtccctcctttcttttttagggtgtgtttagtgcacgctaaaattggaagtttggttaaaattgaaacgatgtgatggaaaagttgaaagtttgtgtatagaaaaattttgatgtgatgaaaaagttagaagtttaaagaaaaagttttaactaaactcggcctttgtccatgtagacaccaagtccctaattactccatgcaaattaagcgatccctaattactccatgcaaattaagtgactttttcatcatgatagtacattttccgttcaatagccataagcttattaagccgctattatagaattattagctaataacttccctaccaatattgctcctgtttgataactgcagccagtaactggttttattcagctgcaatagagttgtgcggcttttctgcagctgcactgctgcagccagcacaaacgatgaaggcccttctcgttttcttttctccatggcatagtgacatgcattttcctagtgcaatgttttctcgggtaggtgagtaaaatcgaaaatagatggttcctcggtcaccgcgttgttcatggatggttgcgcattgcatttcgaggagactctcaacaactatatttagcttaatcctacagtccagcccttgaaattggaattccttgttataaaaaagcactatcatattaatcaaagcaaatgggttttatacaatactccattcgttttttaatagatgacaccattgacttttaaacacatatttgaccattcatcttattcaaaaaattaagacgaatggtcaaacatgtaataaaaaatcaacagtatcctatgttaaaaggtgaaaagcaatcgatcttacagcatataataaggtggtgataaatagatttcgagcaaagttcatagtaccaaaaaatgactttaccctaaaatttaaaccggcccacaggtccagcccatcaaagtgctgggcccaacccccaataacctccaccaatctctttccaaatccaaaaggccccactatttttaaattattatttttcctcttctctctcatcacagctcttcttctcccccgtgcacttcactgaccgaccacctccgcctcgccgccacatcgccgccgccgccgccgccgcaggcgagctcgcgaaaccctaggcccctcccctctcctcccgcgccgcccaggcggcgaatggacccggccccctcgctcgcggcggagctctggcggccgcatcaccaccgccaccacttcgaggcgtcgtccgtcgtcaccgaccaggggagcggaagccgcggcggaggaggaagcgggcgcaggaggccgcggagcgacgcggggcccgaggacgacgacttgtccaaggtcgtctccacctccgccgcctccggcggcggcggcggcggcgggcaggactcggtaaggccgtgggggaaccgcattgggcgcgatctgtgttggggttggtgggtttcggggttgggggttgcaaagcaaggggggaagctgtggaatcgtggtttttgatggccctgttcgccgtgatctgcttgtccatgtggatgcacatgcgctgctgctactgtagctatggcagtagcagcgtggggagcagtttagcttcagtgcttgagcagcgccaaacctagttaacacagatcaaaatcttccaaatgccaagtccatgccagtgtccaatactgataaatgattttgaaatgctcaatactggtcagtgccttgtagagtgggaatcagatatgcgggcatgtcagttcatttgggttcattggcatcctagccttagtctaggatgttgctaactttctgaagctgtagcatgacagttgaagtatgaatttattttgttggtgcttgagcctttgcatattcaaagctgtcatatattgatggcaccatcactccatcagaccttgggtaattcaagcatattgttagtttagttgagacactgtatttgctggactgttccgttgttccttgggttagtcacacatcaccaaaacgatttcgggagtatatgtgatgttgttctttttgtcatttcaagaacttgtagttgacccgcaaattagtgctgcttaatttataaaaccttgaattctttgtactgtacaaatcctccgtttcttatttatgattgaatttcatttgtattttaaaaatgtaaagtaaatttataggtggttcacttcagtgtggatgatatatctggatacttgtgtttatacttcatcgactatctacatggatattcaaatcaactgaaagtcaccaccctactttccaggatgctccagaagcaaaacgtttgaaaccaatgaaatctagtgataagaatgatagtttaaggacagaagctggaaccgattcaggaaacagcagtaaggctgctgataaaaatgctacaccaccagagccaccaaaacaagactacattcatgtgagggcaagaagaggtcaagcaaccgatagccatagccttgcggagcgggtaagctcttacacaatattttttttccctaattttcggttttcattttaactatacaagttataatattctctcacaagattataacagagtgacaaccaactcatcacagaaaatgtaatgttcagatattgctcaaggtggattgcgggtagtaacatgataatcatatcagcttaatatttgtttattgacaggcacggcgagagaagataagtgaacggatgaaaattcttcaagatcttgtccctggatgcaataaggtgcactttgaataccatcatgttttcaagtttttgttactttaaagctctttgttctctcaaaattctattatgagtaaatggttctcttttataatatttacttttcaattcctcaggtcattgggaaagcatcagtccttgatgaaataataaattacatccagtctttacagcatcaagttgaggtattacattttctcaatcatgcttggcatggagttgtcttctagtttatgtttaagtacctaattgagctgtttctgcagtttttgtccatgaagcttgaagcagttaatagtcacatgattaacggaattgttgcttttccatctaaagatgtaagtttagttttgaacaactatttattgagcttacaagattcttgattattatctcagcttcagctcttaacatttcaaattgacctgacttgtttgctgagcttattattttactcagtgtgtatttgtttcctgaatctccattttacgctctacatttacattattttcaattcattggacatggagcaattaaaatgttatggattaagtctacttttcatccttaaactcttattttgtccaattttcatccctcaactctaaatgaaagtagacaataccatcctttggaaacaaatggcttgagagatcagtattttctactgatgtttcagttacatagatgattgcacaggaatcttgttttgcacatagatataactttcaacatgcaaaacaattcatagacttttaaaacggctttgctaagttactggatcttttctaatggtgatgaataatatctatacttgcaaataatgacaggtcacctcctgtctaggccaaatgacacattgtttatgtagcatttgttcctcctgaaatgaggtcttaaaatgttcatacagggttcaaaaagattaactagtgcctgtggtcttgcagtttggtgctcagccatataacacagctgctggtttgacatttgatccacaaacaacaagggaatttgcccagggttcaacatcagagtggcttcacatgcagattggaaatgcatatgaaagagtgacatgaataaagcaagcaaaaccataaaacataattccttgtagtggcaataaagtgtactgggatcgatcaagcctgtggtcctaggattatttttttttctcaacaatttcttctcattatcatgtcaccaagttatttttttgttcctaatttggtccatgatgccatagatacattcatcttgacctgttgatactcaacggtctatctgctttgcttgtatcccatggtctttgtagctcggatttgaatagggaaagaagaggatgaaaaaaaaaaacagttgtattgcatagcttgagcctacagttgtactaagagctgccatcctggcgtgtcgggggggaacaacttttatttctttgcaaggactggcttgtcgatttttcggaatatgtcctataatatgcttttggttttattgcgggagttgcatatgaatattcgacacctaactacctaagttttctgccaggttcatacgaaagatcaaaatcatgacaggattgcaaagtaaagtcccttttctccatattggtttcctttctttttgactaaaatgaaatgggcatctatacatgtcattttcgttggcgctgcacgcctgcacctgtttttcctgatggaaattcaaaggaagagacagccatgatggatccaatatctgaatttcgtggaccttgcaacgatattgtgcccatgtacagtccaaatcttgatgtggcgaactgcaggttcaggacccctaaactgatgcttttatagctgtgttaccactttgcagctcagaagatcagagttgcagcttgtgattctggggcagttctctgtaccctttgaaccaaccagcgttttatttgggttgacacactgcaaaggcaaaatgttaattaccaactgatataaggaaacatatactgtgcacacacatttctcatacacatcaactaattaaatgtcaccgaaaaatctataaaattttatgcatatactttcgatggtattacacatgcgtgtaaaatcttaacctcaaattctttatattttagccgtaaaataaaaaaagcaatctggctgctttaaggctataactctattagaattttgtatttttttctctttatgtaggatgaatttgaataagatactttacacgtagatgtactattgttgaagtacatatacaattttttctagaatttttagtgatattgtttgttaattggtgtgtatggtgtgtacgcgtgaagatttaagtgcacaggatacattccctacataattttggatgtgtgtatgcaggagactactttttgaggctacgagcttttcctgagacaaagttaggttagaataagcattagaggctaagactagagaaactgacattaagttagttattagtctatcgatcgagagggttagatgcaatactaatttgtttgtgatacggagaatatagaaactactatctttgttctaaaataagtttatttttcattcatgctatacatataataaaaaatagaatatccacactttattaaatttcaattattatttctctatttatctactcttaacatatttatttatcctctacttttacacgctctgatgtaatgataacttagaaataaacttattttatgatagatgagagtagctaaaagtaaacttattatgatatgaagggagtacaaataatgttagcattgggactaaggtggaaaataactcaaaactcatgagctaactcgacgtgcgtacttagcttgcttgactggacttggttgcttaagtgcttaaccagccagctcaagcttactcgcgaattaattgcttcatttgtgttagtatcacctctatcctaaaatataatatattttgattagatgggacacgtcctaataccacaaatctgaatagtactaggatgtgtcatgtttaacaaaaatcccttatattttggaacggatggactaatgtgttgaattacaaaccattgtttatatgctgcaaatgtaccataaggtcatgatttcctatcataagttcataattgtccatggcaactcaattttgtgagtcatgatacataacatgagccatagctcttaatatatgagcctacgggggggtgattggttggttgcctcactttgctacaccacactttaatcatatcatagtttcttatgtatgtgtttgtttcgctactacaattgtgttatgccatacttttttactcttgggatccacatgttatactctcaaatttataaccgaaccatatcacacttatggccaattatttcttagccacactatgtccctatcctacaactcgcctaatcttagttacgataagtttaggcatcaaccaaacagcccctaaatataccacataaaaatttaaaaccatgtaataatgagttcaacggcctatgaggttgtgtatttaaaatgtgaaaggtaccattttttttccttttaacagctgcgtgaggttgtgcatattatcggtttggtccatcaaaggagggatgagggagccatgcctagatagatgggtttatttgcttcttgggttaatttcgacctctttttcatatttttttttgtcatacccatgcgttgcatatactttttttaaaaaaaagtcttgagtttctttttaacttgttacattaacaagtcaagtactcaagtggagaagctcattaacttaattgagtttctacgagtcaaaggctcttttcaaatctactccctccgtccaaaaaaaaactctcgtactgtatgttgacatattctagtactacaaatctatacctgagtatgagtatgtcaacatctagtatgcggtttagttttttagggtagagagagtaagggtgtgtttaaatcaatggttaaaaactccttttctccatggaaaataaggtagctcattaacgcatgattaattaagtattagttaaaaaacttaaaaaatagattactatgatttttttaaagcaatttttctatatttttttaaaaaataaacacattatttagcagcgggaaacatgcacgtagaagatgatggagtagaagttgaaaaagtgtaattccaaacacaactcacataggatttagctactagcctactatcttattatcttatttttgcatgctatgttcccttgactggtattattttgtaatttttttataaaagtttttttaaaaaacaaattgaataaatatattttttatatctgttggtgatatgacatgagacccttcgaccagacctgccgaaaccatgcaaccagtgagggttcaagcccgagacgtcaagatcgttggggcgaagcccccacagcgaagactatgaagcaaagagggcgaagggcggagaatcgcgctagtacttcacaaggataaaggcatcttgggcgaatactataaggcgaagagtatatgacgaaggagggtgacttcgccataacgagttcggcttcgagaaggctcaggaggctatcccagcctctcaagcctggtggccattgggccaacattcgccagacggcccattagaaacccatgtacctcaattaaactgtatacccatgtaaatgtccctttcataaggcaactatgtaaattcacatgtataacctaaaccctagtagtaagaacctgtaatggggctataaatagccccctagggccatgtaatagggggaaccgaagaaaatttctcaatttaatacactttactattttccaaccactgttgagtaaccacgtcttccgatgtatgcggttgtcgtttcgacaacaatatctataataataaatactttattaaccgtacgttaataaatttctatagttaaacgtaatatctttagttgagttaatttgttagctactcattccgtcacataaaaaaccaacatagtactggaagtgacatatttcagtactacgaatctagacataactttttttagattcgttgtatgtaccacatccaattctaagtttatttttttggatggagggagtatcatgtacgtacaatcatacatatgcattaccacattagtatccaaatccctgcctaggaataattaactatttgtcacttttgcaagtggtgataaatgatttgccagttgatctacatatcatagatacatgaggactcacgagccatagactactagtggtaataaatcattaattaccaattctaaaaagtgacaaaaaaaaaaggttaaatgtcccccttgcccaacctgaccgggggagacacgcccggacgcccgcggtggccggtgccgtccgagtccggttcgggcgcttgctttccacgagtctagtctacgacggcgacccgcccgaccccgtggttgcgaattttaccgtattgcccctctccctctccatcccctacgcggaatcccacttttacccctcctcctccactccccct

SEQ ID NO: 43891 - DNA, 7073 bp, Oryza sativa
  unsure (1)..(7073): unsure at all n locations
ggtccactgtgcccggcagcttacctgctgctggtttagctttcgtaggttgagcttggaagaagctagggttagggtttgattgggctgttgcgctgttttcttcgtggttgcaggtgtaccgccctttgctgaacatctcgggggagttcacggcggaggacctcgaggaggcgcttatcactcccaatagtactctagatgatgtgcacatgccactcctaaaggtgagtgagccctcgggctgttaagttcatgtcgaatttgttgctgctctataggctggaatactctgtctgtagttctacctccacgtggttcattggttcatcatcagagagaggatagaagttgtgtccttgtgcttgcaagaagtaataattataatttttttgggttctttgtgactttgagttttagcgctgttgccagttatagtgacgtttttgctgatttttacatttaatgtatgagaaaatgccataatagcagctacatgttgttcttgggcttatgcttactctgccataactcgaatatacctcgttaacatttctgtgtatatttgtatttgatcatgttgtttgtaactcctattttgatgtcttcttagacaatacacgctattcgattagagctatcagatagactctgcattatgcatctgtatgttagtagatattttatgctcaaataaaaatgtaatagtatgtgaaagttctccatggaatctcatgatttttattgcacacgcagtcaattcctccagtaacccgcatggctatgggacgtggaacctgggtgaccgtcctatgtagaaagctaagggattggtggcattgggtatatgattaatattctatgtttcagacaactttgataaataatggttgcagattccattcaattggtgaggtattaactgtctgaactgcaggttgcagaaggtgatataccaattgttgcatcacatgggttagtttagctcacaagaaatcattgtgtaatctcctgctacaaatgtatatttttttcctcagcattgttttcccaactgtttcatcttccacagaactgaaattgaagcatacaaggttctagaaccggcgactcgtttaattatcttgaaagcaatatgcgatatacgtgtcgaggtacgtgcttatttttcttgtcctttcctagtataaaaccgaaggaagtttgtctaaatgacttgattttttgaaattttctaatacgcgctgtagtatattgttataatcatgttgacattcttctgaataaaatctcatcccttgtcatttgtatcccgttatcccacattcgtgtccttgcaatgttgaaaacaacacttgaatatgatgactggtatttcatccactaatccgcttctgcataatattgttgaaacattttcatcgacctgtacaattctggtgccaaaggaaattcttcatcaattcattaaaaagggaacaataataccctttgtctattcctgcatatgaacctgccagaagttaaagatacattgttgctaaacgattattcctttgaaaaatgaaagcagctgttacttttctatgatgtgcattctgtgtaagggataactactagttccaattaaaattgtagaatttctttttcaagatacacttcctcttttatacatatgtgtaggatattgcctattgtccctttctccttgcacaactgtagagtagaggattctgcattaaccctgatgcttcatagtagaaaaataaaattgaagatgatttgaactacttcctgaagtttaataaaaatacatgcttgatagttgatagtgaacacataatttgcctgctctcttgggcaattaaataaagtggagcaagagaggcatgagcacaagtctgttgaaatcttaactcaccaaggtatgcaaaaatattaaaattttatatgtgaaaaaaacagaggtactatctgcaggggacatgctcgtaatagctaggttgggattattgttgttttggatatatctggaaaaaagagagaggcaattttaggttttgaatcgcatgagcttaactagatgactgattcttaagcatatattttgcagcaagaggatatccggaatttcattgacagttccctaaagcatggctatgacctttctacctttcgtaaagaacgaatagggggtgatgcctatggaatctcatactggtgggtattttttcctagttgctatttttgaatggactgtcctggaagtttcttgttccgatcccattaaggggtgtgctgatcaagtctttcagaacaggtatgaagatgatccgattctcgggcatagattatatcgtgaaattagacgagtggaacagctgaagaaagagccaggaaaaagatctagggggaaaggagggtctataattcttccagttgtgtcctaccagtgggaaactgtcgcatccaactttgacgagtttgatgatgttgcagtaagttgagttcctcatatgtggtgtagaaagtgagttgtagtgtttttcctgaagacttatctttcgacaagggtaaaatgctatgtaacctcaagtgtaaaatgagcatcgttattagaaaaaatgaggcaagagtaaatgctccactatcttataatatggatatcttaacttgcacagggttatagcctatatgattaacttggttacctacacaccagccatgagaattaagtatgtaattcgaaatataaatttgtaatctcgtcaaattgaattaaaaaaaatctagtaaggcatttactggtaagaatacaaaaaattggaactccatgtttatccaggtaatctggctgcatgtggtaaccagtcaggccaagtgcctaggtttctttggtaaactggcttttgaaacctttgcttatatgcatcttttcattctcccatactgtgctgccatctagtgtttaatggttgatcacatgttttcaaaagtatgttgatagtagatagtggtgtaaccaagtcgacttaattataatccccaaccaatagattagtacctaaataatgttcaaaaactttcttgggtcagaacggagttcatttggaataagtgctgatatgaaccattcaactaaagctactttggactgttattgttaaccttgtggcttgtgcttatatttattaagtgtagtgacatctaatgatattatatacttctgccttaggaaaaactcttttcaagtcggaacaggacagaggccaaccttggcaagaagttgaagattgaatatcttccagatattgaaaagatacataaagtatgtagcgtgtttaacccagcctgttttgccagtgaaagctgtttcaagcttgttaattaatgatttacctattttcttattgcagaagaaggagaggttgctcaaaaagcaacaaagagaagcccttctcattgatagcttcttggctccagatggatttaccactggtcgctctcttcgtgatagaaagccagtaacatacacttttggtaagcaccaagagtctaaggctgaacctcggtatagttatgaagatatcccagaatggaaataccatcggtgtggttctgtcatgtggtccagaggtccccacttgtcagtctcatgctagatggtattatccaatcatatatctttgtgatgctactttgttaatttttctttattttgatagcagcgatgctttgttgcaaatgcttcacaattattaaactctctcatttatttccttcacattttagatatccaggtgatctacgtcacttgctcactgttttatttccctacgcattgatatatgccagtaaaaagtcttatttattctcagcagcaaattactgatggaattataacataactcctgaaaattttaaattgaagtgaatctatgttggctagtttaatacagatttatctgacttccagctgtaagataatatagtcagtaaacttccaaaataaaggctgattgttaaatagaggttgctaattgatagccagtaccatgtggtggaactgatctagcttccacattttgcattcactatctatcattcctccattcatgtccatgacaactggagtatgttatatctatttcattacttctgttcagttaacttcattgattcaaattaaatgttttgactctacgtatggtgcagatgaatatgaccgctcaataagtgaggccataaaaataacgaagtaggtggatcgcatctattgctcagtaattttcacttggaataaaaaaaacttttttagagacaccaacagtttagcatacttatgtgcccctttcatgtgcaggaaaggagaaaactctgctgagcctgctgctccagccaatagaaggatccttacgccaagaccggaggcatcgagcaatggcaaggtgaatggcctctcaccgactaccaatgaatatgatggaaattcttcaaagtcagatgactaccgagatagtgatggtgaagaagaaagtgagacacttgatcggaggtacatctttcatagcatttggcatttatcacttgccccattggaatatatgtgttgatgagcatccatggtttgtattgtagcaaccgccggaggaggagatctcagagatatacacgggactttgtcgaggctgtctcagatattgacccgaactttgacagtgacgatgaaatcatgggggaggcagtctatgatgaggaatatctgagaactcgaaaacagcagaagacatcaagtgcttctgaagaggatgaagagttccgatatagacacgaagncantgnnaactgggnaatagaagagagaagagagaatattctttgaggataccagtggagagatttagnnanggaggccacnnanacagacgcnaaaagaaactgcaanaactcgtggcnncggcgaggggccaagcttagatctgttgatgaaatccaaacaggtcttaggcgcagcaagcgttcttctcgtcaacgcattaattaccaacagtatgattattcggacacagacacagagggaggaaaggaaggaaaatccgatgcatcagatcctgatgctggttttgatgcagaaaatgatacggaactctcgacatcgagtcaagagcaagaggaagatgaggatgatggccctgaggaacaaaaggacaatagcgacgacaataaaatggatgaggatcatgtaatggtggaaaataaagaagagcaggaggagcagccgcagccacctccactgccaccacagcagcctgtggaaaaaatggaagctcctagtagagagattgaaactgtagggagaacatttctagatttaaatgagcttgcacctggaggtggctttgacgatgggccaagcctgactatgaaagatgaggatatggataacagttaggaaataagttttgtaatacaatcgagtttagtaggcgctgcttggagcaaggtgtaactgcgtgaagtcgtgggccattgccatagatgaatggtccactagtaagatgacacagcaatatctgaacagttttagatgattgctgttacatcgatttacagtgacaaaagaggcgaggttccaccgaggttgtggtgaaaagagcttcaaatgtaacagattgcttgtttgatacttgggggccatccaaagggagtttttcattctattgttgtacactacacgaagggcgcgcatcggtcgctgctgtattatgtccagactgattgatgctgtgttgctgccagatacaaacttgtagcctccatttgtttagctctaggcgcgatactgttgtcgggaaattcttgcaacattcatatggtggaaacttgtaatacacctaagtgctgctcttctcggcatttcttacggctatattccacttgtagaatgtagtttttgagtctaagtaaggcctgtagctcttgtatttatatctgtcaacctgattagattggtacatctgtgtgcagttgatgacctgatactactgagctagtaggatttctccagctaagggtggtttgtttggaagtcgcctttgcgtttatttctgcctgagaagaacggaagatgcagctgaagactctttggagtttgggattaccttcccaagggatttctagagattcttgtttggattccgaaaatttttcatattcgtacactaactaaatagtttcctacaatactcctgtgaaattcccttgtttcaaacggatatataaatttattccttctaattctgaccacatagacaaacaattaataataattatatattattaaaaattgaagatgtttccgtggcctgtcattcgtgtttgagtcggttataaaaattaaagatgttttcgcggttcgtcatctgtgtttaagtcggttttaatctaatgttttggttttaatctatatctcttctcttctatatctatactattataaaaattgaaaatgtttttattatattttggtacgtcatctgtatatgagtcggtttttaagttcgtttgtttgtttttggaaatacaggagcaagcttgtagtaattttgcaagcatacggtatactgcttcgcgcggaacaaatggaggaaacacacacgcacacacaacagaacataagcaagaacaagcaaatcatgggtgaatcaaacatatttacgatggagcttgcacacacacacaagctagcagtaccggaaatcagtgataaatggatggaaagatggagaagaatgtagacttcttgttagctgccgttcttttgctttagttcgacatccgtgtatgagtcggtttttaaattggaaatacatatctgtatttgagtcggtttttaagattgttcacttttggtaatacataaggaatcatataagaaatctgttaaaatatctcacatgctaacttgagacgatcggactcctaactgcagctcatgattttcttaaaaatatatatatccaaacgaactcccacagagcatttcatcttaattaaaccatataacaataata

SEQ ID NO: 43892 - DNA, 24446 bp, Oryza sativa
  unsure (1)..(24446): unsure at all n locations
agctttcaaagtttgttttaaaatataacagaacttttctactaacattttcttcctaaacaaatataaccatacatcattcaattttttaacgtaacttcacttcttatccaatcacactccttttcatttaattttatatattttcttaataaccgtaatagaggttgtagttcattgctcaatttcatcaggaaacaatcacattttcaaagaatgtgacaaaaacagtcacgaaaaatattacctctatcccaaaatacttgtcattttgagtttttgtttgtaacatttgactattcgtcttatacaaaagattatggaattattatttattttgtttgtgacttgctttattgtttgctcattcatcctttttaatattttattttatttaatatttttatttattttattttgtttgtaacattattcatccttttgaatattttctctaactttttaaataagacgaatggtcaaatattgtaagaaaaaaagtcaaaacgacatctaatttgggacggaggtaatattaatactagtatcaaccgcaattattgagcagctgatactaatacacttaattaatcacaaaatactactctatccattccaaaatataaggcacaaccactcttaacccaaagactaagaaataattattatcatctcatagtctggattaccctaataaatagaatgcatgcaaccaataaaattagatatctgatgatgaacgatgtaaataatacggagtaatattttagtggaaacgatatgatagttaatgatatgtatgcacgccttatattatgaaataactttaaaaagtagttgtgccttatattatggaatgaagagagtactcaaatatgttgggattaattgcttttgtgatttttaattggtcataatggcacgtagaagttagaacacctccttgcccagtatgtgtcacgacggcccggagtgcaggctccgatggtgatgaccaggtacgccggccaccgctccgtggggagggcggtgaggtagacggaggtcatgagggagacgatcatggcgaggcaggcggtggctccacgtgagcttgaacttgacgggatccctccacccccagatgaagcagaagacgaccacgatggagctgcacatggcggcggtgtgggacacgacgaagttgcgacaaaccaacaaagaattaaaccataactaattgggaaatctaaatatcgagagcgttcttggttttgccttattgcgcaacacatccgacagccgtcgagattgctacctggtgatcgatcgccaggagcgatcaggattcgatccctccttccctccacccgatttcctttcttggcaccgtattacttttctattttagtaaatttatacaccttaaatttacatagtttagagacccaaagtttataaatcaaaattttatatatccgattcaaattttataaatcaaaattttatatatccgattcaaatttgaatttgaattcaaatattttttatatatagtatttctatacatctaaagtttatacacctaaagtttatagacctaaagtttataagtcaaaagtttacatacccgattcaaatttgaatttggattcaaatattttttatatatagtatttctatacatctaaagtttatacagtttatagactcaaagtttataagtcaaaagtttacatacccgatttaaatttgaatttaaattcaaatattagtttatagaccaaagtttataggtcaaaagtttacatacccgttttaaatttgaatttaaatttaaattttttatatatagtatttctatacataatttttttcaactttgtgttttttattttttaaaaatttatggtgtagtaagaagagaagaagggaaatagaaaggaagagagtacctatataggggatgagcgatcatccgcccattagccgcccccgacagccgtccatccgcgtctacgtgctatcgaaaagacaagaagccttccacttcaatggcatcaaagcgaggaacctgcacaccaccaaccatcaaaattaaagataggttacactatcctaatctttctttttaacaatacatttgatgacttatatattttaaaccatacattatttttcactttcatttgtaccattattctctactcaaaaaatacgataaaacgagtctaacattaaatatattcaaatatttaaattaatttacttaaatcgtagaaataagttagttctgcaacagaagtaactacctatagcattaaaagtagttatacttatgttgatgcgaaaaacacacattgggtctgggagaactgcttagctccagtgcaggtccaaatcttgatgaggtgtgggcgtgctagtcagtttgatccagtaactgataagatatgtaaacagcagagccgatcggctgtcaagccgatggagtagttctagccgatgccgatgccgatgccagccgatagcgatagggttttgagctatcggcaatatgtccagtgtaaataatgatataaaggcagtcagctggtgataataagatataaaaataatataatccagtagaaatcaatcggctaacaatatgatatgatataacaagtactaatcctatggtcaaagcatacaatattagataaatcaatgaaacctttgttgccatcggctaaatccaacttatatgtatatgcaatccttataagccgatgcaacgtccagataacttatcggctagcaccccgataaaacattagcatgaacctatcggcttaacaagatttatattatcaacaaaaatctagtaggtcgaacttaaccgatgcagcatgagattgtatatgataatctaatactcgatgagccaatagatctgtctaatgtgatggatataacaaatctatttacaacaacattgtgattgtagagatatatcggctaagacagaagatcggatctaaccgagacagttccaactaaaccgatgcttctctaaacacaatgcaattatagatagaattgagatatcaggtaggcaaatatatcaaccaaaccagagcgatccaagagatcgaagcgatgtagccttgaacaacactaacgtagccgatagattcaccagggccggcggaacgtaggatttatcccttcgctggagatcgaaccatcaacagaactgaaccgatgcagccccatgtcaggtgccaaattacgccggttgataagtaaaaccacagaaaagagggtggcgatgctccgagagtagttgtattgatcgagagatattttacagtgaccccaggtgtacatatttatacccatagggagatactagtccttgtcgaacaagaaagaaacttttctaaagataaaaggaaaacataaagtccttattggacactaaatacattttcctaaagataaaaggaaactaacaaatactgcctaattaatagataaactgccatgccgcatcctccttgaactcggtcacttctggataaactttctttaatagattaattttcttaatcgaatataacaagaatccggctattggcgacttgataattctcattggccgattccaggactctaaagccgatactgactttaggccgataataacttcgggcttaccaaattttggcgttaacaactgaccgattagttgatgatagctgagatacgaaaacgtgtatgttgtactgaccaagagacagagaaatgagaccacttaccaggaaaaaaggataacatattatctgttagttatcatgtgattcacgtcaagtgcatgttgctgaggctaagatgtcgttacactactatattttcttttttcttatagaatctatgatgacctatattttttagactctatattattttaaagatccacttgaaccatcatactctacttaaaatatgtgataaaataagtctaatatcaaatatatttaagttatttattttttaactctaaaagcatagttacttccaataatgtgaagagttacttccttacagcaatatagttacttctaggcaaaatttgttacagacatccaaaaaaacatgtaattagccgagggatatcgtaagatcgtgaaacggctaagagacactctaaaaaatgtgtaattagctgttggacactttcaccattattttattatttttgggctgaatggagagagaaacaattcaaaaggaccagattaccctcagggctgacaggcagacatagctttgagggaggtggcgacgacttccacggcaatggccttgaccggtggcgaacaatagcggaaggcggtggactctcaagccatgtcgctgaacaacaacgagtagttgtcgtctgcggtggtgacgagcaccggcatgcattcgatgatgatggctccctcgatgcaatggatcaccacggtcgtgcgctcgtgcccgctatgcgtgctgctgctggtgcaggtcacacactggcccaatggcgataaggaacttcttcacaggcgagacgtgaaatacagcctcactaaggcgcttgtggcgttctacccgttcgccggccagcttggcgtcgatggagctggccacatccaaatcgactataccggtgagggtttgtgccgtgccgcgccacgccgtgagctacacgacttgttcgccgacgccagacttgccatgcgtgctgaactgctgatgctggttcaggtcatgtacctccgaggctccgatgtggcggcgtagtgctcagcctggcgagcattgcccgtgcctccgccgaggcgctgttgccgccgacggagacgccgcacctgtatcgggactcggatgtgcttcgaccacaagctgctcaccacatgtgccacgtgtattatgctaggtcgctaggaccactcaagcagcgccgctggcatatgcggtgatcacgttaagcaagcagcagctagcaaccagcaggtgcaagcaaatcatcatcatgctaaacaagcagcaggaacaagggtgaagaagtgaaaaaagagaagggcaaaattggcacttcacatgacttctctctcctcaacccgatgtatatattattttattgcttatagtgtccactagcaaattacaccttctttgagtgtcttttagccgtttcacaatcttgttatattccttagctaattacacattttttgaatgtcctgtagcaaattttgcccttctaacgccatgtggagttaattcgctacagtacaattacttctaatatcttgaagaattatttctatttctatttatatttacttccctctaggagtgtatttccttttaatattacgaagagtgacttctatttctttaaaagttacttccctccggtagtgcaattatttttaatatcgtgaagagttattttctatatgacgcaagattttattttttaaaaaataatatagtgattactttaaataaatactatgtatttacttgaaaatcttctctacacttatggatttactccacttaatttcttattttcaactcgtcgtaatgtaattacgtctaatgctataaagagttaattctattgtatagctaagttatttttatgatttaataaattacttttagattaaattgaattatatttaaaattgaatcttttttgtcacatattttgagcgaagtacaatggtgaaaaagatcttaaaaataatatacggtttaaaacatataagtcatcaaatagatttaaaagaaagatacgtcagtgaccaatctatataagtgcttgttgctattttaaggtggtaaaggaggatttatacgtcacgtgggatgaagttgtctgtggtttagccaaaccagcgaccgtgcacagtgtaatcgtgtccataactaatatagatacatgtgctcatagctatcctatctttctataaagttaaggcccactaaattctaaagttcaacatgcgaatatatcacatcatccactaataattatgacatctcaaatctcatgcaagcatgctaatttattaacttccagagctttaaaatgtaaacatgttaattaaattatcaacccacataatcacataatatttcaatatatatctctattatttttttataatatcctctgtatagttcatcctcacttaaattttagagctttaaaaatccaagcatgttaaatcatcattctacataattcccaatatatttcgatatatttttccataattttttataatatctatattactacacaattcatcctcacctaattaatgttacttctctcttctctcattaagccataccacctcaattgtttctaaccatcaaatgattaacctacggtgggaattatctctctcattttcttatctcataaagccacattatattacttttacatttagatcatcattttatatactatttaaattatgataaaccacatcaacttatacaagtttctatatatcgtctaactgtcttacatattatttctatttattattatcataccaaacttctgcagcaacgcgtaggggtttcatctagtatttattatttttgttacaacttgtatgagtcaaaccgtgtattatttgtcaaattttcgtgtaactgtgacatgtaagaaataaggtgacatcgatctgtcgagtgattgcatgagtcccattaattaattcctatatctgtatgtctccattactgttgtgagacttgacgtcaaccggtagcagtgtcttctgaacaaacggtatgtagaaagcctccttccctaatatgagtatcacgacgaccggagtgcaggcgccgatggtgatcaccaggtacgccggccacctcttggtagacggaggtcatgagggagacgatcatggcaaggcaggctatgacggtgagcatgtgtnnnnnnnnnnnnnnnnnnnnnnnnnnnttgacggggtcgcgccacgcccagatgaagcagaagacgacggtgatggagctgcacatggcgacggtgttggagacaaggaagatgtcgaacgccgcgcggtcggcgtggatggcgaggccggaggtctggttgtagccgccgggcatggtgaaggtggcggcgaaggtgacggtggcgatgagagtggccacgagggtgtaggtgccgacgccgagctcgaagtagtcaccgttgccggagccagctgacctgtggctgcgcctgcgcagcgactggtacgtcgccaccggcgggaggtgctgcaggttcttgcaccgggactcctcttgcttcttgagcttctcccagaggtagacgacgtaggcgtccatctcgccgacggcgagacgctcctcgacgaggctgcgcgcggtgtggccgtcccggttgaggaggcaggggttgacgcgggggtccttgagcagcgtcagcgttgactggacgtgcgccatcttggcggcgaggtgcagcggcgtgttgccggcgctgtccccctggttgatcacctccgccgggccgatcaccttgaggaggcccctgagcgtgtccacattggacacggcgacatggaccgcgttcctcccgtccttgtccttactctccgccgcatcggggctgtgctgcagtatctccgtcgccgccgcgatcgagccgtttacggcggcgacgtgcagcgccgactgctgccggtcgttgggccggctggccagttcaggcttgaggtcgagcagcatactcaccatgcgcgtgtcgttcttctgcgcggcgtagtgcagcgccgtgctgccggccgagtccgtgatgtcgatcagatccggcgccgtccttatcagcaatatctccaccacccctgctccacatgtgtgtatatatatatatccaaggcttaaattttctccaagtttggtttaaattcagcatttgtttgttcacatgtatgcatgaggatcacaatgccaaataaaaccacacattttctaaaagaagctaacccgggaaaagaagaatatatattaaggcctcctttgaacggtaaattaaaaaatgggggaaaaaacgtaggaataagatatcctattgaaatgttcactgttcattcatttggcttgcgcagaattggagcagacgagaagcatacgaaaatttccttcccctatgttaattttcaaaaggaatttcacagttttgctaaaaaaaggaatttcattggagaaaaaaaggcctaaaaagctatttttctattcctaccgtagaatcgaggcaagtactcaggccccgtttggcacagctccagctctcaactccaacttacctggaactggagttgtgccaaacattccagatcctccgtttttaggagcggagttgggagagctgctccacaaaattatactacggggtggagctgggtttttactgctccacagctccactccaccccaaaagacccactgccctttaattttttagtgtatttacataaaaatgccattaaactacacctacccacctcctctcctcccgttctctctcctcccccatctttctcccgagtcccaatagctgcggcgggcggtggtgggcggcgtcggccacgacggcggaggaggaagagggattgggggcgatggcgtcggttgccgcggtggagggcgtggcggtggcactccggtcggtgctatcccgcggcgggacgacgcgcgggcggcgggcggcgagctagcaggcggcggcggcggcggcaggcacacggcggtagcagggcgacaggacgacacgcgggcggtggtcagcgagctagcgggcagcggccgtcgggcagtgggcggcacgcgctgcgacgacgcgcgggaggcgtccggccggcggcgggcggggcacgcggtgacgacgcgcgggaggcgccggccatcgacgggcggggcacgcggcgacgacgcgccaccgtcggcgggcgacgccctgggattgggctgccggcggctaggtttccttttttttttcaactctttttgcaatttattttttttttcaattttttttcagatctagagctgaaaactagccaaacacttctcaacgagtctccaactccaataagagctagctcccactagagtaggagtttggagttaggagttggagtttgaagccctaccaaacggggcctcaatgtagacatcccttttagagtaaaatttcataaaactctaagttctgaggcatttgtaacgtaaatccctaggtattgcaatttgtttcattaaaccctgagttttgaggcaaaaatgttacgtagaatcctgattacaagcttatatcgtctgtttgacaaatatatttattcatattaatggtaataaaatttcttttaagtacatatacacattagctggtacatttttaacaagtgttggttatcgatagtttgattatttgtgtgtattaactagttaatgtgtcattatcggtagggaattatgttgagctttttcaatagtgtaatgcaaaaagtgagaaataaaataaagtacataagagggacttgtactttgaatctactaatatgaatttgttttgcaaatatcatgtataacaatggaatatgagctttttttttacataaatatggggcatcttgaaatattttgccctaaaatatgggatttttgaaacaaatccaatatatgggctattacgttacggatatctcgaaaccttgggctttatgaaatttagtgattttactaattactccactaacattattaacaactattaccttttaattctaaggcaaataaattttctttattattatataagccaatagattacatcaactatgtccaaacaaacttgagcaccttataaaaaagagtaaatttaatagaatcctaggttttggggcatgcataacgtaaaatcccatgtattacgatttgtttcacgaagccttatgttttgaggcaaaatgttttaatgaaccctacgttcaagcttacattgtctatttggctaatatatttatgcataataaattgtgaaaaaatagtatgtggtatttttaagtgtacatacacagtagccactgtttcaacatatgtgagttatgaatagtataaccttttttttaattaggcaactagttgacctaccatttatattgaggattgtgttgactttttgcaatcatgcatagtgggtgaggaaatagataaactggggtgggagggatgcacattttgagcacacttagaacatataatttaaagtactatatattatatgtaaaatgagtaatttacataaatggggttccttgaaatattttgtcccaaaatgttgggtttcttgaaataaatcacaatattttgggttttgcgttacacatgcctcgaaaccttaggttttgtgaaatttactctttaaaatatatatagtgtacatattatgttttagattctaaatggtaaatttagaataaaatctaaattgtattttttaaaaataaaatcagaataaaatgcaattttcaaatcagatatgaaaacatcagcatagagacaaaaaaaagccaatttgtactttttaaattaaatttctgcagaagagtttttgtgatgcttgatgtttgaatgtattttcgggtggtttcatatactgtcacaactttgaaattaaattggtatgcatgtctccattactccatataaaacaaattagcaccataatttctagctagcatgtgtgcatgcctacatgcatgcattattaagtttggaagggtaattatgacatttaatcatatttcctcatatgctgtgatatattaatatcaatgagaaaatatttttgtttcgaaaaaaaatgaataatcaactgttaaaatctattgtatcatcttagctctttggaggtaagaaggagcaccataaaaggatctttgctcgtgaaatgcttcgagttgcatggattaaactacaagtatgagttttatcgctaacttatactccctccgtttcacaatgtaagtcattttagtattttccacattcatattgatgttaatgaatctagacatatatatctatttagattcattaatatcaatatgaatgtggaaaatgatagaataacttacattgtgaaacggaggaagtactcaatatttttatgtttcataccaatcaggcaccatttttatatgtcccagttgtttttaaatcctcattttgcacacacattactgttcaaagctatcatatttttctattcatatgtttaattttcattatattcacgaaagaattcccctatgcccatgaaagtttagccgatcccttctacgtccctcgagttttgctcactctcttatagctcttgaattttggttttgatccatttcatacccattctcttagttgtctagttagttcttatagaaagatccacccttaggcataaaggaaatgtggaattttgtagactatattgttggatatggaacttaattactccctctgtcccagaatataagaagttttagggttagacacggttattaagaaagtagatagaagtgagtggtggagggttgtgattggatgattagtggaggtaggtgggaaaagtgaatggtggagggttgtgattggttgggaagaaaatattggtggagaagttgttatattttggtacaaatcttgagggctaaaaattattatattttgagacggagggagtatataagactattgtatttatgactttattgtacaaaggtattagtattcagaaagttaacttttacataatgacaaaatatattttatttatttatccatagagtatatgtagcataattttatgacagaactgcaacagatatgtccacctttgtactccctccatctacttttaatagtcatatttctaaatttaaaaaaattatttttgataggtatatttgaatccaacaacctatcatcttaatgactttctcgcatttaatgcgtgactctctattcttccacacaagattggatacataggcatcgagaaatgtaaatattaatgaatcgtttgtttacaaggaatgactagtagcatgtttaaatggatgataagtagaattacttatccttgatctgtgtactaagatgaaatatgactatcaagagtagatagagagagtatatattatataaaggaatgctaaccaaaacaatgtttacatgctacacacactttaatatatattaaaatttctatgcatcatacttcccatacaacaagcatatgaatatcatagtgtcacacaacaaattactacatttctaacaatagatttaacaaacttctgcatattccttgcacatctaatggcaaaagtaacttcttttacaccgcggttaagtatgaaaggaatcaaaattaaaattcagggttatgcaagagagtgatgaaaattgaggggcatagaaggaaacaactacaaattttaaaggcatagaagaaaattttctctatatttataggtcccaaagaaccatatgtgtgcgatcgggaaaggaggttgagaacttctctcccgcgcacggctatcgggaaaggaggttgagaacttctctcccgcgcacgcaaaacagagtatctgattagcatattattaattaaatattagctaaaatttttaaaaaatagattaatatgatttttaaaaacagcttttctataatatttttttttaaaaatggactgtttagttgttcgggaactgaaaaatgagaaaataaaagttgaaaaaatgggaaaaagaacacaaaccaaaggagttcttacgggtgtggccaccaaggacggcctggtgtagggcggtgccgcggacgttggctgtggcgacgaacttctcggggacccatgggatgtcgaggatcttttcgacgacgtcggtgaggccctcccgggcggcgatgtgcagcggcgtctgcatgtccacgttgggcgtgtgcccgcagttgggctccacctccagcagccgcagcgccaccgcgctccgccgctgcttcaccgcctcatgtagcggcgtattgcattcactgttcatcatcatcagttggtcctcctgcgtggatgtgtataattaataataagtttaggtaaatattacatgtgagaaaagtctattcatccctcgagggatgtcccttcgtttttcatgccacctaaaaagtatttttttcttgaaaaacagtaagatagttaaatatgtgatatgcaatttcaccagcatgcaaaattaaattcagtttatataagaagaaacaaaataaaaatttcctttaaatagacgcgtaatttttattcagatttattgtttttgttttaaattgtataggttgaatttgaacttacatatttgtggaatagcatatcacatactctctctattttaaaatataaatatgtttagctatgaatctggacaaacacattcataatcatagctaaaaattactcacttcattttatattataagtcgttttaactttttttcattagtcatttttaagtttaagtaactttataaaaaaatatagtaacattttcgatacaaaacaaacatattatcagaatatagtgaatgttagttttggttaaactaatttggtgttatagatgttgctaaatttttcgataaacttaggcaaacatatttagttagagataatccaagaaatgtcattgacaagcatccaaatttaagaaatgccatcgataagtatgaattctaagaaatgccactgtacaaacgattttatttcagaaatgacatcaccattagggttacgtccattccgtgccgttaagtgctataggatgaacaatgtatttgacggcgctgtcagggttatggataccacatacctaatagtagttgactacatctcggcaggacccaccacataccatgtcctatacggaaacaaccttcggatataggaggagttccgataaggaaagacaacaaaagttcttcatggaaacgacaaggactactcggattgtatccatattggtttccctagttctacttagacaaggggacacctatgggtataaatacaagaccccctaggaggggaagagggcggacacccaccagggagaaccaacgcgatcaacacggtcaccacgatcgagaccccccatgagacaatcaactcccaacacaatcaacatagaagcctatatacgccaagacaagccgccggatatcgacatcagagatacgcctagatcgaccctatccggtaccttcagaggccggtcgtagggatctagcactgtctctgattccgtcggccgcgagctcgaggagaaaggctaccctgttgtcgactacgagtcagaccttcagaccgccatgtcgacaacagttagatagactaccccacatattgtacttgtgtgattatggtgaataaaaagcaacatcggctccggccaacaggatgtagggctattagctgattgctcaggggcccaaacctgtataaaaatccctgtctccatctcttttacctcagtctcgcgtatatcctagcaccgacgatccccatactgttcaaataccgtagtcgagacatcaaacgtcgacagtggcgcgccaggtagggggattttggtgcttcaggatttcgacaagataggtttaagagatggattcttcgacaacaagctactcgacgacttcggctgtgaggagatccacccggccagaatacatctctcccgacgagactggataatcgtcatcaactatttgatccggcgagatcggacaagctccaaaatacagtcgccgtgaaggataatgattcaatatcgtcagatacgggacttcggttcgtgctgactacacggtgaactgacttccgtcgccaaaaatcgactactgatacgaccaggtttaccgttctaattttaattttactcatatcggtattatttcttttggctactaattgtatgttcgactggtgttttcctgtttatgaatgcactgctgctgactgagtccgagtcatgatcactagttacgcatacatatatgtggaatccgaacacctatagtcagatcaataatttattatgtttatctagagcatgttttttatacaatatctattgcgcggatgtttccgacgttaaaccaactacggtctaacgctgggggctcgctctgttatcttctgtataaatcatgcttgtttacggtttacataatgccctgatatttacatctgctcgttatatcctgataatgctagaagatccatgcagtttttgagtacatactcgatattatctgctatatgtcttgtcttctagaaaataattttcaggaacaactgagcactcgagtaggttgtggtcgagtacgctccattatcaagaacattctcgacaaatgcggagttatcgcacccaacctaccaacgaagaccgacgacctatctcatagcaccggccatggctggactagtcgagaaaaggttgttaacggataattcctcgcgaacgtcgtcagcttgatcacccgacatgattgcgaacggacatctggatatgctataagttgggtacgtgagtcatgctggccacatgagatacacatgcaataaaccaactctagcacttccattggtgttcgagagataattccgctcgctcactggttttcgcaccaatacgtagcaatctctcgcaccgcaacttccattggtgtttgagagataattccgctcgctcactggttctcgcttaacttcagatggtcaaggtacgactacaacagcgtagcggtcctcgcaccatgacttcagatggttgaggaacagctacgactggtctttgaccggcagcgtagcggtcctcgtaccacgactccaaatgatcgagggacacctactcaccggttctcaaccagttgatcgtagtgatctctcgtacatttgcttcaagtggtcggctacttccactttaagtggtcgagttacgactacagcctggtcctcgaccagcgatgtagcgtctctccgactacttccactttaagtggtcgagttacgactactgcctggtcctcgaccagcgatgtagcgtttctccggctacttccaccttgagtggtcgagttacgactactgcctggtcctcgaccagcgatgtagcgtttctccggctacttccaccttgagtggtcgagttacgactactgcctggtcctcgaccagcgatgtagcgtttctccggctacttccactttaagtggtcgagttacgactactgtctggtactcgaccagcgatgtagcgtttctcccactatttccacttcaagtggtcgagttatgactactgcctggtcctcgaccagtgatgcagcgtttctcccactacttccactttaagtggtcgagttacgactactgcttgattctcgactagcgatgtagcgtttctcccactatttccacttctagtggtcgagttacgactactgcctggtcctcgaccagcggtgtagcgactctcctactacctctatttcaacaaagttgatagcaggtacacaatatcgctaagtgttttacccagagatcccttaccacgacgacacctagtgttgaaacctatcctactgtccctttacgccctcttgacaaggcctccgaggaacctaagggaacttcggctggggatgctcagagccgataaggccttgtcggatcctgtagagacaaaagaccatgtaagatctggtcgtgtaagagttctcgccgtgcgtattaaccaagccgtgtaatcggaaattgacttttccaacttcacggctgggggttaggatcagtgcttattcaaccaaggcaggtcaagggtccaagagccttatcctccgagaacgattctccgacgacaaggctgggggctagggagagtgtatgactctacaaactgactgatcgaagtcagtaagagagaagacgctcatacacaaaacattggtcggtaaatttaattcattttcaatttaccatacatattataacatgtcaccctttgggcattcgctcgggggctatttctatttgatattcttttctgagtattgatttcaggaaaattctattcgacattgacgaacactccatgtctctatggttctacaccaagacaaagctccttcgcagactctacgccttctcgatcgctcgagaacggttgctggatctcgacaaggaatacggaatgaagagatggtgtacccgccgagatagaatttcttgacttcaatccaaattctcgattacagcaagacatgagacttagtcgtacactctgtactttcttggttgacatcagagattgactcagacaaaccctttaggtacccgcacgaggctgacaaaggaagtctaacgttatctctgaactcaccgagaacggtcacatgagctagataacagttactccaaggtctgcgcgtggttgagaatatgaattcgttcatttgcattgaagtcgggggttactgtcagggttatggatacaaaatacctaatagtagttgactacatctcggcaggacccaccacataccatgtcctatacggaaacaaccttcggatataggaggagttatgataaggaaagacaaccagagttcttcatggaaacgacaaggactattcggattgtatccatattggtttccctagttctacttggacaaggggacacctatgggtataaatacaagaccccctaggaggggaagagggcggacacctaccagggagaaccaacacaatcaacacggtcaccacgatcgagacccaccacgagacaatcaactcccaacacaatcaacatagaagcctacatacgccaagacaagccgccggatatcgacatcagagatacgcctagatcgaccctatccggtaccttcagaggccggccgtagggatctagcactatctctgattccgtcgggcgcgagcttgaggaggaaggctaccctgttgtcgactacgagtcagaccttcagaccgccatgtcgacaacagttagatagactaccccacatattatactggtgtgattatggtgaataaaaagcaacatcggctccggccaacaggatgtagcgctattacctgattgctcaggggcccaaacctgtataaaaatccctgtctccatctcttttacctcagtctcgcgtataccctagcaccgacgatccccatactgtccaaataccgtagtcgagacatcaaacgtcaacaggcgcagattggacggaaccctaatgacgatggcattttttggacacacacttgtcaatagcatttcttggattttgacatttgtcaattgcatttcttggattatcacatttaattaagtttgaccaggaaaaaaatcaaagtgacatagagtattatattttaggatggacgtagcattaatctatcttactaatgattttttggacgacaataatccatctccgaggtatgtgacctggtgccagtcagccggtttagcttaatatgttcagcccccacctcctccccacccacacaaacttttctattttattgttggatccgcctctgtagctactgaagtgtaacagcagcagcactaggccaggatgccactgaacagctgcagcgccggtggcagtgtcgatgtaatatgtgttcccttcgtcttgaaaaaacaacattgataataattataggacataaacgaatatggatatgagccatattcagattcactcatatctagttttgatgtactaagttatattccatccttaccaagaatagttttcacttttctttgacggagggagtactccggagccagagctgcaccagtacacgatagattttcgtggacgctatccccttttgtttccatgcgattcgtaagtggaaccgcacgaaaaaataggggaactggcgcctggctgtcgcccacacgggaaaatcaattttctcgtgcggtcctcctaaacggaccgcacagaaaaatgagccgattttccagtgcggatctattaagagagccgcacgcgaaaatagtattccctcttttccctctcacccacttcaaaatttttcctcatttatctcttttaatttctcctcacacccctcccctcttatctctcttctctctccccctctctctgtcacacctctcctctcgtctcctttcggcacgcggggacagtggcggcgcggcggcggcctcagctccacacggcggcggtggaggtacgggatccggcgggcggcggccgtccccgcacggatccggtggccggccggcgttcccccacgcgggatccgctcccctccccagatccggcggaggggaagggcgtcggtggcggtgcggccggaggggagggtggatccggcgggcagcggaggcgggcggcgcgaaggggagcatagatccgtcgggaggcgggcggcgcagatccagcgggcggcgacgcagaggccgccaccgatgaggaggaggaggaggaggcggcggcggcgccgccaattctagatattttattttcttgaaattttattttttttcggtttttttcccgtgcgggtgtcataagcggcacacacgaaaatcggatttttgcgtgcgggaccgcacgcaaaaatcacgattttcccaaacatctgggtgcgtacaggccgtccatccatacacaaaaatcattttagccgcatgcaaaaatcggtcatgtagtagtgctggaggcacccacaactagagattcatcgtgcatgggtgaggtgtgtgtgcacctatgtgtgagcattattttttttttcaacgagtgatccgactggaagaagggttatgcgaggactttgagatcaacagatttcgctttggtcaacccttatttactaaattttcacattggattagagttagacttatattttcacttaaaaccatatatagttaccatcatttacactttggaccgggtttcacaaattacacatacacatagtacaatgattgtagatctgatctcatttcttttttgtgttagaaaacttagaattcaataatttgtactaacactacagttggatattgtaaaacatgtaatatcttttctagaaaaatagttcttaaacttaatatttcttcatttttttctctagtataagggctgtgaatgttcatatgtagtagtaatgaagtcccattagtctgatagtctatcatataacatgttgcaatcttgttcttgtgctaagcatagttgcaacggaaacttttctaggagaagttcgaatctgttccgttcggatattgatcggtcttggtttgacatggtttacgcgttactggttctcggaagagtcaatttctccattagctataccctttcttaccctacctttggacttggcaaatttccataccattgtctcttgtaaaatgctaagcacctagacaacagctggtgtgatggtacctataaaatccggtccaaagtgtaaaaaacagtaattatacgtggtgttaattgaaaatatgaacctagctattacccaatgtaaaactttgatcaataaagatggtccaaaataaaatttactcatatagagtaaattattatatcaatttagttaaccggtctgggaggttgttttatttagtctatgtttttttaacggatttagtctacgttttcaactttacctcccttgtttttcacgtgcatgcttcctatacactgctaaactgtatatttttaaaaaaaaatctataaaaagttgctttaaaattatattattttaattttaagttttaagctaatatttgttggatagtatagggagagaaatattgtgtaatgtggcttaacttgtattaagtatcagggggaccggtatatatggaagtacatggaagaggagataaggaatgattacagatatggaaggtatccacataaatcaatcatatcctaatatactaatctaaagctagcagtgtttgccagctttgattgggccacgtggcagtctttttctttcaaaataaatcctagaattatgtgaaagaaaaaaaaggaaaaaagggcttgagcgttgctgcattgaagctctcctgttatgaggtgctagatctcttataggaataactagcgattaatctagaagaatccagggcatctaaaatattttgaactaaggaccaaatataccaagagcctaaccacaagttgatccgagtactactctctataccaagagcctaaccaaaagttgctttaaaatcccgccgccttgtgcagccgtggatccatcatatattactactctctatacgtacactagctagagcgcacaattgaactctccctttgaattgccgcagtgtggcagccagcgatttgtacgagtagaaatgtagcggttggttggattcgttgcttgtgttgctgggtatatatgtacctctcctgtcctgcaagctacgtgcactggtatatattcgttgcttgggaacatccccccccccccccacacacacaccaagtgttaccaaccgggactaaagatggctcagccggtttagccatctttagtcccggttggtgttaccaaccgggactaaagatagagctgacctttttttttttgcatgcccctgttgctgcatgggttatatatatatatatatatatatatatatatatatatatatatatatatatatataaaccatgcatatatatgtttcaatacatatatatgcatacatatatatatatatatgtatttatacatatatatgttatgcaaatgcatatgtatataggtatatatatgaacaaaatatatttatattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaaatttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtatctgtctataagttcgaaaaccttgtcaaacgtagactcttttttatccattgagtcatatatgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatacagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctatagaaatcttcttttctggacttcgaggcttgaattgtctcttgacttctgatgcaacgtaagcgtcaagctcctcttgcgtgcaatcgtaccccgggtccttgttcttgacggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtacatccattgccgatccatctacatgagtcaaaaaaaccgcacacaaataattattcttacaataatgacagtcatacaataattataagatatctttattcatacaaaaatcataaaatatcacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttcta

SEQ ID NO: 43893 - DNA, 19332 bp, Oryza sativa
tttgtatgtaatcaccgaaataaattcaatagaaattttggcatgacctcccctcttttttgaagaaattttgaagcttgctcgggcagctggaggaggaagaagacatatatataggggtgggactttagtcccggttggtagcaccaaccgagactaaaggtcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctctaccagtgctggtatatattcgttgcttgggaacatcccccccccccccacacacacaccaaatgcatggtacataaagaacaaaaccaatcacaattaatcttcccttatttaattctacgtattttcttaataatcgtgtttaactcttaaactttttatattctgagatgaatgtagtaatatttacgagttatcaaacacatttcatttgcatatcggtagttccacgacttttctcaaactaataatgtgccaaaaaaatcgttaaaaatttaacaagatagatcgataaatggtatatcactatacaaatataatatatatatatatatatatatatatatatatatatatatatatatatatatatatatatatatatatatatatatatatatatatgtatgtacccgagctcaaatctgttcatcgtagccactccgattttaaatctgtgttaaaaatttaacaagatagatcgataagggagatggaaaatctgcacgcgagtgcacatatacccttgacccccgatagacacctgtccccggtagtgtaatggtttcgtgtaattgatcattaaaacgtagagtggtcttgtacatctcgatggcgcatatggcgaatgagtggtaggtgtcagcacagagcgatgtggttttgacatttttacccttcagcgcttgaaggtgtaatgatcaccacgccgcttcttgtgttgtttccacagtgcatccactcagatagctaaaggcccacaacaagtgttgtttttttatgccccatcgatgccatcacctaacattactataactcagcaatgcgcgcctgacgccatgcatcgtgtcagccatatatgcgaatttttttcagagaacatggatccgtctcactcggatggatgggtcacaatggctcctgctgatgtatctgcacacaggatacatcactccattgacaagatagatcaaggctccctccatcctaaaatataaagctcaaccactcataacacaaaaccaagaaaacatttaatcacctttttggttggatcaccttgatacatgcaagcaatatgattgaaaggtttgatggtataggatttaaaacaaatcaattctattggaccaagaggtgttaattaatgtatgtatacatgtacgtcttatattatgagacataagagaaaagtggctgtaccttatagttcatactccctcggatgggataggacatctcatcctagattagtttttttgacggagaaagtatactaatttgagttttctgtgttatttttgttataatttatacaagttaaattttaacttgcatatttgtgaagtgatatattacatagaagtattcatctatcacatgtgctttttttgctcagagccagcggaaaatagactactgcttgatgacaaatctgtgagctagatcgatcacgataccatcaatgtcatcgctgttacctggctgcccactcaagggcatctggaaaaggttgcacgtgaaagtcaattcttgatgacagtatttttgtgcagcgacttactacctccgtccaaaatataagtatttttagaaaatacagatttgcactcgggttcatatgtacctacaatctacaccgttgatgtgttccaagattcatgctgcaaaatgtacctaaccttaaccaaatgaatatagggagaaaaatattaggattaggttggttcacaatatgtataacatgtatgttgcattttttaccaaataatttttttcaataccaatcatatatgacatttatatatatagtgcattgtatttttctaacccttattttgtttataacatgatatttagtcaaaatgagaaaccaatatatctacaatatcaccaaattgtcatcttgcaaaaatgatacttccaaaatgatatatatatcctaccatcaaaaactacaaaaacaaggtaatttatataaacaaggtaaactacataaacaagttttacatacaagaaatacaaaaattacataaacaaggtattttacacttgtaaaaaatatagtataacgtaaacatcatgcatcttacattttgttagcacctaatatacttgccttaagattcgcacaagctacatatagggtgtagattgtgggtacatgtgaactcgcgtgtaaaaaatccaactcctacggaggtagtacctcccaatttatcatactccctccatcccaaaatataagtaacaactactcataacataaagaacaagaaaaaatttaatcaccttattaattaaattacatccatacatgcaagcaatgtaattgggagacttaatggtacatgaaataaaataaaccaaatttaaaggaccaagagatgataattaatgtatacatgtatacacgccttatattataatataagacatagagaaaaactgattgtgacttatatttggatagatggagtatcatccttgctcttcctggaatcgagcttaaaagcctgctacactttaagaacaaaaaaaaaagtaataagggatcaaaaaattttgcctaacaccaccctacatcttgatagaccgtgcagacatatttatgcagaagtacgttgtcgtgtactgcctagtaaataaacacatcttatccactactatgtcagtcccaaaatacttatcattttgagtttttatttgtaatcattcgttttatttaaaaaaattataaaattattatttattttgtttgtgatttgttttgttatcaaaaagtactttaagtataacttatctttttttatatttatactaattttttaaataaaacgaatgctaaaacattgcaaagaaaaaatcacattgacaacaaaactgtgggatggaggatacgtgctgctggcttcctacagacgcacttaaaagtgccatctgctgtcttggtgtcccactgactctcagagaatcggccattgaagaggaatagctcctatctattgccgcctgtactaatatgaatggcgcttgctcccgcagcaccaagggcaaaacaggaattctcgctctcggtacctgtgtagcaatacgtacaaggtactacatgctctatgtttaacactgcctgccgtagtactaacaagccatccaccatcattcttgtgacccctacatcacgaatctccgagcatctgacggcaaggatagtgggtacatatgtacccgagctcaaatctatgtgtgtgtgtgtgtgtgtgtgtgtgtatatatatatatatatatatatatatatatatatatatatatatatatatatatatatatatatatatatgtttgtaggggtgatatactgatatatcacatatagatatatcttgttcttttttgtttccaaatttgttgataacattttaaatgctatggaaaacaatggtatatcctctcgagagacaaatagacttcctccccatatacacaaggaatcaagacatgaatgtcaaaactttttctcctttttgaggctataataaagttataacccactaactcctaaagtttataatgcaaagatgccacatcattagccactaacaatcattatatttaaacatcatgcaaaaatgctatatctattaacttattaaagaaatagaaaaaaaaaaggagcctccacgttcactcttacggtctagaaattcttatattaatcggagaaaagaaaaacagagtccatatagaaataaaatttagaaatagttgaaattcggaattaaaaaatgaggaatattagaagaggagactatagtccatatataaatataatttagaaataaccaaaattcagaattaaaaaataaacattatcagaagaagagtatagagtccatataaaaatacaattaagaaataatagaaaattggaattaaaaataaggaatattagaagtagagtatagagtatatatataaatttaaaactaagtaaaattaggaataaacataataaaattaaaagtagagtttagatgtccatataaaaatacaatttacaaattactaaaattcgaaattaaaaaaaacatgggaagaagagtcttaatacaatataggaattcaatttagaagtaactgaaattcgaaattaaaaataaaagaatattgaaagatgagtttagagtccacgtagaaatacaattagaaataataaaatttcagaattaaaaataaataatattagaagaagagcctagagtctatatagaaatacaatttatagttaacgaaaattcggaattaaaaaaataagaaatattgaaagacgagattagagtccatataggaatataatttagaaataacggaaatttgatattaaaaataattaataactaacacatatataaaatataatatgaattacacattagtagtttcataaagttagtacaaaatttaaaattatgttgtcattttaatatattttaataataaattgtgaaaacatatatgctattatatgagagaaaatataatgatgctagccgcgcaatctgcgcgggccaccatgctagttatctataattttataattgattatactataaagttataacccattaactcctaaagcttaacatgcaaagatatcacatcatcatccactaataatcattacatttaaacatcatgcaaacatgctatattatctataactttataatttattatactataaagttataacacattaactcctaacgcttaacatgcaaagataccacatcatcatccactaacaattattatatttaaacatcatgtaaacatgctatattatttataattttatagtttattaaatttttagagctcttgaaatgcaagcatgttaaatcatcatcccacaaaatccacaaaatatttcaatatatatctcccttatttttttataatattctatgtacatatatttcattctcacttagttaatgttatttctttcttctctcattaagctctaccacatcaattgtttttagtgctaaatggttaatctatggcccaaattatctctatcattttcttttctcattaagccatatcaactcaattatttttagtttttagatgattaatatacggtccaaactatctccctatatttattctctcgtaaaatcatatcaccttatttttacatttaaattatcattcaatatactatttaaattaaaattatcataaacaacgttaacttatgtaatcttagttatctagctatgttacacattatttttatttattgttgtcatactaaactcctgtagcaacgcacaaggtttcacctagtgtgtttaaatatatgctcccatcattgtaaaatgtaaagaattttggtcgaatatgatacataatagtaatacgaatctgatctaaaatataagggattttgatcagcattgtttagaaggatagtcgtccttctgttccctcccctcaagtccatgcatgcatgcatgcagcgcagaagcacaactccctttgtgaaaatcagaaaaacaagaggtttgttaacgaaatccacgctcttacagcgtattctggtcggacgggcaagttgcagtacgcaggtatgagtaggacaaaatctctctcgaaggcaaatactacatatatagctgaagccttccttgagtttccttcataaggatttgcagagatgctcttgttctacacatcacatttgcgtcccgcactaagagcatctctaatagagaccatagactcagtcctaatcaattttcgagggttaagatataaaaactagattcaacaccgaccctagtaccctactaaagctcccaaagtgagaagaccccccgatcctcctcccaagcccctagtcctggggctccgagtacggcccccatcgacttatttttctagcgtgaaccaaaatttcacttcgcgtgatctagtctcacccgcacggcactatgacctggatctcctccggcaatcgccgttgactccccccacccacctccgccaagatcgccccaaaaaggtgaggtttttcctacctttgttgcagtcgtctacagggcctccgcttgcacgcctggcctccgcctgcatgctggtcgttcacacgctcggccatcgtccacctggccacacgccgcccgcccgcccacacgctggtcgctggtcgttcttatataaatttcaaatgcacaaactgcacaaagattttgcataaaatagtttattgaggaaactctattcattccttaaggggatgtcccttcgtttttacacattgcttaaaaagttataaaaaattagtaggatcaatatgtgatatgtcactccacaaacatgtatgttcaaatttaacttatacaattaggaaaaaaattcatagaaacgcgtaattcgtggttaaatttattatttttgttttgagttgtacaagtcgaattttaatttacgtgtttgtgaaaagaatatatctatcttagaatgtttttattttttatgacattttaaacgtcatgcacagtatgagaggatgccccttcgaggggggaaataatttacttccagttcattgctcaatttcatcggcaagcaatctcactttcaaagaatgacagtcacaaaaatattgctactagtaacaaccgcaattactgagcagctgacaatacatacagttaattaatcacaaaatactacaaatagaagcataaatatgcgggggttaatataactaattaacttgtgggattaattaattgcttttctatggattgggaacctatcctctaagcacgaaaaacggaacaatccattagcacgtgattaattaaatattagctaatttttttaaaaaaatggatcaatgtgatttttttaaacaactttcgtataaaaacttttttaaaaagcgcaccttgaaaaacgtgcacgcggaacacgagagagatgagttgggaagactgaacaaagaacacagccctagtgatatttgtgatcgatcacaatggcacgtagaacacctcccagcgcagtatgagtatgacgacggccggagtgcaggctccgatggcgatgaccaggtacgccagccaccgctccgtggggaggacggtgaggtagacggacgtcatgagggagacgatcatggcgaggcaggcgacgacggtgaggcggtgtccccaggtgagctggtcgagcttgaacttgacggggtccctccacgcccagatgaagcagaagacgacgacgatggcgctgcacatggcgacggtgttggacaccacgaagatcttgaacggcgccctgtcggcgtggatggcgagccccgtgttctggttgtagccgccgggcatggtgaatgtggcggcgaaggtgacggtggcgatgagggtggccacgagggtgtaggtgccgacgctgagctcgaagtactcgtcgttgctgccggagcccggccgccggctgcgcagcgactggtacgtcgccaccggcggcagctgctggttcttgcaccgccgcgactcgtacttcttgagcttctcccagaggtagacgacgtaggcgtccatctcgccgccggcgacgcgctcctccacgaggctgcgcgccgagtggccttcgcggttgaggaggcaggggtcgacgcgggggtccctgagcagcatcagcgccgacttgatgcgggccatcttcgcggcgaggtggagcggcgtgtcgccggagttgtcgccgcggttcaccacctcggcggggcggacgcggccgaggaggcaccggagcgcgtccaccttgccgctcgacaccgcgacgtgcacggcgttccggccctcccggtccagcatctccgccgcgtcggggctgtgccggagcagctccgccgccgctgccgtcgagccgtagtaggccgcgacgtggagcgccgactgctgccgctcgttgcggcggtgggcgaggtcgggcttgtggtcgagcagcatccgcaccatgcgcttgtcgttcttctgcgccgcgaagtgcagcgccgtgttgccgacggcgtccgtcaggtcgatcagccccggcgccgtcttcatcagcaatatctccaccacccctgctccacacacaaacacactcaaatctcttcaaatttgattcaaatgcctcaaaaatctattcacctttttttttaaaagtatccatatacccctctaaactaacgatggaagacggtgatctaacactttaaaactggactttcaatcccaaactttgtaatatcattcattatttaccgctaagatagttttgaaaatcgcaagcttaaacaattactcccagtatcccataatatagcaactagcaatctaggataggatgtgacgtttcatataatgaatctggacaggcctcctgactgattcattagaccataaaactaattatccggttctaggttgctaatattaaaggacggagggagtatgtagtttttgaataattaataaaacatatttacatatcatcaatcattggttattaaatttatacttatataatgatgttatgtgtaagagcgtaagcatggtaagaaagcaaagtttaagtgaaggtttgaacatataaatgttactccctccgtttcatcatgtaggtcattctaacatttaccacattcatattgagatatatgtctagattcattaacattcaggggttggatgtggaaaaaaaaatattgagtactggaattcatcaaaaagagtactctttgaattaatttgagcaaaatttcttcttacgggtgtggccgccgaggacggcctggtggagggcggtgccgctgacgttgtcggcggtgacgaacttctcggggacccatggctggtcgaggatcttgtcgacgacgtcggcgaggccctcgcgggcggcgatgtgcagcggcgtctgcatgtccacgttgggcgtgtgcccgcagttgggctccgcctccagcagccgcagcgccaccgcgctccgccgctgcttcaccgcctcgtgcagcggcgtgttccgtgtcttgttcatcatcatcagtggctcctcctacatacatacatgacgtacatttttcgcataaatattatagtcttaaatcttaatccaaaattgtatggtcaaaatatactttatatttccctacacggagggagagtaacgtaattatcaactcgcaaagcactcgtaggagcaagaatgtatttatttgaaaagaatatacttcattcgtcttgaaatataaggctctatagctctgtaaaaaagggaatcgacatttgtacaactaaaatgacaaaatatatggtattactaaattcattttttgaaagaattttcacaccatgttaattttatggttgtttatatttttaaacagataaaagtatatcacaatgagtgatgtcttttagtgattaccaaaaggtactaacacacattataatgctgaatttgacagctctcgatttcttacatatgagatttataaaaagtatcaaattctacattgcaaaaaaatggcaactctcttgtcacaattatataccggatggtcgaatttcttatattcaaccagggttcaaaattctaaaacgaaatttctgaaacttcgagtctattggaccccacacctagaaaactatttggcctaaaattttcaggttatttacaatttttttttgtgaatttagaaaattttatttatatttgacaaatcgttgtgcaaattttaaatagtgtcaaaacgaaatacccgaaatttcagttgtatcggtacccaacagaaatagcctaactgaaatagtatcaaaccctgtattcaaccggtgacgacgaattaaagctagaagaaagaaaacggacggatacctccggccaacaaggcccagccatggtgatgaaggtgatgagcatgtcggcgacggccatcttgccggccctggcggcgaggtgcagcggcgtgtccccctggtcgttcctggcgacgaggaggtcgccgtgctcggcggcggcggcctcggcgaacgcgacgcgcccgagcccggcggcgatgtgcagcgccgtgttcccctgcggcgtcgtcgagttgaggatcttgccgccgccctgctcctcccccagcagcgccgccaggctcgccgtgttcccctgcaccgccgccttgtgcagccgtggatccatatatgcttcttatttcctctaccttctacctaccttagctacctagctagagctagcctctgtacagtacagtgatcactcctctctctgaatgtctgaatgtctcgtgtattcttctgtcagtgtgtgtatgatgagatcgatcatggaggtgatggtgatgcagcaatggcgatgctgatcgagtagttgtaacttgtatgtactccatgtactatgtaggagtagtgtggatggattctttgcttgtttgtggtgggcttgtgcagttgtgccctaccctgccatggaagctaggttcatggtgctttacttgctaaaccgaatgtgctaaatgctccattagaaaatatatatgcagtctgatgtgctctgtctccagctcctgccacagcatgctttactggccgtcatgcatgtagcacaaggaatcaaagctttaagatggatgtggatatatattacaatgtttgattactctaatttcctcctgaaattataaagccatgcgataggtttggaggcagctttgccaaccatatgatccgcattggtgatgacgacaaaatcattgaagaattaattttgatttttcaactatccatataaagaggatacgagattgagagagaagtaaaatgcaattaacttagtagtagttgttaactgacttcagttagagagaatcacaactttgtctcaagggtcaagcgtcatgtggacatggcaacgacctctgcctcgctggccttgacgctttgtgcatgacttcatgtcgctttgttggtgggttaattatgtgattgtgcaagagtggataagtgggttttacgggttttactttgttgaggtataggaaatcaattaaatagccaacaaaataaccaatttatcaatgcatacggccacatcctaatctttttgcgaaactttttgatatgccggtgcacacccggaacccctgggtctatctttgctcgatgagatcccatggacagaagaaaatacaagagaagagtcttatatacaatattatttccatggtgttgttcatataaatcgttacagtatcatacggggatttacccaaccatgccgtcttgatatttcatgtggttgattaccgttttcagtaattgacaactaattcagtgattcaagtggttgagtaaaccatttttctactaataaaaatagaagggttttttcttccgtcgacaagtaaatataacacggtaccatatgatctaatactaatactagtagaaacttgatatatctatcgataggtaagacaaatttgtctatcaatagtggatctcagctcctttggaacacaaggttttgttgagttttttttttaaaaaaaatcatctaattaaagttcaccctttttagaggagtcgaggccggaacttcttggtaactcgtaatagtaattataacacgataccatatgttctaatactaacagtagtaggtacctgttatatggatcaatagataacacaaatgaacacaacaaacgtggatcttggttcctttggaacataagattttgttcgtttttacaaaaatcctctaaaacctatcctttccaaaggaggcgagcccaaggattgcaactagagatggcaatggtgaattcaccgtcagagatcatgcctgcgtccccgtcaccgcggtgaaaatatttcaccgtccccgcccccgtcaaccacgacggagctataatttctccagccccgatcaccacgcggtgaatttttctccgtggtgaacccgtccccggttaaacagcatattcacagccatggtcggtagatggtggcggcgacagcggctcccggtggcgcagcgacgacggttgctgcaggcgcggcgacgacggctgctgcaggctagcggcgcgtcaacggcggctcccggtgaagacggctgcaggcgccgcgccggcccggcggctcgtcgacgaaggcggccggcaacggcggcttcagtctcccggcgaacggcggtgcggcgaacggtggctcccgggctgccggcggactggcgaatggcggcggcgcggcatgcgtgactcgggtggagggctggaggctgctgtggatctagatgggtggaggatttggctttgacctgttgacttagggttagattatatatatatgcctactaaatgggcttcaatattatgggccaatacatctaaaaagtctagaattcctcccttgtacattacagtcgggtcaccgtgggggccggggacggggaatggttcaccgtccccgcccccgtcatccccgatggtgagaggtttttaaccattctattccccatggtgagtagatattaaccatccccgtcacctaataggtgaattcaccacggggaaacggtgaacgggtccccattgccatctctaattgcaactccagttcaaaattttggacccccggggggggcaagtgattattttggctaaaattttcggtttttctcgatttttttaatttgatcaaaatttagtcaaattcagtaaaattaggctaaaatttcaaaaaaatctgtccaaaaagtgttgaaaatcctgaaattttcggtagaaacgaaatgagcgaaatttcggacatactagcttgctaagatactatgccacaaaagttataaggtttattatggttgaaacagtggtgttttagcaaactatgaattcatttgtatggaactccagtaacatacataccctcttttgagcattccatagaattcctttcacacacatgtgcagcttgactagtaacgtgtacaactccgtattaattgcacactgaacattgtggaatactccactatatttcatcaggacaaaggtgtgtataatactgttttgttatcacaaaacaaagaaaatttaatacctaattaaaaagtcctatcttgttaatttacatgatcttttgattcccataaacacgtacggatcataacccccaaaattatccaaattatcccaagaacaaaagctgcacaaacaagatcaaatatatcacatcacaaatccataaataattaaaaacgagctgacaaattcccagaagcaatttttccttgccaaaaaaaatcactccgaccatcatcagctcagagtgcaagcaacgctcccatcagcagcagcgccgccatcgtcgccgcggcggccgggacgacggcggcggcggcgccgccgctcggcgacgagcccggcggcggcgaggtccccggcgcggagctcttgatcgggcacgcgtagccgcactccgccgggtcgaccacccggtagacgcccttgctggtgagcaggtagacgtcgccggcgttgtcctcgccgaaggagaagatgtagcccagcgacggcagcgtgctcctcgccgcggcggcgtcgcaggggatcggcgacctcccggagcaggcgaacggcagcggcgtgacgtcgtacgcgccgctgcccggcggcgactcgaggcccgcccaggcggactgggcgtagaggtcggcgtagaggtagcggccggcgaggcaggggtcggtgccggagcggtagacgtagccgccggtgatggaggcagagccgacgttgttgttgacggcgctgtgggcgtagcccatcaccggcgggatggcgtcgatgtcggcggcggaggtgttgccgccggggctcgccagcggcaggtacgccgtcgtgccctccagcacccgccacccgtagttcccgccctttatcaccaggtcaacctcctcgtacgacgactgttttcaaattccacacaaattcatcaactatatggcaaatttggaccaccaaaaccattttgttaaaattaaaatggactaaattaatcccagtgacatggtatcgctggagaaaaatactactccctccgtcctataatatagcaatctaaaattggatgggacatttcatagtacaacgaatctgaacatgtatctggaccggttctaggttgttatattatgggacggtgagagtattagaagagagagcagtataaaaaaaagctatcactaggtcaatctccttggtgttgcctatttaaacttacacaaaatcatcacaattatatggcaaatttagggggaaatacaaaacaataatttcttaaaatggacgaaattaatcatgtttgcttaaatatacgagacatggtatcgctgaaaaagaatagtaccagtagggaccatcgtaaaaatctttgtaccgatatatgtcctattactaatagagatcgccgtaaaatttgtcttaaaggaagggaatgtggcacctgtccgacgtcggcgcagtagaggtcagagggcttgccggagtcgaagctgcaccgccacgggttcttgaagccgagggcgaaaacctccggcgcaaacttggagtcagtggagaaggggttgtccttggggatgacatagtttccccagcctgcagtgctattgccagctgcagagtttgtaacaggaagatcggtcaatcatcttgtcaggggttgttgcaactcaatttcagaactcaccaaaatatgaacaaatttctgaattcaggtactatcctgaacagtgaattagttgaaagttgcttttgggggcatttgatttgattatgaacaaattccagaggaatagagctaattcacacactatccttttttttgaacttaattcacacactatcctgaacagttctgaataggattgcacctgaagctcaattcgtttgaaataaaatgaattttattttgttcaaatgttgctttttttttgggggggggggggaggggagggggggcatttgatttgaatacgaacaaagctaattgacaaactatcctgaacaatgttacctgtcaggactggaccttaagttcaattcgctgggggaaaaaagaaatgaatttttagttgaaaggttgctctttttctgggcaatttgatcgcaaaatgggggagaatttgggattacttggcaatgcgttgacgtcgatgcggatgatcttgccgagcagcgacttcttgttctgcgcgaagttccacgggtcgccgacgctgccgccgtcgcccatcatcaagtagaggtagccgtcggccttgctgaagaggatctgcccgccgtggtgcgtcgtgaacggcagccccatcgtcatgatcctcctcacctccgccgggttcgccgccgtcgcctgtgacatcaaccgctattgagttacatgcatcgaccaatttaacccaaatacctaagctgatgagaaaagacggacaattcacttcatatccaaacacttccccctcaaatcttaagtcaggattcaaactcgtgatgagaaaagacggacaatttactttatattcaaacattaccccctcaagtctcaagtcaggattcgaactcaaaacttttggctctgatactactattgagttgcatgcactgactagttaacccaaaagctaaagctgatgaggaaaaaataacaattcactttatattcaaacacttccctctcaagtcttaagtcgatatacgaattcgagaattctggctctgataccgtgttgagttgaatgaaccgatcaatttaaacaaaaagattaagctgataaggaaagacgaacaaaccaccaccgctggcgagcgagaagagctgggtgtgcgtaccgtcgccggcgagccggaggaggcgttggcggtgtactcggcgatgacggtctggaactggcacggctgggcgccattgtcggcggtgagcttggaagggtcgcagccgacgtcggagttgcaggcgcagcggccggagcaggaggcggactgcgtcttgtcgcagctgtaggagacgaagaagcggccgttcttggcgaactccgggtggaacgcgaggccgaggaggccgaactcgttgtcgaagtggacctcgtcggtgatgtccaggaacggcgtcgccgcgtccacctgcagcggcttgccggagccctgcgccggcacggtggcgacgaacaccttgccggcctggttgttgaggaacacgcggttcgagccgtccgggtgcggcgccatgttcaggtacgacccgttgccgaggcgctccaggcacatgccgctcgccggcggcgcgacgcggctcgcgtcgaacgccgcggactcgccgtcgaagcacggcgcgccgccgccgcccggcgcgccgcccagcgcggtgcagaagtcgcccgacgactgccacacgtcggtcagcgtcggcgccgccgcgccgccgcggggcggctggaacggcgagcccgggatgcgcacggccttgcaggtgtcccacaccgtcgtgcagtagtccgtcgccgccgccgccgccgccttgccgccgctgagccggctcgcgacgccggtggagttgcacagccgcggcaccgtccgggggctcgtcgtgacggtgaacagctcgccggcgtacgggttgcatctctgcagcagccggcgacctcatcaaaccaagaaatcaaatctccatggaaattccggcgaccaagcgaaggagtcatcataccgcgcagaggatggacttgacgagttcgccgcacggcgtgccggagatgttcatggcggcgaactgcctctgcacggcggcgtcgtccgtcgagttgcagcaggccgtgccattgtagccgcagaaggtgagcgatccgttcaccgtcctcgggaacgctgctccgcggccaccatgatccaaaccatcagttgcaattcacaattcaatcacaaagaaagacaaattgcaagaacatcatacttgaatccatgcacaattgcgcgcaatggccatcccggacggcgaggagaagcacggcggcgatggcgaagagtagtaccgccccggtggacgacgccgacggcgccatggtggattcagggaaggagaaggtgtgaagatgctcagaggcagaaatggtggacaactagtttgcacttatatactagtatataagtagaaggcagccattgaccaatgcaagatcaagaaattcaagatttggtagtaaaagaaggcaaacaagtggtaatttttgggtagaattaaattctgatttctgaaagttcacgtgttggatggtgacaactttctgtacacattatatatcataagatgagcattagcatctggtcatgcactccaatttgcaattaattaaacaaggaagtcgcatggagagagagcagacaaatgtgcttgtttggattgtgaaagtgacaaggtgaaatcgacagcaaatttgtcaacggcctatttgaagtatggagttcagagaatttgctcactgcaaatacccaatgccccaatcagctgaatattttcactcttgaacctgaagatcccagatccatcggtttcagactttcagtgaactacaaactacaatattgtattgtttttttatgccatcaggaaataaagcatgcagtagcatcaaagctacatgtaacttgtaaaatcttcatgtcagagcaagaaggtaaagttggtgttactctttaccatctattgtcataacaactaacaagtggtattagagattcagaacatcttgacagtttttcttttctcgaatatgcagcagaactgcatatcattgcattaagaaggaacatcttggacagtcaactgggacatgatagttcttcagtggccttgtaaaccctcttcatcactgtactaattgaacaacaaagctcctggattttcttaaggttggttgtcaatttacgaccagatagttcaaagcctgtctaaagagacttacctaattgcaatttcctttttcatacaggaccattgacacaagtggggatatatcaatagatcatgaaggtccaaatgtaacagaaaaaaatgattagacagcaacagttgaccttggaaagatatgaaagctttgagtcgttgtagtttggattaattaaaggcacaggaaggtaggttactttggatacttgaaatttgtgcttcttttaaggcccccaagggaagatttttagaagaaaattgtttacatgaggatactgaagtcaaagagagtgagcaagtgggtttgtattttgacactggataagagtactcacatggatcaatggacttataaacagtgggagatatctcacactggttaggggaaaacccagctatgatcactcagtagtagtggagctgaagttactactaattattagtatcatatctgacagtgattttggtctcaaaagttacaaatgacaaagttatgcatgctgcctcttctgtcaccaaatcatcactccaagcctttatgtgcctatatgtaatatattatgatatagggataaattttataacctttttacaatgttcaaataacaatgccttttgagggaaaaaactgaccctgggtggtaggcaagtccaaaataatttttaagtgaatcttttgagagcttcgaaaaggttagatgaaacttaaggaaaatgatatgtgaaaggattttttttccctacatgcaaaattatacaaaaggagttgactatgggcatatggattgatgtgcccagaacaataaagttacttgttcttagggtaacattttgtatagcatttaaataaagaaaattacctatgcaaagctaaatatggaatatttgacgga

SEQ ID NO: 43894 - DNA, 928 bp, Oryza sativa
aaattcagctagaaatgtatccacaacaatacactattattgcaacaaaaattagcttgcaccaagttcactcaggcacccacagatatcacaatttcatgacagctgtggcataagctaagctaaacagtcatgcagaatgtatacaaggggctaagcaaagctattagtcgtgtcacacacgactggtggtttaaatttgaatatctgccagggcaactcgttgaacatacaactgtgaagataggcaatcatgctctattgatttgacttggtacagttgtgttgcacagcaactgatatttgattatgaacgtttccccattttcacaaaactagatctggaatattgttttctcatggggaaatggacatggtttctgagtacatgaaaacctactcgtgagccctaacgcaaagagggctcatgcttagttcatgtcaacaactgcaatttgcagtcagactaattgagctactcatcaagagcacccaattccttcatatcttccaagaatgccatgtaggaatcatcaatgctttgtggcttggatactgaggacgaaggccggggctcagatctaattggagccactgacggtttcagggcagaagatgatgttgttgctgactgttgcacctttggttttggtttgaggagagccgattctctcttaactcgaactgatgcaggaacctgtaaaaaaccaatggtttttcagtacaatggtgcatctaaaactatgtaaatggaacacaaaatatatgaatcaattagctatagcaatcttagaccaactcagctgtttaaaagttcgtggccaatttgtttatttatgatgacataaagggaaagcaaatttatgtaagtgttaagagaaagcttaatagtgggctagccaactataagctcatgtggaggaagggg

SEQ ID NO: 43895 - DNA, 25990 bp, Oryza sativa
  unsure (1)..(25990): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagggagcactactaatactaataccataatttagggttaggaagcttatgcctcaatagaaattctgaagttgaataaaaactcatcttggaaaccatattctagaaatagactatttcctcacacttcaagtcttacacactaccttgcagggccagaccgcctgtaaattctagtatacatttctgcataaaatacaagacctaaaaggacaaggagtttgactgcatatttatcatagtatataaactaacttcctgtgaagttacagatcaatatgataatttggtacgcactaagcagttgatagcctcaatcaattaattaaaaataatatataaatgtaagttcagtatcatgcacatatcaacagccttaacttgtacattgatttagctaaattcacaactattatttacacccgaggtagccaactcatgtttattaactgccacactagcctcatatgtcaaatacttcagccaggaacagccattaaggatagcatatacacaaacaaaaggaacaacatgtttactgtttaatcaagttgtaactacaatgagaaaatcagtccaactttaggggtaagatataatgtgcaagtcagaggaacccatgtatgccatgacaaacctcatttgcgtctttgcaaatttcgttctcgttcttctttggccaattgaccctccagcatctgattgcatcaagttaaatacaatacatgagggcttttataatcattcttattcatcacgaagcttatgatagcaacacactgatacacaaacctttctttaccaagacgacgagcaagttcctcagccagagcctgccctggaggatcagcatctgttgccagtattatcctagacgcctgtttccatggcaaataaaggaattaaaatgatacctgtgtatctcagctacacagttctataaacaaattattctgagataataaaatgcccaccgggtcaagatattctttgcaattccacagatattggtacttcttatcctagctttacagggaacataagcaactgttaggtcgcagattagctaaaactgtaccagagatcaacactcaaactgaagaatataatagtgacaagaagacataagttgtcgtgaatcttgagggacaaaaactttggcaacagcagaaagtagcgctaacctgatctttatctgggagcttgctggatactttcggtggtgcaccatctggtacactgacacaattacggtagccagcttcttccattgagagcttatcaatttcaccctcaacctgccatgtcagtaaggagaacaaacaactaaaaatctgggaatatgaaaacattggcacaaatcttcaggagcaatatgcaaaaagaatatcaagtaacagattttgaacatacaatgataatatctcgtgctcgctttatatcgtccagaccatataaaattttctctgtgtttgcttcctggtatataagtgcaaaaataagaacaaaagaaatatagcataagctcatacaccctaaaaacgagtagcaccacaaacctgtgaaaatttcttagagacttccctgtatttgcagccaacgaggaccccatcacgcctgtaggtgaaagcaataactatctgcaaacaaaatgtacttacaatgctaacacaaagatgttgtatccaaagcagatctacggaaatgcatccatctataccttattactccagttacgctgcattacgctgtttctccgaagtgtttctggcgatatcattctctctgagaagtatgttacaagctgccaaaatgtgattgttttgtagaacacccatgtgcaaaaacttctattaggattcatcaaagaagaatgggaaaagaataaaaacaacaagaaacttttgatgatatttgtacagtaattggtaatattccagcctaaaaaacaatttcttacctcatcgcaaagtggctcaagatggaggtcctcctcacaaatttttctgtaaaccttattgactgccagattagcttcaccatcctggtccgtttcacattctgtattattttttgcttgtgatagtttgagaactccatcaggctgcagagagaacaatagtgatatcaggacattttattaacttcaatctttattcctatatttatttggtaaaggcacctcgacaaaacccttccaaccacaattagctctaaaacattgccatgcagcatttttcctgaagaacaaaaataggagaaacatcagatgagacaggccgtactacatctgaagaagtaaaagttgaagaagggtaaatataaaatctcacccatccattcggatcataacactgaggctcggctcctcagtagatcccccattgcactagtgaacatatggaaagtaatactcatcattgctgtctgatagctcagcatgtaaagtaaatggatcaccaaaggatcatgagcaggtgagcatgctataagtagaaactagtgggttttatgaaccagccaccaaaacgatgatactttatgatacaggggtaggctaatcaaatcagatactagtagaaaacaatggatttgatgccacaatgtctctcatttctcttgatgtcttaaaccacaaaacaattgcttcttatctagctagacacttctagcctcatctttccgcttaagcttatgcttatcagccaaaatttgaattttcaaccttaaatttgaagttgattttggggtttttttcatcaaagtttattcttcagcctttgcttttagatcgctaagaacacgtatataaaagttttattcacaaattatttttcgtttgcaaatatgccatttggcttattccacgaataagccaaacgatggggctcttcatgtaaaaaagggaaacatgaccaataattagagtaattaaaaagaaacgcacaatacctttgggcacatcattcgttgataagtaccaagcctccattgctttggacttattccttctttcttcagtctctcaattaactgtcctagtcgctgctcgcaaccctttttgtagttttccgttgaatgaactgttatccaaagagacacgacatcaacggaaagtatcaccgctactacatccaattgttatagatcacttgcaaatgctcaaactatgacatgtacgccgcctaagaagaacaagtgggcaccagaactgcgaaaacaaggcagacataatgccttggacgaacagttcactcaaactgtcacaaaacagtaaaagcgctccaaattaatgtgacaatttcaactaaaggagtttgaaagagtagaatcaatcaatcaaaacgatttacccagcacgattgattgaaatcctcaaggagttcctggcgataagaagttaagaacacagcatttgggaggattaacagctaaacgcctaaaagtacagtagtaacgagccacgaaattaatcggagacacgccattgagaagcgtattcccagagaccgatctcctagtaaaacatggcgaaaacagtatcgcgcatgttcggagctcgaaagcgagttgttccataccactcctggagcgaacggcgacggggctggcgggccgcggcgcgggttcagtcctgacgcagcaggccacctcgtgcctcccccgccggctcgcggcggagaaggcgtggagcagccggatacggtggccccccgcggcgagggcggcggcggggaggcggcggcgcgcggcgaggaggaggccggagtccccgccggcggcagcggaggcggccatgaggaggagcgactggagggaggggcgcggtggcatcacgaggtctagggtttcgccgcgcggggcatgcggggcgcggagcagaggaggcgagaggggaggggagaggggcttggggaagaagaagaagaagaaggaggagggaggagaggatggagtttggattgggtcgcggaggtttagggttttacacatcggacatgtgggccccaccacctagagatagatagaaagagattgggttttggaatagagctgtcaaaaaagctctcaagctgctcagaaaatctcagagctctcaagctgctcgagcttgattcgttacaagcttgaatactagataagccaagcttaagcctaggctgaggctcgcaagcctagcaagctcgagctcgaatagtttggcagagcttgattagcataagatgcattatatttaggaatatgttcttatggatcaatgtatacttatcactatgcttgacctgcttaagtcttaagacctcatcaatgcttctcaataaaacaattatccggctgctagtaatagtactactattcctattagatgtagtagctagcttttgttaattgcaacgtttcaaagccataaattcatgagaaaagctgcataggcttcattcaaaacgagtagcacccattaattttgactaccgataatttgcattaatatcttttatacaagagtaagttctttgaagttccaccaagtcaagctgtcaagctcaagtaggctcgaagctcgctcgagctcactcccaagctcgatcagtatccaggctcggctcgttgacagccctattttgaaaggttacattcttttctctaaaccctaaacctagaattgattgaatgatgattaagattttcatggtacgctttttaaactgtggaatggtatgtttcgtatgaaaactttctatatgaaagttgctctaaaatatcatattaatctattttttaagtttataataaataaaactcaattaatcattcattaataccaccttattttatataaaaaaaaacttaatcttcatcttcagaagaaaaaaacacaaccgaagataaaaaaaggacaggatttgaaacgtaggtgaaagcggatgatgtagttcgaaaaatagagttgcacggatacgtgagaaattcatagtacaaagttgtttttgaatttacaccaaaaggaaagtttgatttgtattttgaacttgtgctactctctctgttctaaaatatagggatcagagtatatctaagttcatagtaaagcgttcatgaaaaagtttatagtaatatatcccattcaaacaaaatctttttatattttaggagtaagggagtataaacgaaacgccaattcagaaactttatccccaaaaagattaaaaaaaagaaaagctaaatcgcgcgtgggcccaagtagtagtcctcctcctaactcaggctaaatctgggccacttctaggcccagtttaagccttagcccagccaagcccaacaacaacctcccaggcccaatttttgtcgtgcctatatattgctgttgaactcttatttgccttcttgatccggtaccaatttgaatcaccaatcccattgaattcaaagtctcctgctgtttctttgttgaccaaatgacaaataccatacctgcgaccgaaggtgaaagtacattttacgggaccatccgtgatcgatccttcatctagcagctagttgctgtaactttcccaagtcctcgtcgtcgtcttctcccagctaagcaattaagatgtctaaagctgtaggtttaaaacctgtaaaagttgcaatcaatcaagctcgagaaatcttggccgatcgataaatgtactgtacagaacgtatagctaatttctgccgtctcgatcgtcgctttggctggagtagtagctagactttgatgatgcacatccctggttttccaagagcaaatagagtacatctggtcaataggaaacgtgctgtcatgtagccactctattgattcaaagatcatggccgcggacgtcgtacacgagagcggagtcgtcgatctggtcgtccatgctgaccatgtatgtagcagtacggttgcttcctcgttccaaattactttatcatttttaacttcatcttagttagtcagacatttctaacttcgagtctcaaattctaaaaattcacctagtttaacaccgtagatttatacatgtttttggattttctgaacgtacatattgttaaaatatataatttcaatcggtgatactgcgtcaataaatttgcacgttgtatattaaataaatgtcgatcgacgatgtatctatactttcagtaaagttatagtccaataaatctaaatctcaacatgcatgtcacatcgtcacccactagtaacaattgcatatctaaccttgtacaagcatataacatcatctataatttatttaattatacaaatcaacatgcaagcgtatccaatcatcacccctcacattatttgcacgatattttaacaaatttatctattattttataatatttaacatatatttatcaatatatttcacattaaagtacgggtatcatttgttcgttttacgataagtattgataaactctaatgttttattattatttttccttttactcatagtttgactgtcgagaaaaatgtattaatcaagatgaagtatgttcgcgttgcatggttggcgtacgtgttgacaagcatgcatgcatgaatcgatggatataaactactattgtactagtagtggtcaaacaccaacttgtttgtgtctgacaagaaagggaagagaaaaacaatagcgtgttcaaacatcgtcaaaggccaggcgtctcggttatacagacaacttgttgagaacacggacggaacgcccagctgattattcagaactacatgcaattggcaacttgtgcatggctgcatcatgcatatgcttcgcacaatagatgtgcatggagatggtgacttgtaagagggagaacgcgtcatgctgtcatgcatgcatgttgatttgattcagtcctgaatcatgaactcctcacataaacgtattccgatataaaattgatggtaatgattataagattttaactgaatcttgtcctaaagaattcaaacacttatgatcaaagggtacatgataattaaatgtttgaactataatacggagtatattcatatttttgtggtgggcgcagtcgaatttcgagctattcttttatagtttctaatcttacttcatgtattattgtattttcttcgcattgtttgttgtggatgacactgatcgatatatcatataccaaagtctggtgtggaattgaattaaaaaaaaactacaagcctttgctattcaaaatatatcccaaactttaactggcttgctcttcttgcatgcacatatttatttttcaaaatgcaataacacaatgcagctagataggaaaagaatgttgttttcagctttcttttcgtactttcttcaaaaaaatacatatatttatttttaccctcaatttacccaggccaatcccaacccaatacactagatatagtttccataaactccacatcatcaagaaactagtactccactagacactacttttctaatacaaacaccactatccatacttaaaaatttaatgctacttatctcacatgatgtattggatgttatgtagaaactatgtttatgcaaaatatggtttccttctctttcctcatttattcacttgccacatcatttttcattctaggtggtagcctatttaatgctatagacaccatcctagttattgagttggaaatgaccccatactcgttatacgtacgaaaatccattaatgacagcaaaatcaatagaatagaaatgcatgctgaataattcatgaattattattccaatggacatttctgacaggatcatatcgattgcaatcagcacataatattaataaccataggtaagacatggatgaataccaaaggagaaattaaagaccacttgagaagtcaccgagtctatatctcgatcgatttggcattcatcagcactaactaagctactgaatagttaatcaacatcctactataatttttcagaaactcaattgaagagaagtcgatcgagatctctcatctctcatctcatctgcttaatttgctcaattaattcatcaattaatcgagctgagatcgcggttaataacaacggattaattagctcttggcggcggcggtggcggcgtggaggacttgctggaaatggctgacgtcgcagggcacacggaggatgccctcctgcttgtacccgaactcctgcgccgccttctccagcagcgccgcgaacgccgggtgccgcagcgcctccacccgcaccacgaaccgctagccgccgccgccgccgccatcgccgtcgccgccgttgtcccccaccatcaccggcacgcacccgcgcggcacgccgtcgccgccgccgccgccgcccgcgcggtccgagaagctcagcctcctcatcagcccgcgcttcacggccgccgccgcgccgccgccgccgccgtcgccgccgccgccgccgccaacgcggtcagagaagctcatcctccgcatcagctccctcatcgtcgacacgttaagcttgtggggttaccaaccggcaccgattagggtttctgtgttaattagagaggattatttcatgcatgcgtttgctcatcatcatcaaggatcggggcgccatttataaggaagagagatccatgggatggaatggaatggagtggcttacattctatcagaacggctgccacttgttgctagtagcatgagcgtgtggaataatgatttcactgatcagtgacatagacaagctagagagagagatgtggcatggaggtaataatggattaattaagcaggaattgaatggagagagaagacgtttactagtctgtgcatatggttggcgttggtcctggggttaaccttatgaagttggggttcaaaaatgttggctatcatatatgagcatctttgaaagttaagaccgtggaatttagtgattagatgaatgcaataagtagtggcagtaattaattatttaattaacctatgtaattgagatactcccttacggcgggcaatgcaaaaaatacttgataattatattatatcaaataaaaaattgatgtctgatattagttatacggatttaacgtggaaaaccctcttatactaaccacccctccctaaaaaatcacaataatttacgatgactgagaactcaacagaacttacgacacacttcaatttacgaatctctactaataaatatcaattgattagattcctcgcgaaatttcaatttcaactagctagccagatcagctaatcaacaaattcactctctcaactgcactgattataaaataatcccggatatccctaaatttggattgttccacacctaaaccccatgcagcagctaaaagatgattatatggcacattatttaattcaaaccaggaaattcttcttcttccttccggtggtctcagggtcgaaccatttaatttgtctggttttggaacgtgcaagctggtattccatggtgggcttgaaattgttgctgagtgcgacagtggaagggcagagcgaggatactagctacccctgttgacaaacacacacgcaaaatcgcttttaatttttgtattatcagacgaaccaacaaatcagccagttaacattacattatttggaaacagaagatgaataagcctgaagaccggagtaatatttctagatgacatgatgatgcatgatttggaaatttgctaatctattctaaaacaagatgtagctagctatatatagctagttaggtgttagaattttatatgcggaccaaccggcccatagcctagaaacgtaatgctacgtatgcatgataagtggcttagcatatttacatgcatgatttaatttagaggctggttctgtttgatcgtgctctgagaattttcacctagctatagctagatacactctcaggcgttcgatcgatttcgaaggccagggcatcatccaaacacaatatgcaaacagaaccaggcctttggaccgaccatagtattaattaatcgcttcattttctttatttaatttatttattattgttatctttttttttcaaaactaatggctaatagataaatgatttgtgataattattcgaggatagaaacgaaggaattaatattataaagttaaaaatagattaattcaaactatcttttaagaagtatacttttctaaaaaaaatcgtaccatttagaatctcgggaagcatgtgcatttatcacatcgctccattcgtcgaaagagaacaacatgtggccatatatacgcatgagcgcacacgagtgcaaatatgacttcatatatagcgcaattaaacatatatactaaagcaaaatatatactagaatttgaatcctagctactcccccgtcccaaaaaaaggcaaaccctgggttttcgtgtccaactttggctgtccgtcttatatgaaatttttttataattcgtattttcattgttgttaaatgataaaacatgattaatattttatgcgtgacttgtctttttaatttttttcataattttttcaaataagacggacggtcaaacgttgggcatggaaacggagggagtagtttttaaaaaataacacggaccacaagtatcggtcggagtggtccactagctagctagtttgatctgaaacaaggcacgtactccctccgtaaaaaaaaaaaaaagacaaaccacacaatcagtaggctcgatcgctttcgagtggatcaaccctccgaccaacccgcgcacggacgtcggcgtcagatcacggcgcgtgcgacttgactaacgaccttaacctgatgagcgtggtcgccgcgttcaacaactttgcaagctagctagccgcgatgcatccaggaacaagccggtagggcggggcacaggacgcgcctagtactacggctactactgcaggctgctacgtacaacgtacgcaatgcaattctctcaagactgcagcagcttaatcctatcttactataaaattatcccccactaactacttaagcttaacatgcaaagatgccacatcattatccactaacaataatcacatttaaacatcatgcaaacatgctatatctttatatatttttttaatttaagagcttttcaaatacaaacatgttaaattatcatctaacgtaattcacagaatatttcaatgtatatttgttatgttttatgatatcctatatacttatatagttcatcctcacttagttagtgtttaaatgattaatctatggtacaaattatctttctcctttttccctctaattaagtcatatcacatcaattgtttttagcctttagatgattaatctacggtcaaactatctctctacctttcttcttccataaagtcataccaccttattttttacgtttgaatcaccattccacatactatttaaatttaaattatcataaaccacattaatttacttaatctgatgttatctagctatcttacacgttatttttttaattgttatcatactaaattcccgcagcaatgcgcggggtttcacttagttatcctataagtaaaactcatttaattttgatcaaaagtttataaaaaaagtttgtcataagtaacactagattagttttattaattaattagatcccaattgaatatatatatcatatttttatatatttgttttgcatgtagaaaataatgccatgtttttgtttttctgatcagacgtgaagaggtttgacttcaaataaattagacatcaaacatctaattacaacatgaaacaaacggagtgtgtactacttatctagtagcttatactatacttctatctctgttccaatttaagggcaattatcagttttcgtgttcaacgtttaaccgtccgttttatttaaagttttttttaaaaaaatagtcacacataaagtattattcatgttttatcatctaataacaataaaaatactaatcataatttttttcaaataagacagacgatcaaacgttgttaaaccttgtaaaactacaacctttttgtaacggaggtagtaagatttttatttttagttttgcaaccctgccagcgtaatcaactctagctaatacggccagactcggacttcttcatatataaacagtagatttagccatgttacaatactactagtgtcttcaaattaagcataattgaagcacataattatggggttgtcaatttaatctttataaatatatgtactatgtattaatacatttttagataatagaaatggttacatttccggtctctgtcaacaatcacacacacagccaatatatgagtttagcgttgaagaaaaaggaaaaacaaaattgagtgatggaacaagcccccatccatccaaaacagaacagaagttcattagttaccaatttcatgagggctagcaattccatgagtgtacatatatagtaccactgcgcatggtatcctactacttttgatagcatcaaataccaagtacgaagctaattggtagacatgaagataacccagcaattttttattataaaaaattatatcatttcggtaataccaaattgaccatatagtacactaaccacaaataaaatcgattttttttggacctggccggtattaccataaaccaatttccaaataaatacatacgctggcgattgtttaactcgtggcttagatacaccattagaccggtaattcatattcgctagcttgtgggcaccgcaagtggtccccttcaactacatacgaggtgtcttcatgtgtccctgtacgtatatatatacgtctttgtcttcgtgcaccaccatacgtacgctaattcgaagcttcctttcatcttcacatggagaacgaaaactgctagctagtctgctacaattgattttttccacgccattcgttttctcgagatgtcgttttaggggcagtttaatttatccttttttttctatctagtaggagtatatgcgcatggaaaaatcctaatcagtgaacgctctctagcatgaactccgcataaaaaacgatcaaacatatcaacagcttaatttgcattttctttagttccttttctatttttttccttattatattatatagttttatgttggaattgaacaggtgcatcggttttctggagaaaggaacactcaccgcttctttatcagagtttgagaagaaagagaaaaacacctcactcaatattgaataattttgtttcagatataaacatgctatctttaagagaagtttgcgatatgataggaagtttttattgaattttctaattgaaatatctttttatatttttcgaaagtttttttgttacaacgcaacgcagcagctgtaagtctgtaaccagtgctttgttattggctacttttttacggagatattttttttgttgatattggttacttaatttgatcatctttttgagttgacagctacattaattagcacagctgtacgtaccggtactgcttgcaaatggacatcaataaattaattaatattactgcttaaaagaccatgcctagtttgtaataatttccatatgcaatatacaagaattgaccgtagaccaacgggtgtgtattattttcttatcaagccgtagctgacaaccaatcgaaaagaccatgacgagtctacgatgatgtcactctcttctctaaggttaatttccaacaagatgattaggtgaatgataatcgtcttagccatccatccattttactgtttccttctagaaaccacatgagtggccactgtacaattctttttccacatgacaggatgcatgccaattttgactcagcctgcggtgaacaaaatccacatttcctgatgctagtaaaagttcttgaaaataatgatatcttcgttgaatcgaatcgaatcaaagacttttgtttgtccttttcaatctgcacgcttgcaagactggaatttagtacagctggttgcagcaaagataaattaatcaagctaagtacgtagagaaaacatttggccaattgtgcttagtttttgttgtcagggcacaaattagattagctagcttagaagagatcgaccgatcgaagtggcatggtcagtaaaaacaggcttaatttgcattttatctttctgaaacttcagtggtcaagctttttaactgactgcagtacgcctgcctggcctttttttccgaattcgttgaagggtgacctcatgatttatcacatctttgtccatggtgacatgacttcttgaaggaaaaataataatataagtgccttctattgtaggtgcgcatcaacttcgtaaatactttcactctttttaatcaagtgttccgttcagtctttttccagttggtaattaactatgatcaattcattcaaagtagttcttggtgtgtttgaagtgtgattatgtgaaaatgcctctctctttttcttttctttttttttgcagaaaggtggcatgacttgcatcaaggaaaggtgttaagaattccattggcttatgcaagatcgtgtagaaaaggtggcagaaaagtgatttccatggttatacaagataacaagattgtgtaggaggaacttctgcacacagttttgtggtagtcttggtgatgcttaatttggaaatgttttgcaattgctcgtgttattctgttctattaccatatacaaactagctaggcccaaatagagcatgtcaaactccttttttctttaatctcgatgcgttccaactgactccaatattgatctataatattatatgaagcggtgttttacttttagaatcagttgacaagggtattttattccaatattatccgtgacttaacatgaattgatttaattgttagaatatgtgtggttttttttagcatgtcaactatttttatttcttaagggtagctgggtatttgtcccaccacactcttttattttatttaagtaaaaactaattggttgtgtgcattgtggtagagaccggggatcaaataaatcttcattagataaaaacttcttgtctatatgtgttagttacttgggcctaggtcaatattttgcatggattttaggaactagatatcttagatgtcttagttacacagcagcttctgaaagttgttccctatagatcaaagatcacaaattctcaataatcaatagctagccttgcttgaattgtcagtaacatcgaatgcaaaatctaattaagtactaaaacaaaggacataataattaatcgaacaccgtgtggtaggattgacacgacatgcacgagagtacattggcaagcagaaaaaaaaagaatgatgaaaatacgaaaggttaaagaactaaattgaaaaaaaaaactggcgccacaaagatggaaatttgatcatctcaagagggaattcctctcaagaggcacaatgtcgttcctttcaaattacaagtctaataagcccacctgcacaggaagcccatgggcctttcctcctgggccgttttctttccagatttagacacgtccatctaaagtcaagcccacacgcttttagcataacaagcaacatattagcccacaaagtttgcacaattgacgccaatactttatacacatcaataacaacgtgggtgaacttcttcatctatacaacgtgggtgaactcctgaagggagttaagatgccccctattgtgtaacaaagataaaatttcccaattcaaaattaaaaaaatcgagtatatgtcagtctccggctgtggtcgttagcagccgtcgcttcctttggagaattgttgggagtgtagagtggctctgccccattctgctgttttggagtagacttaccgtcgtatcgactttttttttccttttccttccttgttttgttatcattattttcttccttttttggcataggccggtctagttgagtgcatcgtgtaacaaaaactctattcttctaatatattgacgtgcaatctttttgcgcgttcgcgaaaaaaaaatgtcagtctatatacactcgatttttttttaaagtgaatctgtggtaataaaaataacggattggctataattatggcgatagatttttgtcataaacacagtcgaattttcagcattaagattgacacgaagattcgtgctcacagggcatcagcacacacgctttgctgtttttttctgatcgttttattcaaagattaccgaatctgactgttttattcaaagatttatgttgcatgatgattagatactcctatacaaatttacacaatagtttacatcccatttacacaccacttacatatgtaattttaggatttacatacgtaattttaagatttacatatgtaattttggaacttacattgtaaatacactaaaattatttatgtaatttagagacttacaatgtaaatacatacagactattttttagtgaaaaatatggcgcaataaatatagctagtcccaaacttaatccagagacgcttcacgcttgcatgcagccgtcgaggagaaagatctaggtcgacgtcgtcacggcgtgcatgcgacttgtcggacttgacttgggcgcgttggcctgcaaccacgcgcatatgtacgtcgaggagaaaaatctagccagctggacgtgcgtacgtagtgcgtgtacactacggcgctactactacttctcccaagactgcattgccctttgctatctgctaaagctttgcttctaaaatactcccgctcgacaaaattcgacggctaagttgaaatttcgaacgaatcgatagttaggacaattttctggtttaaaattgggtacttttaatttcttaccgaggcagatgagatgatcatccctcgaggtgacataccctctcgtttcttgtatgtcacctaataattaagtaataaaaaatttgaagaaaatggtaactattttttatttttgttacaacttatatacatcaaattttagcttctatgtgtgtggagtaatatatctcatgctaatctaccttatcatttaaaaatcatttttttaaaagtaataagtacttagatgactggcaagaaatgagaagatttgaatcccctcaagggatgaagaatatttttccaattcttgtacaaatgaagtcgattctttcacaaatgaagtcgagtttgcacaagctaacatgtgtgaattcttttatttttttacttagactttttgttagagtttgcatgagttttcactaaggcctcgtttgattcatagggaacaatagagaaaaaaacataggaacaagaatcctacggaatttggtactattcatccctttgatttgtaggaattaaacatagaaaaagcatgaaaatatttcctatgaccatgatttcaagagaattccataggaaaattaacatccaccttgagctcatttttcttttcctatgggtaggatcgaggcaaaatactattggaagataaggtttaaccctaataaaaccattcaaattttgattgctattgacttaatactcaacattcctatgtttttcctttataccaatcaaatatcattcctacaattttcttatgtttttcaatcatctgttttgcatatgatttcctatactattactgagtttttcttattcctacattttttcaatcctatgattcatatgagctctaagattgagttttcaccttgcaccgcatatttagggtgggtacagtagtgggagtacaccagctcagctactggagtactggagtgagtacaccagctcagctagctctgtcagatgctcatgagatttctctgtttccagtactaaggcctctcacagtgcggtgagttggattggtgtttcacagtgccagcttagaaaaacgcagacgtggagggtgtcgccgtgcccctgcaaagcacctcgcccccacgcagagcgccgcacttcctcctctcggcgagtccgcgcgcgccgtcgcgaggcgaagttccgcgcgctgtggagcacgtgtccgtgacgagcgcgtgccctcgcggcgaacgggaggtgcaatccccgattcgccctcccaaaatcccctcccgccacaacattatttctcccgccatagatcggattggaagagaaaaggcaataaaatcttggagattggaagaaagaaaagatcggattcgacaagatgaaaaagaaaagcaaagcaaattcatcacagcaaattcatcacggcaaaatcatcccagcaaaatcacgacgacgacgacgagccggcaaccacgactccacctccccggccgcgcgcgcaccgacgaggagaggagtcctcccacgcgcgtcggtcgccgcggcgtcggcgcctcacctccccggtgtcccgcttgccgcccaggcgtccgccgcgagggaggagagcacaacgaagaggaggaagaaggtgaaggggaggagaaacgagcggcgcggccgcgcgggcgacgacgaggcgcacggcgacgaggaccacgccgttggccgccacctccaagccagagggctcgagcggactgggccacgcgctgtgttgagttgtgatccaaattcatttgcacttaataaaggctagcttctgccgtagcggatcatcatcccttttagggttccactatatatatacctcttgtaagccgccgtgcggcgatgtaacctcacctcagatatagtgaagatattttgctggctggcgcccgtggttttttctctcctgttttgggagggttttccacgttaaatcttgtgtcttttgtgattgatctattgttctttatcgtttgttcgcctatcgtttcctaacacgctggcctccggccgccacgcctgggcggacgtagacccccaccctctcggcctggatctggggcgtggtcgtgtgggagcggaggagtaagggcggggcgaggggaggagaaggagtcggagtgcgggaaggaggtgggggaggaggcgtgcgacggaggaaacaaagagaatcgaggaggagaaaggggtgtcgagaccgagcgctggagggcaggtttggaattatttccttcacctgcccgtgccctcattttggcagggtacatgcactgtggactcggttacctctcccactacatttatccaattaaactactgtggactcggttacctcccccactgtatacaactaggggtacttgcactgtagaataggccgtctttaggccaattttttgggttaggggtacgggccccatagcttgtattgtgaatggaccaagctgtcgcgttggcattctgccacgtcatcaccgggccacgtgcatgcgtccgttatcctccagcatggacgtacacgtacgttggatactccctaaaataaaccaatcttcaggggtgaaataatagtttattttaaaacggacgaagtacgtgtatttgtacacgatatgtatatatagctaaaataataggttgttcgttactttgcgttggaaagttctccacatcaacacgaaaaatggaatagctcattagagcataattaattaaatactagcttaaaaaacttaaaaaatataatacttcatccgttttataatataagtcattctagcattttttatatttatattgatgttaatgaatctagacatatatatctatttagattcattaacattaatatgaatgttggaaatgctaaaatgacttacattgtgaaacaaaggaaataataagcttttttcaaacaacgtttctattttttttaaaaaaaatagtattatttatcaatttaagaagcgtgcacgttgaagaaaaagtgtaaaaatgatgaaacgaactcagtcaagtgtagaatggtctgatggctatgacatgcatgttccgtccttgttacaccggccagctaattaactagagcttgctgggtagacaagtgacaacagcaatgtctgggaaagtcatttcaaccctcgaggggatatcggctcatttcatgcattccacctaaatagtcataaaaaaatatgaaaaaaaaggcaacatagattaatataaaatatatcactctacaaacatacaagtttaaattcaacttctacaagttgtaacaaaaataacaaatatagttgcgaatgtatgataactattttcagtttaatttgttatttatgttgcaacttgtagaagttgaatttggtctatatttgtagagtgatttatttcgtattaatctatgttatcttttttaaaaaaaattttgataactatttatatgacatgcaaacaatgaggggatgttccctcgggcgatgaaccacatccgcaatgtcttactcaaaacaaaaggggaggagaaactgcaatgtcaatcctactaattggcttcaaaaagatggacaatattacacatgcaccaataacgctcaactaaggttttgtgtggctgataaatagcctgatatatttacaccgaccaaagggtcaaattaatcaagcagatgcatatgatacatatgatcgatctttgagcaaacgatatatgcatggatcaatccagcggcagatcttaaaaaaaaacgattcgttggtgttataacgtatttattagtgttatagcatacttgttatgcttggatcatagtgttataatatatgaataaacagtttcgttatagctaggttttgctaaaagtcatcggtatcgccaccgaccattacactgtaaatccaccctgtatcgatcgattgagtctccatcgatccaactatatatagcaacatgtgcagttttcggtcaccactaggtagatcgatcatccctataatcatcattgtacgacgttgcgtgttcgacggctggattaattggtttgaataatttttggtagttaattatctgactacattttcccaattcttaccaataaagtcgagtttgcacaagctacatgtgtgaattcttttttttatatcttagatacacttttttgtcagagtttacatgagttttcaccaaaattgagtttccaccttccaccgcatatttagggtgtattcagtagtaggagtttggaactctccccgaagcaccgcatatttagggtgtattcaatagtaggagtttggaactctccccgaagcacacaaaatggagtgttgtatcagcgcatctatatactaatataaaaaggagtttgcccctcccaatcctattggtgaaatcattccatctatctcatccgttcatcctcatcccatctaatctcatccgtccgctgtacaccgtagctagtatatctcctctagcgattttgcccgatctcatcccaccagcaatttcggtccccatgcggtggctgcgcggcgcaaatccccgcgcggtgactccgcctactcactctgcgccttgctccccgcgcgcatcctcgctctacgcctcctctcctcactatggtccagcgacagtttaccgccggaccaacaacctcacgtcctcgttccgcgcaacgccggacctccttcatccttgcaacggaccaacgacaacgcaccatcgcaccgccagaccagagccgaggcactaccgcaccgccagaccggcaccgaggcaccatcgcgcagctgcccaccgctagaccagcgcacgccatctcatccccttcagccggggactgccccagacggtggggtagtggttccccctaccgccggagccgttgcggcgcacgccacgccggcgccgagtttgttcgacattctgtcaaactttcttcgagatgcttaggaactggtgatttggggactacttcaaggtggaggccattgggttagcctgggatcatctcactcaggttttcttttttttggatccttttagattccctttttattctcatgcaattgtggccgtgctgtgtgaatctaatgtctcttctaattgggactggaatcatgagttggttgggttggcattaaactgttttgagctagcgaagtcttgataaataatacttcctccgtttcacgatataagtcattctattatttcacatatttatatttatattaatgaatctagacatatatatctatctagattcattaacatcaatgtaaacgtgagaaatgctagaatgacttacattgtgaaacggagggagtagaagagttgttacttgtaagagatgtcttattttctgatcttgtcgagtacaaataatagataagagacaaacaatagatgagttgttgtgctcgacaatttgggaagatgtctgagtacaacacacctagctttatcccctataaatacgtttataccccccagcctgaaaagttaaccatgcaggcatcaaatcacacagcactaactcatcaagagctctacatatacatactaattaaacctaaatacgtagcctgatcagtttaggtttgtcaaacgccatggatatggagatgggtaaattgcttcatcgcccatggaaatggagcttaaactcgccgctactgctgctgctcatcgtccccgtgatgatccacgtacagctgaagctacgtcgtcgtcgcaagaacgccgccgccggcacgaggctgccgccggggccatggcggctccccgtcatcggcagcctgcaccacctcgccatgaacccgaaggcggtgcaccgcgcgctggccgacctcgcgcggcggtgcggcggcggcggcggcgtcatgtacctccgcctcggcgagctccccgtcgtggtggcctcgtcgcgggacgccgcccgggaggtcctgaggacgcacgacgccgcgttcgccacccgcgccatgagcgtcacggtgagggactccatcggcgacacggtggggatactcttctcgccgtacggcgagcggtggcgccgcctccgcgggatctgcagcctcgagctcctcaacgcgaggcgggtgcgctcgttccgccccatccgggaggagcaggtcgcccgcctcgttggcgccatcgccgccgccgccgccgctcccggcggcgatcagccgccgccggtgaacgtgagctggcagatcgccggggcgcttaccgacctgacgctgcgcgccatcatgggggagtgcggcttccgatggcgggaggagttcctggagacgctgggcgaggcgcagaggaaggcgagcaggttcggcgtcgccgacctgttcccgtcgtcgaggctcctccgcgccgtcgggagcacggcggtgcgcgacgtgagggcgttgaacgccaagctgttcgagctggtggaccgcgccatcgagcagcaccgggaggcggcggcgacgactgcggctggcggcgaccacgacgacggcggcgacgacgacgcgcgtgacgacaacgagtgcttgctgaatactctcatgagaatccagaaggaaggtggtggcactctctccatgtcaacagtcaaagccgttattcttgtaagttctttttttttatctaagactttaatttaattttcttttaaagagtcacatggattttttttatctatgactttaatataattttgttttaaagggtcactgggattttttacaaaaatatattcttactagctattccctagtgatccatccatccaaagtctcttatattttcagatggacagagcatatatatgaagcaaatataaaatattatgtgaaaactatttgcaatattaatctatcagtacaattttatactctaaacacagttgtcatttaattagggttgctatagcacggaatcctatccaaatagtatactctcacgtatatatcatatcttaatacctccctggtatcacctgatactcataggtatcaaatttggtacctaaccggtatcacctaatatccataagtgccaagtacggtaccacataggcctcgcctagtaccaacaagtatattataactcagataccatctgaacctctggttttgtcgccaccttcgtcgagccccttcacattgcttgcagtcaccattgccatcgatcccctccacctcgcttataaccgagtaggatttcggcaatttcttaactcgtagagatatttttccgtaatttgaggcgaattcctaacaacgtatacggaaaccaaccgtacacgtgaaggtataccttatcggtattttccataagtcgtaggatagagggtatgccttatccgtaaccctgacaaggacctttgccaccgaaccaatagccttggatgagctcctccaatctgtcgacgaactcctccactgccatgaaacctcatgtgtggcgcttgctcccccaatctccacaaggtccaccactgagcccacccggtggctcctaggcgcttccccaccagtgccaccacaacccgaaatgttccccttcgcgagtagattcagctggtccgctcccaccgtcttattgtcgagtacaccggatttaaaaggatgtaggcggaaaggagtaaattggttggaggggatgagggcaatgggagtcagggcaagggaagaaggttgattacgatggtggacaaagatgagagatcaaagggctccaacagccaggggaaggaggagttacggcagcaatgttgcactatgggaggatggaggcgaccgcacttgcagcgctcgagatgccgaggggaatagaggatatataagcaagtgggatgggatcccgttaaatagcgtttttgtaattcaattattgacacaaatccataaatcttgatattttgaaatcagaacatgctaaacaatcagtaggagggtaataatattctttgcttatttacatatcatgtggtatttaaaaggggccgataggcgagccatgcatagcacgactgatggtagtacgattggttataattcttggacctctaatgccagttgtcatagttactccctttggtcataagataaataatgtcttggactgatataaccagtcaaaactttgattattatactttgaaaagtacatagttttataacataaaaaatagtatatatgtatatcactcttgaaaagtgcttttttaatctcataaacatagtatcctttttaataaacttattctaatacaaaattattgtcaaaatcgcacttcaaagatcgttaaaaaagtcaaacttattctaataccaaaagaattatatatttgtgcatgaatggccgtctcgtgctttcatgtcttcaatgcacaaaagtggatgaaattaatccatctaaccttgcaatatgctaacgtaccctccttaatttcaacatgtgctaacatatacgcatgacatgcattggccaggacatgtttgcaggtggaagcgaaacaacatcaacaatacttgaatgggccatgtcagagcttgtgaagaatcctcaagtgatgcagaaggcgcaagcacagatacgacttgctttgcaaggaagatctagaataacagaagatgacttgataaatttaagttacccaaagaatataatcaaggaaacactaagactgcatcctgtagcacccctacttatgccaaaagagtgtcaagagtcatgcaaaatattaggatataacattccaaaagggtcaatcatgttggtgaatgtatgggccatcggtagagaccacagataatgggatgatgcggaagtatttttgccaaagcgttttgagga

SEQ ID NO: 43896 - DNA, 2171 bp, Oryza sativa
cttcctcctagtgttacaccagatgggttggacatggaagaggaattcgggatgaacgttcgtagaaaaagggatcttcatctacatccagtaattcatgttggagtagaaaaaggtataatgagctagatatatggttaatgtaagtgcatttttataggtgtgtatcgacttcttgaataatcatcctcaataaagttgcacgactctcttaaagcggtaagcatttttttaaagattattagcttataactggtttttaaagctatgcaagatatggtaggttcttctgcacgctgtactgtcttcttccagtcttcgtacttgcattggatgcctaatttctttgtgttgttctactattacctggataattgcttgataaacaataaaagagaaccggacgaactagttaggcccaaataaagcaggcccaactttgcccgttagatgtcttggttacttcttacttgggcctggttttctccatggatttgtgcagccggacctgtaaataattacaggtagacagtagtattaaaaaaagagtacagtactacatccatcagcagcctctgaaaattattcccctgagaagaaaaatcgcagattctctaacaaccaacggccttgcttggactatcgagtcagctgacagctagtgacgaaccagtatgaaccaaatacgcgtagtatgtaacttaaatggaattattaattatattgcatttttaatagcaggaatggcacttactattaatttatactcccactgtttcgttttaattgtagttgtgagtttctatgttcaacatttgatcatccgtcttattcgatttttttattagtatttttattattattatatgataaaagattaatagtactttatgcatgacttatatttttaatttttttatatttttaaataagatagacagttaaacgttcacggaaacccgctaaaatagaacggacggagcatattgcattcaacttgagatacctgagcattatagcatcactattttctcatgtagtagtacggtggtagtacgaaatgacactttttaaatcacctccactgatgatccactccactccactcctctcagtttctagcttgaccatgggcggcgaccacaggctacaaccattccaaattctagagaatctcaactgcaaattaacaaagttgtagcactactcctaattatgaaacacaacacatgtccagctagctagagaaatcatatctctgcactgcatccatacatcacctgccattcctcttctcacccaaaaaaaataatatagcaagaataattctcctgtacatatgtgtcatgaactctgaagaaactatataattaaagagctagaggtagctaatttctttaaagacaaacatgttaagagtagtagaaagatagctgagcaagctgggccatgtgcagcttagcaacactgttcgcatccgcgttatagtgtggttatttgcttcgtcgtcgccgctgaattggcgtgcaagctaggctgaattatatcctgggagtttagtactagacgccgttgtgttcagacaatctcgctttcagactttcagtcgttttttttcagagtttcagagtgattgcgagtcaagctagctatcagccaataattaacgaatgattaaatgtgtttccgccgttacgcggttggatcgatccaatccatcgatcgccggccggtttggggcaggaggcaactgtctgcagctgcatgctttcattgcttcctggtctcttcttcttcttcttccctgcagccatggatggagagagctcgagctcgacgtggtctccaagctggaaagagagctatctgacgcgacctgatttaaccctctgcgattattctgcatgtgtcgtgctgcgctttgtgggagtactccgtactggagtgagtacaccagcacagctagctctgtcagatgctgatcatgatctctttgtttccagtgctcccacaaagctgtcgcgttggcattctgccacgtcgtcaccgccacgtgcatgcgtccgtggcatggacgtacacgtacgtacgttggatactccatcataaaattaatactccctccgtcggtccgtcctaaaatataacaacggttaggcatcagaatttgt

SEQ ID NO: 43897 - DNA, 1420 bp, Oryza sativa
agcacgaaaaatagtgtgactcattagaatatgattaattaaatactaacttaaataacttgaaattatattaataagtttttctcaaataacttttatataatttttttaaagaaatatatcatttatcagtttaagaagtgtgcgctttggagaataaagagagcataagttgtaaaagtggtgcaacgaacttagccaagtgtaggatggtccgatggctacgacatgttactacgtaccgtccttgtcgttacaccggccagctaactagagattgttgggcagacaagtgacaatgctaacggcaatgtcttactcaaaacaaaaggagaggagaaaccgcaatgtcaatgcctactaactggcttgaaaaagatggacaatattacacatatgtatcaataacgctcaattaactaaggttgtgtggctgatagatagcctgatatatttacaccgatcaaaggctcaaattaatcaagcacatgcatatgatacacatgatcgatctttgagcaaactagtcgatatatggatgcatggatcgatcgatcgatcgagtctccatcgatccaactatagcaacatgtgcagttttctggcaccaccactagatcgaccgatcatcactggatgatcatcattatattgtacgttgcattcgacggctggatgatgatcaaagattattaggtgcacgtaatcgatcgatctgcagtgatgaacgcaggttcaatcgtgcacatgtgccaatgatccaaagccgtcgctgttcatccgactcgaactcctcttgtcgacccgaaagagatgcttgaccggtgcagcccgacgaatgcatgaatcgtgcaccgttggatcgatcgatcgtccacgcaattcatcaccaatggcgtcagatcgaaagcaaccccaaatccacccatctatcgatcaaccccaaagcacggattaatttgtttgattaatttttggtagttatcaggctgattatgtactgataattaatctccgctgatccggccgtttcagcttaatcatatccattaactgttccggtcagaattatccctgtatttaagcaaaggatacagtactgagcatcattcatttgtactgtcttgaccgtgacagaaatgctttctcggtcaaataattgaattgctgtccattcaaaagggaaaagaaaatgtattttttgtgaatgcacgcgtgtgttgcgtgagaagctagacagtggccggtttaatcaaggtttggttaagttaatatcactccgtacttctcctcaatcctcatcagtcatccgaattttctatatctcaatcgatcgccatcagctgctagcaagtagcaacccagcaacctagctatagtcaagagccatgagtatcaaactgttacttaccactacgaa

SEQ ID NO: 43898 - DNA, 18568 bp, Oryza sativa
  unsure (1)..(18568): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagaaagtccaagggactctgttttatatgtggagaaaggtggggtagagaccataaatgcgccaatgctgttcagttacatgtggtacaggaactgatggaggctatgaattcagaaggtggagaagaacttgaagaagagcctcctgaagaagttgaggaagtacaattgctagccatttctaaacaggctatttcaggcacagaatctagcaagtctatcagactcaggggttggatacagggaacagaggtactcatgttgatagattcagggagcactcattccttcattgaagagcaagtgggaaatagactgtctggggtggagttacttaaacaaccacttaaggtgcagatagcagatggtggtcaacttacttgtaccaggttcatacctgactgtacttggtggatgcagggacacagcttcaagagtaattttacactaattcctttgggaagttatgatattattttgggaatggattggttggtacagcatagtccaatgcacattaattggtgccaaaagtggatagaatttcagtataacaacagtctggtcagattgctaggactttcttccaaaccaactcagttcatggaaatatctggggaacaattgttgggaatggctaagaatggtgctattatgtacatggttcagttgacaagagtaccaccagagcagcaacaagacattcctggatctgtacaatccttgctccaggaacatcaggatgtatttgctgaaccaaaagggctacctcctagaagaacttgtgatcacaagatacccctgattgaaggtgctcagccagttaacttgagaccatacagatacaaccctgagcttaaaaatgaaatagagaaacaagttgctgaaatgctacagtcaggagtgatccagcatagccaaagtgcttggtcatcaccagcactgcttgtgagaaagaaggatggcacttggaggatgtgtgtcgactataggcatctaaacaatctgaccatcaaaagtaaataccctgtaccaatcatagaggaattacttgatgaattgtctggctccaagtggtttactaagttggatttgagggctgggtatcatcagattagaatggtacctggagaagaacacaaaacagcttttcaaacacattctggtcactttgagtacaaggtgatgtcctttggattaacgggagctccagccacatttcaaggagctatgaatcagactctatcttctgttcttagaaaatgtgctttggtcttctttgatgacatattagtctatagcccagacctgccatctcatttatctcatcttaaacaagtgttgcaattattgaggcaagatcattggcaagttaaattcagtaaatgctcatttgcacagcagcaggtgtcctatttaggacatgtcattggagttaatggggttgctactgaaccaaagaaaatacaggatgtgttgaattgggctactcctgtttctgttaaaaagctcagagggttcttgggactggcagggtattatcgaaagtttgtcaaaaattttggaattatcagtaaacccttaactcagctgttaaggaagggagtaccttttaaatggagtgcagaggcaaaagatgcattccaacgtcttaaacatgccttgacatcggcaccagtgcttgggttacctgatttttccaagattttttatgtggagactgatgctagtgaagcaggcataggagcagtgttgtcacaagaaggccaccctattgcgtatctaagcaaggctttggggccaagatctcggggtctgtcaacatatgagaaagaatgcatggctatactgttggcagtggaccactggagggcatatttgcagcatcaagagtttgtcatcatcaccgatcaccacagtctggttcacctagctgatcagcgtcttcacactctttggcaacagagggcttttaccaagctattggggctgcaatataagattatttatagaaagggaagcagtaatgctgtggcagatgccttatccaggaaggattgccctaatgacgctcaagtgttagctatctctgtgtgtacaccaaagtggatgcaggaaataaccaagggatatgagctggatccccattcgtctcagctactcattgaattgttagtggactctgctgccagggaacatttcacattgcaaagtggtctcattcgttataaggggcgcatctgggtgggtaataatgaggatttgcaagcaaaactgatttcagaattacataacaaccctatagggggtcattcagggtttcctgttacatataggaggattaaaaggttatttgcatggatgggtatgaaaaaacaagttaagaaacagctgcagcaatgtcaggtgtgtatacaggctaagccagaaagggttaaataccctggtttactccaacccctaccagtgcctgcaggtgcctggcagacaatttctatggactttattgaaggtcttccaaaatctgaaaggtacaattgtatttttgtggtagtggacaagttttccaaatatgctcactttgttcctttgacacatcccttcactgctgaatcagttgctaccgctttcatgaaaaacatttacaaattacatggtatgccaaaagtgattgtttcagatagagataaaatttttacaagtcaattttgggagtacttattcactaaatctggtactgaattacatatgagttcttcttatcatccccaaactgatgggcaaacagagagagtcaatcagtgcctagaattgtttctgagatgttttgttcattccacaccacataagtgggcagcctggttgcacttagcagaattctggtacaacaatgcttttcactcagctgttcagaaaactccttttgaagtcatttatggttatcaacctgctcattttggaatttctatggaggattgtgctgttccagatctgcaggagtggctcagggatcgaaaatttatgcaccaattgattcaacagcatttgcacagagcccagcaacaaatgaagttttatgcagacaaaaacagaactttcagggagtttcagcctggtgattgggtgtacttgaaacttcaaccttatgttcagacttcggtggcccgtagagctaatcacaagctatcgtttaagtactatggtccatttgaagtgcttcacaaagttggccaagttgcttataagttgttgctgcccagtgattgttatatccatcctgttgtccatgtttcccaactgcgagctgccactgggttcaagcctccagtacaacacagtttaccatccagtgctggagctatgcaatttccacttcaaatcttggatcacagaattgccaagaaaggtaatacaattgtaactcaaatattaacacattggtcaggttcttcggtggaggatgcaacctgggaggacaaggaggagctgaggagccgcttcccacacgcaccggcttgggggcaagccggttcccaaggaagggaggatgtcagagcgcaccaagcatctcatcatcaagctgttgaggaggaggaggacccagaagatgatcaaggaggcgacaaggcgaaggacgaagtacaggaggaaggtgggaagcaagaaggcgttgtcaagagaggcaggcgtatccggatggagaatagaaaatacaaaggggccgaatgggccgtgtaacaatcgttgtaaggcccaactgaggctggtggcgaaggagaggttggagaggaagaaacgcaactatataccagctggcacaagcttgtaagaactcgatgaggaactcggcaaggtggcgatggcggcggcggctccgctcggttgagcgtgagaagtaatctacctatctagttcgagttccacatttctcgtgttcttcctggagtgccaagtcgctagggttcctaacagccagccacagaattcttcttctgtaccctgaccaaacacgcatttatcaatttatcaccagcgacatgtgcatatccaagaggagaaattttgagcatctctttgaagatttcaaataaataattcacgcaatgtgatttaatctgttgccaaagtcgtcatatatatcaagctaagaaggaacttaaattctctggctatattaataaacggtcgagaaaattctttacctagcttgctatatagatacttccctagccatatctctcttcctaatttctaatgcaaggtacatataatatatgaagctatcaatttgaactcaatcactagctaacaagtgactagctaggaatggaatttttaaggaatatatataaatatgctcaagccgatctttaagttcatgctttcacatatgcttttgatcacatgctgccggtgctagctagttatatatactgtcgtcagacataagtcatgatattgagatatatattcatatatatgcagctaattaataagtcgatcgctgcatatccctttcccattttattggggaaaatccagagaagagagagttgaattgacctcaaatatataatttacttttgcatgaagtctacctttgtgaattcaaaccaatatatatacaattaacccgtacatatcaagttgaaaacgtacgtagacacactagtacattagtactagtatagtatatcttgaataattttgtcaaacacatactagccagacaaataagatggctaattaatgttcccgttgaacaatgtaataattcaaagaaatatcaatatctcattttcagtttgtcaaagagagaactattcacactagcaatagtcattgtatgcagacccagacaaacctatcaatgaacagtacatgtcgatcccaatgggaaatgcatgagctacttgaactcatacttcgctgtctcgtgaacagggacagcccccaaactcttcacaaaactggggttcctatacttattttaaaactttttttttcttatctgtgttcagtaaagtagcaagtgagcatgaatgtttgaccggacttggtcagaaaattcagccttctctctcgatctctctcctctccacacattcgatttggtacgtttctgcacggtaggcaacaaacaagtacttgaatatatatatacttcttgggggtgttctccttcttcttcttcatatatcatcatcaccatctttatctccctctctctctctccctctctgcatatatatagctacttcgatctctttgtagcaaccatcagttagctagctagcttgaggtagctagcgcttgtatttatcagaagcttagagataattttcagaagcttagagagctatcttagctacaaggaattaccggccaatcgacggcgagatcgatcgattgatcatgggagggtttgagaggagaggagttcggcagtacaaccggtccgaggtgccacggatgcggtggacggaggagatgcaccggcagttcgtcgaggccgtcgagtgcctcggcggccaggacggtgagtttgaaacaccaaccatggatatgcatgtttggtattgatcaattcaagctatatgagcagattgatcatgcaattgcttaattattgcatggacatggagttcgctttgatgatcaaattaattgggattttaatttgctaggtatagatcgagctatcatgtttttcaagggaactgattaaacgaagtgctttcttgttctttttgttttttggtttagaaagtttggtctccttaattattagttggtgtcggttaggcaggagtttgaaaacgaacacagcgtagcaggagtatagttaaagaaaaataaagacacgtgatattatatgtgcatatgcacgatgaacacccacggcccgttctcttttggattttctacggataattaagactgaattaagcatacaatttaataagagttaattagttagatggaatatcattagcacaataatttatcaattggagccactttcatcctcgactagctagatatatatctttttccaaaattaaattaatatatgttcttcttgacgattttttatttttagttttcatctgaaagtaatttagatcaagtactttagatatttttacactctttttctacctttaatcgtgcatatatttgtaccttgagtactaacagccattttcgtatgtactcagcctgaagtactgatcagttattatcatttgcaaactaaaatatttcaaaagtttcaagtactatctcatttgaacattaccgtaattaattattgtgtgctttatccagcacggtccggccatacgaagctgaacgtactatcgattttctctatccttgagggagacataatataatttttggtctcatgatacatgcatggaccatggaataacagtactgcatcatgatgatatttgtttgtagatcattcttcagaagtgctgataatttatctcctctcgcttttgtctgacagaagcaacaccgaagcgaattcttcagttgatgggcgtgaagggagttagcatctctcatatcaagagccatcttcaggtaattttgtagacccaggacttaccttttcagatttgtatgctaataatatacatgcatatgtatatatgcagcatatgctctttagatttgtatgctaatattagctagagatttgatccgtggctcaacctcttttttctctctcttaaataatggtcagatgtacagatcaggctctagcaacagcaatcatcctgtcagcctccagaagttgacatcagctactgttaacaacattagcaaacgtgagtttgtgaatagtgaagatcgctgcatttacgcgtcaggggatagaaacactgcatcttcagacaagaatacttacaccatactccgctgcggccgctcatcaatgtgagtgtgagagagagttaattagtcatttttcaattaatgttaattccaagtacatatgtgtgttatgaatttttcattttattcaatatattgatttttatacccacttgcaggccatcaatagaagaaatattcagaaactgggaacaaaccagagggcgtcttcttccatggaactccaacgtgattacaacagaacaggtgcctttcccctcactggaagctacgcctcaaataatatcacttaattgcatatatataatttgcattttcgttggacatctgtctgaatttttagcatgtatacatcttggtgtatatcctgtattccattcatgtagagagataggaaaaagctatggacaaatgcagacgtattttacttaaagaatccatcttccatatatgtagtattccctagaagtttttgttttggaaacatgcattaggtggcaggctgccaaactagcaaaccatactgccgtgtattgactgttcattcctgcttctgcatgcatggtcgaaaccatgaactatctagactatctctgaaacacttaattacaaatttaaaatccatatatacatttttcagcaagcttattaacactgaaacgtagattaattaacatatgtatatatctttgcaggcaacgactagagcaagtcgtcagactactaactacagtaagcctctgaagcagctgacagactgcgacctgacgctgtcgatcgggcagctgtgggacgacgccgccggcagcgacgccgacggctccagcacgatcagcgaggaggtcgccgcgccgtcgagggacgaagcgttcgtctcttcggccgatgaccacttcgccgccgccgccgcgaagaaggagagcaatatgctgaccactgatctgaacctggacctgaccatttcatcttcttggctgtcctgatcatatgatcattcagttgatgggcctgtgtatagctgcattatatttgtgcatatatgtagtagtatgtgtacaaaaataacgcggagagagagagcgtcaggctagtagtatttgcaggttacctgatgagatgatcttagagagtgtagtaatattctggagatttctttaggattattttcttatggtcagacacagcattttattaggtttttcagtagcgcatgcacgcgtttatctgtatagttttctttctattattaattgttcgttcgattagagaccggggacttcagacgaagacgggtgagaaattttgacagtttttgcttctcttgggtagacttctctgttgaatttctcacctttcatcatctgggcagttcccctatttctgatcgaattgtttgcgcaccactatctatactgattgagaactactccctcaattccaaaatataagggattttgatcggatatgacacatccgattcgtagtactaggatattttacatccagcaaaagtctcttatatttgggaacggagggagtaatggcgttacttgctagccattttacccttggctttcatagtgtcaatctggatttgtagctagctgctcttcgtcccaaaataaatcaacctcgtacggaatgtgacacatcctagtacgatgaatctggacatgtctcgtacgaagttggtttattttggtagagatagctatgtatcttggtattcgcaattttttttcctatagaacatgtcatcagttctcttctccagagtacttcctccgtttcacaatgtaagtcattctagcattttccacatttatattgatgttaataaatctaaacagatagatacatatgtctagattcattaacatcaatatgtatctatctgtctagattcattaacatcaatatgaatgtgggaaatgctagaatgacttatattgtgaaacgaagggagtactatatattgttctgcatgcagtatacttcaaacttcaccatatatctcaacgggacatttagtgcaaattatggatacagcaatcatcagttcagatccaaattttgaattcaaaagccggtcattatcgatgtttagggcaaaatggtcggaaacgatatcatttctctattaattttagattatggaatagtctcgatcgatacggtaatttttttccgtatttataaatttaactatttagtgatgacgacttcaatatgatgctgataaaaatataaaaaagaaaattttatatatagttagaaatgaaagtgatcggaaacaatattatttttaccgttcgatcgggaatttctataccattttcagcccaaactcccactgcgtacatcatatcatagtactactatgtttgtcatgggacatatagaactaaacactttgtctcttaattatatatatcatattacttcctctatttttttaatatatgacgctgttaatatttttatatatgtttgattattcgtattatttgaaaattttatgtaaatttaaaaacatgttagtcttttttaacatgttgaatgataaaacaatgcataaaaaaactaaaaacaaatgataattacatacttttgtaattaaataacagaaagttgaataaatggttttaaacagtttataggaaatgtttatgaaggacatttttttaaaataaatatagtatttggatgcttgggaagtgtactcgtgataatgggtcatctattagctaaaaaatatgtccttaaaaaaaatcttcgaggtggcttataataataataaaggccttttctactacggaatttgagaatttgccactcctaatttcaatcttgattttgcccttttcgatcagttgggagatttgaggatttaccacttctattgcaatctagagttttctatctatatgtgtctatgttatatagcatcaggaccatgcttaaggtgataagttgtgaagcgagtgtagctcttaacgcaagtacaaatctcaaattaacttcgtacgggtgctcatatttataacttttttttcaataataaataataaatccatcaacaacgagatgtatatgatggcttcatcaatctgaagatgtactgacccgatacggaagatgattatatagtactatgatatagtacgtgtatatgttgatagaaatgagtatgcacctaacatgcggatctgatcaacgcttgtgtctaaagtgtgtttggaaaaaaaaagaaagtattaaattttccattttttctgttgtgtcgacaaaatgcttatgcctccctattcgctggcaccatccatatgcttgacaattgacgcacgtcagcatacatcaatgggcagatgaaacggactgtaccagggtcagcccagaaaggccccccaaagcactatcaaacgggcctgatcgacactactgggctggcccgctacacggcccatttagccacctccagattccagttcgttcccgatccgtccacgcaacgcaaattcccacaaaagaaagcccagaagcagaaacaaatcgaacgctcatcttttttcgaagaaaaaagagaaaaaaaggaaaaaaaacctcgtcggcgatccgccgtgcgcctgccgccggcgggaggggaactccgccggagatgtcggttctcatagtgaccagcgtgggggacatcgaggtggacctccacaccgacatgtgccccctcaccaccaagaacttcctcaagctctgcaagtaagcttttagtttacccgcacctagggcttgttctatgtgtgaattttcgcgggatcatctggctactagaggtaacgagggtctcgtggcgggtgggttagccttcaggaagcagttgagcgggcaattttggcgttgtagagcgggtgctactgggtctggattcgatgtgaagggtgcgtgtagtgtagtgtgttggattgattgattacagttgaagctgctgccataccagtgtgtcgtgaatcattgtgaatgctcttgttcccatgttacttcgagtttcgattgcgtttaacttgttagtgtagtgctgttaagttgatagcatcttacaagtgctgttggtagcacttgtctgtggcgctcctcatatgacaatctgtattaaccatctctgtacatgtctcttggatattttcaacgttattcacccagtgtttgcatgatttttctttttgttgcaacatggcgacatgcttcatcagattttgctgtaggactttttttttcttgcaacggttttgatgcttctgcctgtcatgtatttgttgcggccgtagcccatagtaggaaattgtggcatttgtagtggaaaattgtttcagcggagtggacaaataaactggagcagacaattgtttcagctagaacatgccattgttgcgattgtagcgagaaatcgtttcagctgcaacaaggaaattgcttcaattcttcttttggaattgttgctacgtgagtagaatatcattgctagctaagccaccaatatttatatctaatcgttgatttgatttgtgagggatgttgatattgtggtagacattttattttctttatgattagtgataaatgaaagcagctgtggtacaatttagaagagccagaagttgacttccgaagcaaaagattacggcctccgtggagtccatgaattggttgatttaatggttgcttatatagtagcgaggatcacttatttcagaaacgtctgacaatagctctcggattgaacatccgagcactagttgttatcattagtatttggttctagggatgaggtgggatgaaacaggatggttctacatttttgggatgaggtggaatagaattgtttcgtttagttgtttggttgagaatgggatgattcaatattttgtttggtttaagcgagatgggatggaatggtccaatccagagtttggtttggagaatagaattagattttctttttagaaaatgggataaacccggcctctacatccaactggatttacgcagccaagaataagataggattgactcaggtaacctgcaccttagactggtgagaataaacctttttttttaaatttcccttatttccttttccccttcttaatttttctctctcccttatcatctgtaggaatgagctttcctggctacagcttcttccttgtcttcctctctcttcattattttgttcacatccaaaactatttgttctccagattcctgagtggtgctatggctagtgagtggaggaagcggagtggatgacgccactttgctgcacaagccggcgactctcatgagcgcgtcaaggcagtgatccactagcggcatcaatggtcgagtgcaagaaaccttttaacctcatggaggtggtagcccactgcttctcagcttgaggagagtggtggctgctcgcagtctcgcagatgggcggtgaacaaatccagcgagaagctctcccccgcactgctgaacattcttgcatgagttcatctgggcaaaagagtggtatcatctcatcctgaatcttgttggaatattcgtcaaaatgaaactacctcgtcctgaaatgtttcgtcccatcccaagaacagaacacatgggctcatcccaggaccataaccattcgttctatcccacttgatctcaggaaccaaacacatagaggattgttctttgattcttagtgtcgttgtctgaactaaaattatgtaaatatgtttgtctacttatcttgcaaaagttaaatactgcaaaatagcaggctatgaaatatgactgagttgactacttatggcaattggagtaatcattctctcgctgttcctatgattttacttaccaggatgaagtattataacgggtgcctgttccacaagatagagaaggatttcttggcacaaactggggactcaactggaacaggagctggaggcgactctgtatacaagtaatcaattaatatagcgcaataggagcctctccttctgtttcctgtaaaaaaataatcaattgctcagatgtctcactgccaccgattgtcaaatacatgcctgaaaacggattcattttttttcctgtagattcctttatggtgaccaagcacgattttttgatgatgagatccatccggagcttaggcattctaaaatgggaactattgctatggcaagtgctggtgaaaattgcaacgcctcgcaggtgtgatacttagtccctaaacttcctaccgaacccaaatgttttgattaccagtaattagtccattttgatgtcctcactgctgtttttagcctttcgtttatgtttgtgtgacttattagttctacatcaccttgcgggatggcgtggactacctcgatgataaacacactgtgagtagcaccttactattattacattgacttagagattttttttcttgaaaaaccctactttatctgcagtgactcacaagtatatcttcatcaattgtaggtgtttggcatggttgctgaaggctttgacacgattacaaagattaatgaaacatatgttgatgataaagggagaccatttaaggatatcaggtaaaatacctttgaaaagtactaaactgcatagttagaacatgcttgccaatatttacttactttctggtctttctgttgtttctgctttatttccattgctgaccttctgcaaaatacttaatgaacaggattagacatacatatgtcttggatgacccttttgatgatcctcctcagctcagtaaacttattcctgagaattctcctgtagggaaaccacaggatgaggtaatatgagttctgctattgtgctcatgttggaaagacaataatcaaaattgactaatcagaatcacaggctgtcttacatttgtttaattcgttttaccttccacattgttgaaaactttataacaatttatttgggcacatacctgtttaagagtatgtatggattttagttgaggcagccactgggtgtacatgtaatttattttccctgttctgtctgtaccaaattatgctaaaagttcctatgcaatgtcctgctaatgtactatgttatatattttcttttcaccgtcaatgtacagattgcagaagagcgcttagaggataactgggtccctccagatgaaacagtggctcctgaagaactcgaggatactatccgctccaaagaagcacatacaaatgctgttattcttcagagcgtaagtcctggtgccaaattaaaatccaaaactacgcttattaattattaatcatgttataacttgtgactcataaaacttgtcttattcagttaggagatattccagacgctgagatcaaaccacaagacaatgttttatttgttcgtgaactcaacaaagtaacacaagttagtatcggctcttaattgattaactctgttcgccagttccactaatttttttgcttatccatcctgctttggtagtagcactacgtacagattcttatgtatagacatttcattcatttaatgctcctgtgattatatcacagattattttggacatcataaatatcggattgatatcccatagcttatgaaatattttttggtaagagaagctaaagggctaatattcattgttttgtaggatgaagatttatatacaattttttctcattttggctctgtgacgtcgtaagtgccttttcctaagctcaaataatttgcttatcttcctgttgcttctcttgttaatttttttaattgttccttgcagagctgaaataattcgtgactataagactggtgatagcttatgctttgcttttattggtaagtttcattcctcaaaagctggggtgcattgacatacttcgatcaagcattggatttagacagagtcctgctatttttctggagtaccctgagcccagtttgttcatcgaatacttgcctgagctatatcactagatttcgtaggcattcatcatccagttattcagttgtgttgtacatcagcctcttagagctgttatcctaacagggctccaactgaattacctatgcaataactgttggtgtttattgaaaggcatatactttagttgcagcatgtaaacacaccttttattttgttactatatacccgtgcattgcaaatggtcccatactactgaaaatgggctaggggctaatatatggatctaacataaagtgagaatatatttttatccaacaactattccctttttttcccgtctttcttagcgatttctttttgtgtgtaacaatttttctctagtgattttttttatggttccaaaaaaagaaggtttctgctactgttgctagattttctaaaatagtttttttttgtgcggaacctttttctccagcaattttttttccatgagcgagggggagggggtgggaaggaggacaactgtgcttttatagtagtagagatagctagtaatatacccatgcattggaacgggtccgtactactgaaaatgggctagggactattaatatggatttaacataaagtgagaattttttttatctaacaacttttcctttattttttctttatttcttagcgatttattttctttttgtgcagaacaattttgctctagcgattttttttctggttcaaaaaattaaacgatttctactactgttgctagatttcctaattttttttgtgtggaacctttttttctagcgatttttttccatgagcaagggggagggggtgggaaggaggatgagtgtgcttttatagtagtagagataaactcgcaaatggataaaatacatgaattgtcaaagaagattgatggtgttttctcctaaaaaacaaacctaatgatttaagaaaacaaactgagtgactgcattgtacacttctgaggtagtaaaccatagaagttaactgatagctaaactgttctcagggttacaatgtcagtgcaacatatttggtgcagactcaagtagccagtagatggcctaagaaagaatctctcttgttccacctggattaattggcaagatcagaatgttgttacaaaatactaaaaattatcttggtcttttgtagaatttgagaaaaaggaggcatgtgagcgcgcattcttcatggttagttgcctaaattcctgtttccagtggcagataaaatttcttctcttatataattatactctataattccttctgccacctactccctccgttttatattataagactttctagcattacccacattcatatatagattcattaacatctatatgaatatgggtaatgctagaaagtcttataatatgaaacggaggaagtagcattctagcatattttttatatattatttatgcttgactagtgaatgttacctagtttctgcattgacaattcagcagtctatgtttttgtaactatattagagtgttttcatgggagcatttgcttactcaatgatatgcttatagatggacaattgtttgattgatgatcgaagaatacgtgttgacttcagccaaagtgtttcaaaacagtggcgtcagttcagacaaagcaaaagtaatgcaaataaaggtaagataagtcatgtattcttatttccatggcttatcgttgcaattccagcttcttttttatttaagctaactgcaaaatcagtaggggaggtgctctactgttggttttttcctttaaggaaaagaactaaacaaatctattcctcatcaatattcttttcatctagacttactttggtggcactcaaatatgcatattctcatttcaaaccatagttgtagcattctgtgttcattagaaattcttgaatcctataaggaattttaccattttgtaccatggtgaagatgtcgagtcagtagctagtacctttaaatattttcaagtgaaaagatggcaacaatgttcccaataagttgggggcaaagaagaaagaacacgtcgatctgagtaagacttcaacatgtattttgtccttagcatttcttacttaaatctcttgcttgaacatgcatttgttctttggagttcatctgtaaataggagaagtgtgatatgaatacctcgtcttagtatatcagtgagtgtgaagatccccaaacagaatctaattgttacatgagtctttattttttcagtttttggcaaaactctgaagcacttgctgcatacagttcgtattttcatcatttgctaggcattctgatactcggattgttggtttctttgtatatgtaatatatgcgatccatgtagatagccctgcactgaacttaaccataaattcttccagaatcaacgggaccgtgttttgttctttacaacacgagctgggcaacggacttgaatgataattagatgctttaagaacattcctctactagagtaacttgtataactggtgactggtgagagttctcgtaacatctctgccagacaatattaagccatgaaatttctatttctctgtagaaaaagttgttttcaggaatacgcgagacgcacatttttatattaagaaggaataaatgaaattacaggggggccaaacaatttaaaaaagaaggggacagggtacaggtgtgggggggaaacagaaatcctaatctcctaaggagtttggcgacccgtgaacaaatgaaggaactaccatggccggtatggctgccctagccatccgccaaactgtagaaaaagttgtgatttatgaaatgatttttgacaagcaacatctcagtctaggttaaccacatcgaacccattgatctctaggtactaggaattacctcagtatgttcattgccgagtttaacattctcaactaggaccctgaattctggtattaagtcgagttagttgtgagaccttatgcttattttatcatgtgggagtttttaattcctgcatagttgattgcttctaatgtatttttttgaattgctgtgcaacaaaatgtccttttaatctcttccacaaacatactttaaagtgaaaaatacatgatgcatttctttctctttgcagatgggtgcttcaagtgtggcgcacttgatctcatagccagagactgtgaccagagggctgagcagaaaaacaaagggccaaattatatcctgaaagacgaaaacactcagcgcagtgggaacaagcgtcgaaggtgattttcccatccgccatcactcatattttctgattgtttcgccttttgataatatgttattattattttgtagctacgatcttgtctttgaagatggtgcaacctataatggtcagcaagatctccgaagcgctgaccgaagaaagatccataagatagatgatcgaagatcagggttg

SEQ ID NO: 43899 - DNA, 5159 bp, Oryza sativa
  unsure (1)..(5159): unsure at all n locations
ataagtgcgatggtgaacgacgctacagaggagatgatgaccatggaaggagcaaccgccacacgagatgaaagtgataacaggaaaagaagcccagacactggtagtaggcatagaagataagatagggagcaccgtgagtgagacgagcaaacacagggaaagaagtcagagtgatgatagtatattgctaaggtagctcacgtatattttgtatagttctttttctgttactttacatacgaggatttcagacgaagacgggtgagagagattttgacagttttttgctctcgtgtgtaaacttctcagctgaatctcacatttcatcatctggagtctgattacacctttcatctctgatcgaattgtctgcgaactaattgcgaatggcgtgcatgcatgcatgagctgtaatttgctagccattttactttggttatcagagagatctgaattacttgctagctacctattatagaacatacttcacatccgttacaacatataagcattcacctagccagaaatgcttatattttgatattttgaaatagatggagtatcagttcctagtactgctgatttgcaaaatgtccaaaattattagttacgtgtacttcatattcatacatgcgagtataggttgaagaaatgctgctgccagcgctatgctcgacgattgatagtttttttatttcctctatgacctatgataataattaccataaaatttacaccaagttgttaagatgaaaattacgatctttactacaacagcatttcgtggattggatttcacatatcatcaacgcaccacggatgaagccatgtagatatgtaggtcctgtttagagaagcttctaacaaatgcggtctctcttggaatctattctcacccagattctgataatgtagttatagaatgaaaaataaaagaaaataagtcaagagcgcaaccaactgtttcttagaatgttaactctcagaaacatagccgtaatatgcggttgtgggcctggacagtttggaagagcttctgattctgggagaagatacaactggtagaagcttcccaaaactatctagcttttcatcgaattatgagaagctatagttatagaatctataaaatgagtcttagggctgtttgggggaaccnccaactgctacagcatccttctagaatcagaagctcccccaaacaggccagctgtcggaccagattctaagaagctgtagttatagaatccagaaaatgaactagaaattagaagctggaaaacccagcctttctaaattttcaaaagctggttaccaaccagctgcttctcagaattttaagctccctcaaacagactataagctacccaaaagaccctgtgcaacagtgcagggttggacgaaaagcatagcatgaccaaattgggccatatacgcgggcaaggcccagatatttcttggtcatggttttctggcccaggccgagaattcagggtcggcccttacatctccgtagcacgcagcctagtgcggtagacggtttaagcgctcagaaatcaccaattttttgtcataaaaaacaaaaaagaaaaaaaatagaaacacctcgtcggcgtttagaaaggcggttggggttcggcggcggcggcggaggccggtgagtatccgcggccgcgcgaaccagtcgcctgagctcccagaagcatccggcgctgcggctcctccgtgatttgtgtatttttccccttgaatcccgcgccgtcgcggccgccgtgtgctcttgccgccggcgagaaggggggaaaacgcccgcggagatgtcggtcctcatcgtgaccagcgtgggggacatcgaggtggacctccacaccgacatgtgccccctcaccaccaagaacttcctcaagctctgcaagtaagctttcagtttacccgcatctagggcttgttctatctgtaagtgcgcgggatcatctggctagtaccaggggtaacgctgtctcgcggttgaggggttagccctcacgaagcagtttagcggccaattttggcgttgcagagggtgctacttggtgtggatttggtgttgtattctagaaccgcgaagggtgtatgaactatggagtctgctgggttaagattaattataatttaagctgctgctgatgtgtcgtgaatcattgtgaatgaatttaccttcttagtgtagtcattaaaatgtaggatggaaagattgggtcaattaggggatcgctctttgattattagggttgttatctgaattgaaaaaaaaagtatgcttactgatattgcaaaataatgcacaatagcagtattatgaatatgaaatagtaattttatggttatgaaatatagctgagttgactatttatagcaatgggagtaatcatcctcattcctcctatgatttgacttaccaggatgaagtattacaatgggtgcctgttccacaaggtggagaaggatttcttggcacaaactggggacccaactggaacaggagctggaggcgattctgtatacaagtaaacaattgctcagatgttttactgccactgattgttgaatacatgcctgaaaagggattcatttgtttttctgtaggttcctttatggtgatcaagctcgattttttgatgatgagatccgaccagaccttaggcattcaaaaaagggaactattgctatggcgagtgctggtgaaaattgcaatgcctcgcaggtgtgataccatattcctagccttcctaccgaacttagctcagctgttttgataaccagtacttgataatccattttgaggtccttaactccttgctgctaacctgctatttctaacctttgatttatgtttctgtgactttattagttctatatcaccttgcgggatgacgtagactaccttgatgataaacacacagtgagtagtaccttattatattgactcacagaatattttctttggaaaaatccactttatctacagtgattcatatgtatgtccttatcaattataggtgttcggcatggttgctgaaggctttgacacgctgacaaagattagtgaaacatatgttgatgataaagggagaccatttaaggacatcaggtaaaataccttttttaaaaagtctaaactgaataattagaacatgcttgctaatatttacttactttctggtgttactttctgttgtttctgctttatttccaactgctgaccttctgcaaaatgttcaatggacaggattaaacatacgtatgtcttggatgatccttttgacgatcctcctcagctcagtgaacttattcctgagaattctcctgtagggaaaccacaggatgaggtaatatgagttctgctattttgctcatgttggaaagatgataaaccaaaattgtctcaccaaaatcacaggctgtcttttgtttaattcgttttacctccacattcttgaaaactatttatttgtgcacatacctttttaaaagaatatggtatgaatttcagttgaggcagccactgggtgtaggtgtattttttttccttgttctgtctgtacaaattatcccgatccctaaaatatctagacaggcatgtttcagattagtcctagaagggtgtggttttgccgtgattctcctgaatgctatgtgttgtccttttaacatggtcatgatattttcttttcactgtcaatgtacagattgcagaagagcgcttagaggatagctgggtccctatggatgaaatggtggctcctgaagaacttgaggagatgatccgctccaaagaagcacatacaaatgctgtgattcttgagagcgtgagtcctgatgccaaataaaaaattaacagttcgctcattattattcatcgtgttataactgataaaaatacctttgtcttattcaggtgggagatattccagatgctgagatcaaaccaccagacaacgttttatttgtttgtaaactcaacccagtaacacaagttcgtatcggttcttaattgattggctttgttctctacttccactacctttttatgtatagattcacagatcagtttggaagtcatataggtattgaatttatagcaatatagcttgaaatattgtttggtaactaaacggctagtgttcattgttttgtaggatgaagatttatatacaattttttctcgttttggaactgtgacatcgtaagcgcattttcctaagttcaattaatgtgcatatcttcctgtttcttattttgttaactttttttattattccttgcagagctgaaataatccgtgattacaagactggtgatagcttatgctatgcttttattggtgagtttcattcctcaaaagctggtgtacattgacatactgtgatcaagcatcggattgttgttagctagagttatgctagtccgttcatcgaacgcttgagcttcattgatagctttcccaggcattcatcctccaattctttaggcgtgttgaacatcatgttttaccctcttagatctgttatcctagtaaggaacaactgagtgacctaatttgcaacaaggttctggtgttttgtgtaaggctgagttccaaatgttagtggctatggatatactttagttgcagcatgtaaagcacaccttttagtttgttaatacttaataaaccagcaaatgggttaaatgcatgacgtggcaaaaagactaatggtgtttacttgtatctcctcaaaaataaacattaacgatttaagaaaacaaactgagtagctccattgcacacttctgaggtattaaacaatataagtttcttgatagctcaatttttctctcagggttacggtgtcagtgtgatatttggcacagactgcagtagacagtagatggcctagaaagaatttattgttccaccttgataaattggcaagatctgaatgctattataaaatgctaaattttatcttgctcttttgtagaatttgagacaaaggaggcttgtgagcgggcattcttcaaggttagttgcctaaaatcctgtttcatgtggcagataaaacttggttcttgtaattgtactttatttcccttcattacttagcatttctttgctagcatatttttataagtca

SEQ ID NO: 43900 - DNA, 2435 bp, Oryza sativa
gcaccccctactgttaccctttcctacaaggaaaagaactatataaatctatccttcatcaaaattcttttcatctagactttggtggcactcaatttcctttcagaccataattatagcatcctcctgtatcctatagaaatttatttattcctataaggaatttagtgttttgtaccatgcggaagatgtctagagaagtgtactgattattattcagcacagttaaaccgtgtcaagtgtaaagatggcaacaatgttcccaataagccacaggacaaagaagaaagtaaacatcaatctgagcaagacttccaacatgttttgctttctccttagcatctctttagtatcgcatctctgtctttaacatgcatttgttctctggagttcatctgtaaatggcagaagtgtgatctgaatactgtgtcttagtatattagaagtctgcagagcccctaacagaatatattattactagtctttatattaccagtttttggctaaaccacttgccgcggatggttcagattgtggcaaatagcaaactggcctagcgtcatcatttgctaggcattctgaaactcagattgttggtttctttgtatatgtaatatacgatcaatttcaaatagccctgtactcaacttagccattaattcttccagtaccaaactaacagaccatgttttatttcttacaatatgagctgagcaatggacctgaatattcatatctgcttaagatcatttctctactagagtaacttgcacaattggtgagccatggaactgaattctcataagagacctttgccatagaatattaaatcatgaaattcctatttttctgtagaaaaggttgatttatgaaataattttgatacgaaacatctcatcttatatttctaggttgaccacatccaagcccattaatctataggtactaggaagtaggaaggtgtacgcagatgcccacttcattgcggaatttaacattctcaactaggactcttgaactctagttagttgtgagaccatacttttttactattttggagttagaattaattcacatgaaagctatatgatgcaattctctttgcagatggatgcttcaagtgtggcgcccctgatcacatagccaaagactgtgaccagggcactgagcagaaaaacaaaggcccaagttatgtcctgaaagatgaaaacactcagcgtggtggaaataaccgtcgaaggtcattttcttttccctatctatcatatttcctgatcgtctcattttctgataatcttctgttgttttgcagctatgatcttgtctttgatgaagatggtgaaaattatactgatcagcaagatcctggaagtactggccgaagaaagattcaaagaacagatgatcgcaaatcagggctgccacctcggggtgaccatgacaggattagccgggagagaactcacagtgatgagaatggtagagaaggtggtaaagaaggtgatagggaccgagggattcgtaagcacgaggactaccaccgttacaataaatctggtgaacggagctctagtagatacgatgatcgtggctacagcaagcacgagagcaggggcaaatatagggatggcaatgatgattacagacgacaaccgggaggtggcagtcgatatggcagggataagtatgaaggtgaacggcgctacagagaagatgatggccatggaaggagtgaccgtcacaagagagatgaaagtgataacaggaaaagaagcccagatactggtaagcatagaagagaagacggtggtcaccgtgagacaagcaagcacagggaaaggaggcagagagatgatagataggtcactgcatcaccgtcagttttgtcttgcctgtttctcatcatacattgaattttgtcattcttaatccaaagatagcaccagaacactaaacatgtagcttagaatctgcgtgtagacattatgagagctccactggctacagattgttgtaacttgtagaccttttcttttctatacatgctcatggacgttgttctttttgggggacgatcaccatctgattgttgtcgaactgttgccacaactagcagcttgcttttttaattgctcttgttctagaggaagcccactgcaagtgttctacatatttgtgagtcttaacacgcctctagtttccttcagctacacgctcagactgttttatacccttttactcagagatgtaaatcaatttgatatcatttactaaaagttgtctataacataattcatgtactctgtcgggagactctggacaacttctcttcttttctttttttacattttaaaaaaatcatatttaaaccgtgtttcaaatacattcttttttttttcggaatttcttccaatcgggcgttgggtgggttgggg

SEQ ID NO: 43901 - DNA, 28066 bp, Oryza sativa
  unsure (1)..(28066): unsure at all n locations
catactctgttgcaaaaaatcacccacatattttggaaaccttctattaagggaatccgttttattctttgttccacaaaaaatatttcacctagtgtacttacaatatattgttatgtatatatctaatgttatgaattgaaacattcttttgcaacaaatcatccacatattatggaaaccctttattaagggatattatggaaaccctctattaagagaattcatttcactttttgttccacaaaaaatgtttcacctagtgtacttataatgtttcactatgtatagatcaaatattaaatgaactgaaacattctttcgctatttgctgaaatattgtttttatataaggtgaaacatcgcctgatttaaacgattgaagcattttcgatctacttagtgaaacaattacgatatacttggtggaacatcgtacaatatttaaaaataattcaataataagctaaaaaaattttcgtcggaatatatccatgtgtagtcttgtttcaaagatttaattgcaacgaatttaatggtgcaatcggatcatgatttggataaataatttaaaagaaaaaataatttaaagtagtttttgcatgctgacgtcagcatgacatgggcgtccgattttcccaccttggatcgggcgcctgacgtgtagttgcctccttttttttttagctttctttggtccattttaatacaatataacactacctatttggtgattcttgcatacacaactaactctggaaattacatttgtgtcgcattgatgctttccttttactttgattttattaattgggagatgaatgtatatttaagacgataaaagctccaacaataatgcatcaaaaccatttctagtccaataaatgcttccttcctactacattaatcaatctatgcaagtccaggacaataaattatgctataaggtgtgccatggatggataattaatgtaaatcctgctaattaatgtagcacttcattgaaagaaaatctgccagatatatatgagatatgatattattcaaggtaggcacgcaccaattctttgaagcaacattaaagccaactcttctactacttatatgagttcccaggatcaacatgttgcttgaaccagccgtcagtgaaatggaagtacacaactattcttgcaaaatgctgcaagatttgtgccttatgctgtctatatttgtgggctttttaaatcatttagctctatcatcatcctattacgcgtacccagatgttggcccaattagaggccaagcttcaacaaaaggattgaaagaaatctcatatgtaagttcactttatctcaatccatatcatgcttttcaacctcatttcttcccttatcgtagtgaagcatatgaatgttatggatcagttgcatgttcttgtatacatattcttgggtcacttctttttttatcttttctctctaaacatgatgtttctgtttaattaccaaagcgtacagtttcttatgacaatgaaatataattgattttttttcttaaattatgagtgttgataaataataattgttaaactgatatgagttgatatgacgatggaaaggttgaattttgagtcggtgatgaggggacgtttttagttaaaagttgggaagttgagttttatctttttaatatattgttcctattcaaactcgtgaatttgcagctgaactggaaaagggaatgaaaaatccatatgtactttttaaattacagagatgatttacatctcctgcctctatcattaggcacacaaccatgcattgggaggatccattcatatttattctttatgttaagatgtctatatgttcaagtagtgaaaatgccactagaataacatatatatgtatattattttttcctagcacgcgttacatcgttcaacagatgcccctgaaaatggatatagcggcgccatggcaactctggatgtttataattttccatatttgaagaaaatggaagtaagtgctgctattgttagagtttcaaattaccaagacgaagccactaaagctggtctcaatgatatacaggccggatgggtggtaagtgaacaactaaccttaattgtctatgttaacatttggaggatgtgtagtacaatcaacatcagctatgatatatatatctcatctcaaatgctattttccctacatatatagattgatccaaccacctatggtgacagcaaaacccacttctttgtatcttggacggtatgtgtccacttatattcattgtttgtgcacttgaaatacattgcttaattaccatgcatatgtctttaattacaaggttttgatatggatgcatgacatacaggctgattattacaataaaaccggatgctttaacttggactgtgacggttttgtaccagtaaacggtgccccggtgactcctggagatacattagaacaagctaataaccaaactaaaatatcattcaagatatttaaggtaatgtaactaataattatttgatcctagactgtatttagtgtgtacatacgtatgctacacaacacatgctgatcttttttccgtaatatagtaaataaaagtacattttcatgaactgattatttccctaaactttcatatgcccgggtatgtagcttgtagatgggatctcttgagctgaaggctgaaaatttccctgttatcttaaagaaaatgtaccttgtatttatagtaggaaaatatctaagtgtacagcctttactttctcgaatagtaactcttccgaatattcttgcgcgatgatatttttccatatatgtacacaggacaaaaatgatggagattggtggctttactttggatatgacatcaacaatctcaatcgagttggattttggccaaagaatatttttaatcgtatggtagatcatgctactcgtataaggtgggctggctatgctcaatcctacaaagggagctccagtcccccaatgggcaatgggcaatttccaggaaaaatgtcagcatcctttcagaatgttatgtatgttgataccgatggccagccctatcctcctcctgtttggcctgctggtctcgaagtttatgcaagcaatacgaaatgctaccaagctagcatttttgaggataacatgttttactatgtggggccaggtagttgtactagttaaaattagaatctcttgaaaatattaatggcgagggccatctcttttcccaaaaggaagaggccctcgcgtcgccctcccccaggcggctcgggaggcgatgtgcgcgccgccgctttcctcctcccccgcctcctcctccacctcgccgccgccagagcgggtgccggcaatgccgcgcagccgcaaggacggcggcggcggggtctcgcctagccaaccctacgctcggcggcggggggggagctgcccggggcggcggtggtggcggccagatccgcgccgtatccagccggatctagaggggggatggccagcggcggggactgacggtgatggtggcgacgacggcggcggaccacggcggctgaaggcgacgtcggcggcggaccatggcgactgaaggcgacgtcggcggcggaccgcggcgcgtccaggacgccacggctgggacctccgccgcatcgtcatggtcgtctcgctccaaccgggcgccgagcggcgcgttccgtcccccggatccgcgccatcctggccgaatctggacaggcggcggctggtggcggcaaccggtgatggtggcagctggcggcggcggctggcgacggtggcgtggggacgatcggcggaccacagtggctgacggcggcggccgtggtggcgatggctggcgagggcgcatgtgcggtagtcggcgcgtcgacgtcagcggcaacatttgaagacgaggaaggagttgggcggcggggaaggaggagaccgggagcgggcgtagcgtgggcggcggctgcgtgtggcggcgttgcacggctcgggagggctccgacgagctcggcggtagcgcggagtcgaggcggactccggcagggttgctcgctagcggcgagcctcctgctcgcgatgtgtggatgtggatgcgatggcgtgtttggttacgtcgaggtatgactgcttgtgagacgtcatggactattcagtggtcgtcgatgtggggtgcttgtgtgtgtgatgtgaagacgttggcgaaagccttgccgtgcctttggccgttcgacgatgacgatgcccacgggcgccgttaaccttcttggaggcgtcgtgatggcgttccttcatattccccacaaatctccaggtgaaaaccttgttccgatttcggatgagcggcggcgacttatgcatcgtgtcctccttgggggtgtcgcttcggagaagctcctatgtatcgacgaccgtggatggtctttttcggttctaaagccttcataccttggcgttcggcgaggccttcgcctccttaggtccgcttcgttcttgtggtgggtgacacgctcttcagttgcttctgctgatgaagtcggagcggctcgctgatgacgtgcggcgatgcttggcaacgatgacaagttgcagtctcttccaaggagttgttgttggccgtgtgaaggaagtggctctttggtggcttggctgatgccattgttggatatcggagctgcttttcgctctagcgactttcacggcttcagtgtcgatgcggttgtaaagtcggcgctgctgggttgcttgggcggctagctcgacaacgataacacctcttctgtgatgttggagctgtttcggtcgcttttgtgtattagcttggcaatgatgtcctatatttgggctccgccgtcgttgcgagttgtgtagctaggtcccttgctttcttctgtgtggtgagttttagccggttttccataattaaccgtgcaattgtatggttttcgggcccggttttccttataaactgggtcaattctcttcttctaaatataaaagtggaacaaagttccgccttaggtttaaaaaaaatgttaatggcttaatcagttgaataaacaatttattgctaattggcgcttggtttcttccaccccgtagcctgcctacagcctgtggctgcttcatgctataataggcaccctggctgccttgtagtgctgcactaggaagccaaatggtgactatggggtgtttagatccaggggtgtaaagttttggcgtgtcacattggatattatatagggtgtcatatagtgtgttcggggactaataaaaaaactaattacagaattcgtcagtaaaccatgagacgaattttaaggctaattaatttgtcattagcaaatgtttactgtagcaccacattatcaaatcatggagcaattaagcttaaaagattcgtctcgcagattagtcgcaatttgtataattagtttttttagcctatatttaatactccatgccggtgttcaaatgttcgatgtgacatggtgtaaaattttgaggtgggatctaaacaggccctattatcaagctatgtgcagtaaaaaagattggtttactagaagatcacttgctagtcaggaacgataaccgctctgttccttgggcttctttcgtcgctctccttcatgctcgctttatgagtgcaaccaagttcaataaactattcatactaatttataaactataatggtttctatctaagagccatgtacgtgagatgcttccttctcatacacacatctgaagcaacatttcaacatttcaacatttcagcaactgaattagaatgacgtgtgtgtttatcaaccggccgattagttcccatctcgtcatctttcttttgctatatacctgtagccagccatatattaggtccacattacacctttttttctacaaaaaggcagtcataattaatttagggggcaatggccaattacaatcaacatgtcctccaggctcctgtgatgcactcactacttgaggtgcactcgttgttcttcaccttatcccatagtttatttttttaacagttctatctgctcaaaatcattcatgttattaatttgcaaatgaagtttaattatgagggcaataacaccaccaatttggttgtttgcattgtattgactttcgtgttagaacctggttaagggggtttaatttgtatttactttgacgtgcatgacatgcatcttcgcagttgtgcaaaatgtctcaaactaggataacgatgtctagattcagcctagggtgggaaacaaggatcatgagttcattactctaataatccagattcattatactagaaagaggtcatatatattcctttttagattggctttttttttacaaagaaagcacaggtatctaagaagagaggtatcaaaacaaatgttaatattgggtgtaacagccctaaaattcactaagttttaaaaccatttttctttcttgttggatatatatattaattgggtgcttttccatattttcccagcgctgctatttgccgggagtgcataggttctggatgattatgatggtacagggctttgcttggtcagtcgaaaaccccagaaaaaaaaacacatgtaaaccacattattgcttaatttatataaaaagcatggccgcgctcaggggcagattcaacgtgggtgcggggggcttaagtccccctgcacccacaagacccatggataccccatgagcacccttttgattttttcaccatgaataaaaaactaaaggtccgttaaagaaactgcataattgagccccctcccatttttttttcctggatctgtccctggccctgctctagacttcctttctttaaaaaaaaatacaacgcatgtcttgttatttcttttacaaatactcacagaaaattttgtttttctccctttgcaaagaaagcagagacgcctatgataactttgtcatgctagcataatctttaggatgtactcatagggacaggatatgctatatgcgcgtgtatatttagtaaaagtgaagcgcatgcattatgagcatgtctgcgttttaatcgtgttttaaagaaaaaaaaatggaaaactaaattcattcttcaagccgcgcacttacgtacgtgacgtaggcagttcctactcgcttcgccaatcagaaagcgaggcagtacggttctgatatcgtgactttccgttccaacatcggaatcgtcgatctcgctcgcctcggccgcctgggagtagctcgctcgctgtcatctcgttgcgatcaatatatcccggccgccgccgatcaagcagggctagctgcttccgttgcatcatcctcgccggtgatcacccagggctttggttttcgatcgtttgctaaaaagtttggctgctcactaccgaggtcatgttctgtatatgcagtggaagagagcattatttttttctttttgaaattgctaaaaaattgtcacaagttttttgggcaaaaaaaaactttcaaatgtaattgtagtatagttctaatgtaactacaatgtaattacactatagttacattgtattctctatataagttacatatattattttaatacttatatacaagttatattacaatatagttatagtggaattatattacagttatatttgaaaattattccctatatttgaaaaacttgcgacagttcctatattttttaaacatggtcaccacataaacacttaggtgggccaaggttatcttgtggttagtactccctccgtttcaggttatcagatgttttgaccttagtcaaagtcaaactactccaaatttgactaattttgtaaaaaaaagtataatatcatttacgaatttggtagtcctattttctttccgcttcccactcgagtaagttctcgatcgactgcaggcatgcagccaattgtgcttaattccatgatttcaacctatactccatttttccatttagggcgcattctttggctaccttctcgatttttgttagcatattttttaaaccgttagccgttaaaaggtatgttttgtagagataaagtttagaaatggcacgtttatgcatgctgcatgttttttcatgaacaattaatttttattttataaaaatatttaaattaaacccaaaattatgaaatttcaatttttatatttgaaatatccagtctagctattggctctaagcatttcttttgtttatgcaacttgatacaattatttctctcattattttttgtagatggattatagttatgacggcaatagctctgagaatgtgattacttttatcttgccatttctcatggtagcagcggcggtaggagtggtcggatacctactctaccgtctatgcagcatgcaccagcgacaatcgtgactgcaggatatgcctacaggaataggaggtcggcgacactattgccagtctactctacggacaccggtttcaccacaggtgtgtcaccaaatgattcttcaaaagaaccaacggttgccctctgtgtcgcgttgctgtctagtactgtagctctatgggatatatacgtgcgagttatctttttactgactatgtatgtgagtttaggatattttattgtgagttatcattttatgtactgagtactttatatattgtactactagtattactagtattgtattaagtagaacatatacactaagtatttactactactttatattgtatttactatcatttttgttttagacaatgtgcaccccctaataaaaatacatccgatgtctttagtatgaagactagttaatactttatcgagttacagttgcacacactaaactttggagctttcctcgtcgacattgagattgaactttcagaagcagaggcggagctagaaattataagactgtagctaagataggactctactaatgaagtattcatttcctataaaatttacatgatgaattaacaaaatttaaataagtttttggagttaggcctagggcttaagggccctagctaccctaggcctacctccgccctttcagaaaggataccttagctaactaagcaaacttgacatcaaaatcgtacatgcatttgccaaaattcacctgagtttctagcttctcgaaataaatttgtcctaacatagcaaaccaaacctccagctgctcaaaatacaatggtctgcctgccactgctgcacaccttctagttccaccttctttcctctgatatggcaatacataacatatgaaaagtttcagcacacaaagaatctgaaaaaaatattcttctttcgaagaatcatatatgtaatatggatcaactaggaaactatgtataaacagcatgttgtatattgtagggagagatatactgttgtattgaacctcactttttttaaaacggaaaatcaatcatatcctaataccaaaaacacatgaccactcgacagaagagcaagatagatgtacaggatggatccaggatgaactagtagaaggacagaataaattatacaaagctataacctctcttctagtggataaatgtatggcaaaatattttaatgatggttaaatggaggctcatcccatagttacaatatcttagggggcacaggacccctctgtcctcatgatagatctgtcacacagagtccttgtatattggcataggacagcaaaatctccaccgcctcaccatcatgcctcgctgcgctaattgagtcgctggatcaaggaatagcctcgagtacgtgcttggcccgttaaagttgggccagaacgtacgggaaagcaatgaaggtgcgacccatcaggaactgggcaatggctgacgtaaggcccattagtgttgggccagaggcgtatatgaggcctgttgtgtttgtcgccgggccgatgtgaggcccattatagttaggcacaagttactgctgctgctgctgtgattctccacagcccgaactgttttctctttgttttgcacactgcggcccatatgcaagaggtggctggcaaaccgaagcagggacatgtttagtaccataccgcttgttttggacaagatgagctagttgttccgctacttatatagtcaggaagctactagttgaaaactcaagcagctgcgtggtgagcacaaaagcgaactattcttataccttttactaaagaataccgtgtacgcgccacaaatagcagcatacttttatttttggagggtgttttctcttggaaaaaattatctctttagattagactcaatttccaaagctaaatttgttagttttgtttgacactactgtacgcacagttttggagggtgttttctctcgtaggaatacaaatcaaagttcaagatctatcttttaaaattcaagctcaaagttaagtttgctagttttgtttgacagatgatgtggttggcctgctaatcatgctagttagggatggcaaaaatgagctactcaatgtaagtcattctaacatttctcacatttatattgatattaatgaatctagacatatatatctatttagatttattaatatcaatataaatgtggaaaatgctataatgatttacattgtgaaacggaggaagtagttagtgtgaactaaaacaacattttcaaattacatagttacattagtatttttagtatgccacagtagagcagagtatggtcaagaaagcgttgcgtttgccttcaaaactactacataaaagcttggcttagttgaaactaacttgtgtattgtcgcttgcatttccctttcaggacaaaccattgtcaactgcagtaagttcaccataaaaaacaataggaaatgcacatgatttcagtaatcctctatcgagcacaagttacaagtacaggatcatatcaagatattgccgctattatttttctgagaaaaaaactgcaaatatatgtgctgtattgctgcagaggaaaatataactgatccagcaatgcaaaagaaatgtccaccccaattcattcacctcagaccatggagcagcttgtctctctccaagacttcatttttattatctttatagctacttagttctagggacagcctcatgttgttctggtcgaactaagataaacaataagacaatgtttggctaatgagatagcgaaatgattttccacccaccaaaagacatctttaaatcctaactatttattatctatcttctatttaatcataacccttcattcatttcacaatctcaatcccactccccatttcacattatctaaacacaccctaagtataaacatagaaagatgatacacaatgaaaccctctctcaccccagcccatttaagatctttggcatttgtctggtttacgcacagatcgtatctcgccgaataaaagtaataatagttgcattcaacaccgtaatttcgagtatgattcaagcttgacatgaccacctagattcgattatgcattgtaaaaaaaaaaaatcttttctgggacaacatccatggcattagatctctcgcagttgtagttttcttaaatgggccaagtacgttccggaagaggaataagttcatatgaggtcccttaacttgtcaacgaattcgattttcgtccctcaaccagaaaaccagacacaacaggtacttcaactatcaaaaccggtgcagattaagtccctcggcggttttgagggcggttttggatgatgtgacgcctacgtggctaatttgactcgtcttcatctgacgtggcattgacgtggcgcttacgtggcaattcatccagaaaaataataatacccgtgggacccacatgtcagtctcacacagaaaataataaaaaatggtgggcccacgtgggccccacatgtcagtccaacccacccctcctctctctccccatctcccctctcttcagttcagaagagcggtgtggccggctctcgatcttggtcaggctgatgtcccgaaacgcgaaggccgacagcaccgaacagcaccgacgtcccctccctgtcgtgcgcgaacacgatgctcgtcttgaagggccggtccgttcgcgggatgatgggctcccgcgccagcatcacgaaccgcgtcacgttcccggcgtcgtcctggatgccgtcggcgagcacctggagcccgtacaggtcggcggcgcgagaggatgcgatggcggcggtgtcccggagccccgcggtgacgacgtgctcggcggcggccgcggtgtcgtcgaaggcctcgcgggcgacgttgaggcccatggcgttgagggtgagctccccgagggatgctcgacgggcacgacggcgcgggagttctgacggggaagacggcgcggtcggcaatccagagctccacggcctgaaaggccacctcgaactggtcgcaggggatggcgtcgcagaatgggtaggccttggccgccgccgcctcgctgtaggcacccgggagccgggacaccctggtaggcgacgcgcagctgccttccgtgcatgggcgccggggagagatcggtgatggtcacctgatatacgttttgcaaatctcagcaccctaacatcagaaaccagaggtgccatagtaagacaatcatgcaatgaaagtaaccgagtgcctgaatattcagtaatgctcattgttcaggtttcagagaatgacaataactgtaacaacaagagggtgatgttgaattggtgatgaaaaaaaaaaaaaagaaaccggggtgtcacctacaacgtggcgtccgtctcgtcgtcgggcgcttcccaggcgattatcatgtcgtaggtgagcgagtggaactcgctgtcgctgaggtagtcatggcgcttggtctcgacgcacagggcaatgtaggagcagtactccacgacgctcctggcgtacaccagcggctggtcccccttctccggctcaaaccgccggagcagctgctccacctccacgccggcgatcctgcagccacgatcgatcggggaatcaaatcaattggacactggtgaggatgaagggagatcataccgggcgcatcggtggacgacggaggaggcggtgggggagaggggagggatggcgtagtcgggcgccgccatgccctcatcgtcgccgccgccgccgtcgacgcgcggggcgaagaggaggtcctcaacctcaaggagacccatctggagtggcgacggagcaccaggagggacgcatcgttcgttcattcgtcggcagtgtccccgtcgcgcggcgaggtttccatcctccagaggcgaggggtcggtggcgggaaagggcggcgtcgcgcggcggttttgagggtggtttccctggcctaccagcgagcgcgcccgcaagagagagatggccggtggccgctcttctctatttccgccgccatcgtcgtcgccggccgcatctggtgcccatccccagcgcaagagagaaacgaagaaaggggagatggggagagagagagagaggaggaagaagaggaggggtgagttggactgacacgtaaggcccactattttttattattttctgtgtgaggctgacatgtgggtcccactagatttattattttttcagatcgaattgtcacgtaagcgccacgtcaatgccacgtcagatgaatactgagtcaagttagtcacgtaggcgtcacgtcagccaaaaccgccctcaaaaccgtcgagggatttaatctgtaccggttttgacagttgagggatccgttgtatttggttttctggttgagggacgaaaatcggattcgttgacaagttaagggatctcagatgaacttattccttccggaagaatgcaacacatgtggttggcccattttcgttgggccaaattgtacgggaccgcaacgtacatgaggcccatacggaacgggcctgtcgtgacgtgtggcccgttatagttgggccggaatgggacttctgttgtgggctgtggctagcgtcaggaaaggcccaacagtgctgcttctataggcccatgcaggagattggtgcaaagcagagaagagacaccagagccgccgggggagcagaatatttttagtaccataccgcttgttttggtggaggtgagttagccattcggctatttaaagggcggtagctgctcggcgaaaactcaagcagctgcgtggtgagcacaaagcgaactattctttcgccttttactaaagagtaccgtgtgcgcgccacaaatagccgcatactcttatttttggagggtgttttctacaaattaaggttaaatattgataatatttatttttggagttcaaatattgataatatttattcttggagggtgttttctcttagaggaaacactctaagttcaaatagtaataatattgatctaactgaataaatataaatagaatatggatcgaattaaaactcaaaatttatctcttgatagtcaaatttcaaagatgaatttgtcgtttttgtttgtatttgacagatgatgcatatataaacatattaccagtaggttataggccctgtttagattttaacttttttcttcaaactttcaatgcagcgtgtgccatatgttgaccatataggttagatttcaactttttttcttcaaacttttaaatttttcgtcacatcgaatttttctacacacaaattttcaacttttttatcacatcgttccaatttattcaagctttcaattttaacgtgcaactaaacacaactataagcaacctaccagagcatgccaagatttctgacggacaggcgacagcatggaacagagcatatgtttatcataataatttgtcttcaaatagaaactagtcaactttttctttttcatatatgtactcttgcatacagcttgcaggttcctttcattttttgagagatattaggtgcagagtacaggctcgtttctgcaaacaaaatcctgtttaataatgtgaaatctgctattatgcaagttttcatcaacagatcaagagggaaatgggcaagtattttaagtataccacaaaagagtagagtagtactatatataaatttagtcaagaataccttgcgtttgccttcaaaattacataaaagcttggcctagttgaaaccaactactgtatgtatgtactgtcgcttgcatttccctttcaggaccaccattgtcaactgaagtaagttcaccatacaaaacaatataggaaaatgcacaaaatttcagtactccaccatcaaccacaagtacaggatcatatgatcatatcaagatcttaaagatttttttttctgtgacaaaagctagcaaatatccgagctgtactgctggaaatgaaaatcaaactgatccagaagagcaaggaaatgtccatttcattcacctcagaccaaggagcagcatgtctcaatccaaagatctctttttctcttcttgatatatattagctagctctaggtacagccttatggccaactgctgagagtgacaggtaaaatggccatatctgaacttctgaaggcatgaaggtgaagtggggaaaggtgtggacgatgatcttgtcaagctttgatgatggcttaaatcggttggagcaacggctaatgtagtaccactgtaccaactaagccttcaatgctgaacagttgcagacaagagcaaaagatgaggacaagcattgcaagtatgtgtatatgttcagcatcaatgtacattttttagggggccaagaagaatgacatgtaaccatgaattccaggctttgaaatggacattccaatgccttgagcttctgatgaaagttcaggtccctattgaatatatatagcaagtggattaaaggggtactgatgttgaaaaaggcgcaagcacagtgcccatcagataatcagatggcattgttcacttgaagtacaaaacaagttttatttatttttaccctgaaggttagaaatcatgatcaaatgatgtggggaaagagatagcgcaaaaatattaaaaaaaaaactttattgacaacataaaccttccccttttttttgcgagaaggtgccgatagtaggatggtataagtcctccagttgtgagatttttatgggttcagagatggtctgtgacagtggagttttcgtacgggtaagagctatcttttggagcattttgtcgaccttaaatgtaatcatttcgggatgtctctcccctgtatttgtcaagttcttctttaagtcaatgtttcgacatttcttccacaccactgataagcttctccagctgcagaacacggccatgaaatcaatgtgcaaccaactccatcttgacgcatgcatatatcgcgacctgaaactaactgatgagatgggccaacatgactgtccaaagttggcgccttctcagagctttttttttttttccatcggcgtgcatgcatacctgaacatatctgcacatgtcatgcatcatcaaccatgcatgtgaactgataagttctgataagttcagtgctcatgtggcaccctgaggaattaattaacaagatgatgctgattactctaaatcatagcagaagtgaagaacagcatgcatacctgaacatatcatgcatcatcaaccatgcatgtgaactgataagttcagtgctcatgtggcaccctgatccttggttcaaatatcaggaatcaattaacaagatgatgctgattactctaaatcatagcagaagggaagaacagcatggagtttaagccagagaatatgcatgggtgcaatttgcaggagtgaccactttcagatttgttcagaatttatagttctctagtcgacaagtgaccaagcacaatgatgagatattcgtagagttgtcctgaaggaagaactgcacgtttaatcctgaactgttattgtaccaacttatgtgatggccccggcactgtttacacaactaactggagacattttaggcagtattatgggacagtattagttgcaatgtgaagaaacattgatcagcactgaccagaaatccgagggtacactggtacaccaaacaaacgaaataaatgacgatcaagtacaattatgtgctacttgcaaaatgaagaagttagctcttaacactgcaaatgacagtgctaaagatggcacatgtgatccattgattgagaggatagtagaaaatattgagaaataaaaagagggactgctagaagattttttttttaaaaaaagaaagaaaccttcaagtgcagtcagataatgagatctgacaaatatagatgtatcagaaattcagagataaaaccaagaagtgaagagcactccatcagctaaaaattccacagaagatttattaacaataaatggtagatggaaatgaaaggtgaaaaaacgtagacctgaactttgccatcacaattttctagttacttaattcatcaattttaggtcatggtgatgaaacgatgagataatctgtgatagctatcttgctcatttgaagagccgttacgtgaccgaaggtgtatagtgattaccagtactgtgacttatatatattgccgtataatagtctcctcattacctgtcaactcatcagtgattgccaaaatgagttatactcttatattgaggaaatcttctcctttttttttgacttgaaaggaaagcttctcttttgtcagtttatatagaacatgtgcgattcggtggagataaacacacgagtatttacgttggaaaaaatgtctgttttctaacaataaaattttatgaaaaatatataaaaaatcaaccataaactcaaagccagaagctaatcaatcatgcatggacaattgaacttgcctcagtttaattataccaaaatttatgtatgtcccaaacactctacagtacactcgataatttcttatagactatattaactttttacgtgaacgcgtaaaaaaattacacattaatttgcagactatattaacatatggttccaaccttgctcggtaacaccaagtcagtgacatatcaccaattcaccaaaagctcactctagacgttgaanaatcaagtnttgattattcgtgatcgaatagcttctgatttcgatgttcaggactataaattctgcctcctttataatattgaataaaatcttctagatagaagtaggtacaaataggtatgctgatgcaagtaaagtcgtatcgatttgaaatacgatggttcatgagagatatgataagttttttgcacttatatacgaattttaaatatgcattattacatttttgaatataatatatacacacgtctctatatatcatctgtacacgcgagcaattgtgacgtattaattgttgtattttccatacgagaagatgcatatgcttacagatgaaggaagaaatcaacaccttcttgtaagtttctttagaaataccttttttttgtaagtgtatgaacggattgaagatgcattgtgtgatcaacaaaattcgaactcccgtcatgctttcaaagtgtccacaatacacgtaatacatacaccatgagaaaatttacccccaaacaattaaatatgatcatgcatcgcatatagatacctcaatatctcataccatcaatatcggtttggaagcgaactgagttcagttgtagtttgactctccgactcatcatgggcgctagcatttacaaataattattctctccatctatttttgatagtcatatttcatcttagcacacatactaaggataagtaattttacttatcatctatttaaacatgctactagttattcctcgtaaacaagcgattcattaatatttatatttctcaatgtccatttagccaatcttgtgtggaagaatagagagtcacgcattaaatccgagaaagtcattaagatgataggttgttggattgaaatgtgcctatcaaaaataagttttttcagatttggaaatataactatcaaaagtagatggagggagtaatatttatcaacaatgaagactcataggtgcttatgggggtaggataagggtaagatgcacgtgcttatacatgagtgtgtatttgtattgtttgtgtttcttaaaaatatatatacacttttttttcgaaatacgatacactatattatacatattggtttgggaaaaaaaatgcagatcacgagaagatatcaacctgtcgtgcattgatgatggccacacttgtacctggttttcgatcttgatcattaatcttgccaccttctcattcacacagaagaacatctgtttcagaagaaaagtagttcagggcaaacaccacattcagagaaacataaggtgtgtttaattatttttattgacgtacaaagcttgctggacttcatgtgaagtcgacggggcctttccatatgagatccatataagcatgtgattattataccacacatcgttccatctcaatcttccaaaaatcaaacggtgaaaggataccctaagtcgttccctactttagtaggtactagatagctagcaatcttactttattagcttcattacccccttaatcatgccatctgcaaagttggagtgccagttaatcaaaacaataccatttttttttgccagaaacacaatactatttattatgatggttgaaaatttttgctccgcttgaaaaaatagaaacacctagtctacgaaaattcctagtagtgtattcaacttgatgaagcttcaaccatctacgcgttaatggattcacctaattaaatcaggctaaaggactcctttaggatgcggaaattttcacattacaagcattgtacaatttttacaagagtcaactcgattccgtggagaccagaaaaaaaatcccgtgttctagaggagtatgcgtgtgttcttttatgttgcatagctgaatgatttatgataagtgttcaagggtacaaatgaatgaattaactattataatattagaaaattatttaaaatagtattttaagaaatccatatatataaagcttatgtaaaaattgtaccatttagaaactcgaaagcgtgcaatatttatctatgcatatttatgacaatttatatatatgagtgcatgtgtatcttttgtgctgaatgattatttatcataattaagtgtagaaataaacaaaataactattcacatatagatttttttttagaaaattgcaccatttagtaacttagaaaacacgcatatttatccattcatgcaaatcattcattggaactcaggaagtgaatttcggctatctattaagtgactgattattttcttatctatcaatcactttttaaacactaatcaatatcaacaattggtcttatgtttttctttcttgtgtgaagcatgttctaacctaaaagttaaaacttaaaaggatatactacctccattttaaaatgtataacattgttgacttttcgtataacgtttgaccattcgttttatttagaaatttggtgtaaatatgcaaagttataagttaagactataatttatttaatgataaaacaagtcacaacaaaataaattatgtttatttaatttttattaagacggatgatcaaacgttatgcaaaaagtcagcagcgtcatacattttaaaatggaggaattatatgttttgatgtaacttcttgcccatatgtaactagaaattgctatttatataagtaaataatacatccagattaatccaaaaaaaataaaaacaaaccaaactaaaagttccgctttctttttactgaagttacaatttgcaagtttagttgactaaaaaaatcgaccctgataaatagagctgaatttctttttcttcagcaaaattcctaaaagaaaattcagcaaaatcaagagcagccttggtcggttggccacacaaaccgctttctttcttctgttttttttttcttctccgaggtggactctgcagcgcacgtaggtacacagacacaaggctgccgcatgtatgcgtcatgtggcagccagagggagaggaacaaggcaccaaaccaaccatggaatggaagcaaaacactcctaacaatttggcgccctctctgtctctctctctctctctccccccttctttttgtgagaagcctcctcccacgttttcccgtctccttaactgcttctctccttcctctcctacacaactgtggtggttgcagcaagaaagagagagagggtctgaaggcagcaagaattcagtagcattccagctgccgtgggagagagggcaagagagcaggagaaagaattccagcggcggcggcggcggcggcggtcgtcggagaggtggagagatggatgtggagggtggtggtggtggtggtggtggcgcgccgcccagggggaggaattcttgggtaatcaattaagctttggttcttggtttggttctttggtctttcagttttgtgtttgatttggttggtttggtgcattttgtttgcaagtaattttgcagtgttactgcggattctgggatgagttactttgggtgcgggcgctatctcaagttcctcagggttaaattttgtagattttctgcattttgttctgaaaaaaactgaactttttcgaagtctatggcgctacaatttcgcttgaatctacttctgtctgactaggtgtttctgtgtatgcatgagacagagaatgctctgaagctaaggttgtagcggcgcacttcttttcagttctgaatttaggtggtaaagttggttgttttcagttaattaattttgcatcagtccagctcattagttgcagtcttgcagagtgatatgttatgctttctgaatctgataaggggaatccatgagttcaggaatcaatagattccatagacgagatggtatcacgaaatctttgtaatgcactgtaattttcctctttggtaaacgggtccattttcttacatatacacgatttttaaacgtagccatcaggtcacttttgatggtcagatgggacatttcctttcaacttagtactagttactactacttcagagtttgagattttttctgtttactttgaatactatcttgttgcctatttcaagttactctttctagatcatcaattttggccagcagtaaaattcaaagtagtcaagtcgatactactgattagtaattacgtcatcaaatggtcacggacacgaaagcatgacacggtctgtgtttgctagggatggcagaaaggaacacttctactggcatatcagagcttcggagttgtgtatggcgatctctgcatctcacccgtgtacgtgtacaagaacaccttctccggaaaattgcgtcttcatgaggaggatgaagagatccttggggtattatctctggtcttctggagccttactcttatacctctcctcaagtacatcatccttgttctaggagcagatgacaatggagaaggtgatttcaaaaatccgcgtgtttttcgccgtattaataatttcaatgtgcatttagttaaatatatgccatttttgtcttgcaaatgtgccatgtatgtttgcaggtggcacatttgctctgtactcattgctgtgcaggaattccaagatgggacttctgaacaacatgcgtgcaaaccatggttctctgtcggcatacaacaaggaggaaccttgtaaggagtcgaggaacagcatgctcatcaaggccttcttcgagaagcattactcgcttcgtgttgtgctgctgctgttcgttctgatgggtactagcatggtaattggggatggtgtcttgaccccaacaatgtcaggtactgaactctgaaagactgaaactgaagatttgtggaagttgtatgctcaaggcacaaattttgctgcttgatcatttttttagaaattttagataatggaagtgttttataaaccaaaaatatatatgagcatattttgtatacaattgacaaacgtatatgatagagtaaggaactttgttttttaatttcttttttttaaaaaaaaaacagagagtaaggaattcttggggaacatttaaattgctttaacatcatcatgttttgtttgtgactgaagagggtggcatgttcttttctgcagtgttggcggcagtttctgggctcagaattaagtttccagaactacatgaaagtaagcagctgatatattggcttgtctcataaaggtttactggtcactcctcttagcagcacacatttaaattactcttattctcaattctttttcttcttaatgtctacttgcaccagaaaatacagctgatctgctcctgttacacttctctgcagattacactgtgctccttgcttgtgtcattttaattgggctttttgcattgcaacactatggaacacgccgtgtcggattcctattcgcaccaatcttgatttcctggctcacttgcattggtgggattggcatatataacatcataaagtggaaccctagtgtcatccgtgctctgtccccgtattacatatacaacttcttcaggaaggctggcaaggatggctggagctcactaggagggattgttctttgccttacaggttcacatatttttatccttttagttttggtttatcacttgttttcgttgtaacatgcttaattatagccgtagattttcaggtgctgaagccatgtttgctgatctggggcatttctcaaagctttcactgagggtaatatgattttcagtggtgaattggtgatagtttcagtcttggtagctgaaagagtacacttttttttttttgctaagaattagggaaagaaatctttacacttatttttttgttttgccatgacagcttggattcacaattgttgtatatccttgcttagttctggcttacatgggtgaggctgcatacctgtccaaacatagggaggatctccaaagtagcttttacaaagctcttccaggtgagatgttaattctcttgccagattgcttcaggttttccgctgctttttttttctcatcatcttttccaacagagagtacattgattcttgtaatattatatttatcaatcccttcagagtttagtatatataatatcagtagaatttgtgcatggcccatgtaaagcttaacacaagatcagggaaaatctggcccggcccagttatgccccaaaggtgttatgggccatgttcgggcagtattaagcacaaattcagccctaaacaaattcttctaatttcacggtacaaattcagtgtgtggtcaggactgaaacagaaggcctgagaaacttgggccaggaattttggcctgattccaatttccgtccatcgtttcgtctgttaatgaagtgcacatcattcttgtataactcactttcccttgtggatctgtggttttctattacttatattaccaaaaagaaatagtgtataaaggaagtagaaggatgtgaatttgtttgtgaaaggttaatgggcctttcaaggtcttagtgtatggaataactcaggaaactacaaatcggatgtccgattctcttaaaaaaaattgggtggttaaatatttcagttgaccaccagtgaaacattaagttatgcgtgatgaaaaaaacagccattgattttttttttgtgtgtgaaacatagtgaaaacacacgtttaaacatgtcgttatcgtgtatgaaacattgagttttaacagttcgaaacatatgttttctttcatcagaatataatctttgtgatatcttactgtgtgatcggatcataagtcagacaagtaatttaggagaaaaaaatatgttgaaaatcacaaaatacatacatgtatggatgaagtgaagagaacaactagtagactccaacattaagaatttattttcttggcaaatttatttaagtttgaaagctaacataaattcaaagagaattggtttaaagctaagcatcatttttgtcgagtataaacatgcaatatttatatcacctttcattaagaaaaatattcaaaaccatgactcgctatgagcagtagattttaatatttagattgaataattagcatgaaaactggtatgtgtgctaaaaggcaacaactttcgtgctagtgcacttaatccgttgcttttcagaagaacccgcaaatgtaactgaaatataagacctaaatactaaaccaactgaaccacaaatatgcactatattggatgatagccctagccgccgactccgacagttgagaagtgacaaacctttcgattgataatcagattatctgatgaaggtgtgagcataacaactcactcatgaagattactacttggagagataggcaagccttcagctaattgaatactcaacagtcaaaatgctattcgagtaaaaggaatttgttgaagacaccctaaggccttaatggtccctcatctgcctcgagcacataaggtagggaccagaaagttatacacgtagtccacaggttatttgtaaacctaatactatttaacgtaggaaaatatctatattaccctcaagtcataggccattgttgaggggatgttgtatgtaatttcttttgtaccctatctagattaattagaaaaccaccttagtgacaatgtaaagggggactatctttagaggaaaaaagttgtaacaagcttgtggtaccacacttactccccatcgaaggttaggggccttcaactcttgggccccttactctagaactcggaagtagacaggagacacacatattgtatatagtagtcctataatatttttcaagaaaaactagcggtacaacagttgtagtgaacgtatatatgtttaactagatgaataccccgtctcgttgctacgggaaattaaattgtataatatgtacaaataagatgcaatatattttctaaaccaaaacaaaatgacttcctatatatgttttatctaatctacacatggttgcaatataatgcaaggtgaacatattttatgtaattgatacttataaattttgagcctaaaaaaaattgatattgtatggtttcatgggtgaagaaaaaataaactatttgtaccatagatctatcatgctagggctaaaaataattgagatgatgtggcttaatgagagaagagaggaataacattaacaatacttattaacggggatgaactatataagtacataggattacatttccttctaatgcagcaattgaagttattcgacaccttctagttattttccagctagtgttttacatatctgtgtatgtttccttttgctacatatatatgcagaccgtgtgttttggccagtgttgttcattgcaacgttagccacagctgttgggagccaagcgatcatctcagctacattttccatcataagccagtgtagggctcttggttgtttcccgcgaataaaggtggtgcacacatcaagccatgtccatggtcagatctacatcccagaggtgaactgggtgctcatgtccctctgcttggccgtcacgattggattccgagacaccgagatgattggcaacgcctatggtaactagcacatcatttgcttcttcttttaaaccagactcttacacttgaggtaggatttggttaaacttttaaaactttgattaacaatactttcttagatgtttagtttataaagacaaaaatggtatacacaaattttccttgagaaaaacactatatactaatatcgtaaccttgttatattttataacttattccaatataaaatttatagtcaaatatttaattaaaagttgatcgaatcttgtcctttaaggctacaaagagtaaatttaggtgactgataaatagtaacaaccagtatatcaacacccattaattacttgtgttaagataaattttatggtccgtaagatatatcaagagataaattttgataccttctgataccggatatatcaagaggtaataaattttgcattagaaaatatgaccatacctccagataccttttcaataaccgtaaaatcactcagttatcttgtgttaaaatttgcaggacttgcagtgatcttggtgatgtgcgcaacgacatgcctgatgttcctggtgatcaccaccgtgtggaaccggtgggtggtgtgggcggcggccttcaccgtcgtcttcggctccgtcgagctcctctacctatcggcgtgcctcgccaaggtcccccatggcggctggctcccgctcctcctctccctcaccacgctgctggtgatgtccacgtggcactacggcaccgccatgaagcagcagcacgaggtccagaacaaggtctgcctggaccacttcctcggcctcagctccggcatcggcctcgtccgcgtccccggcgtcggcttcgtctactccagcaccaccaatggcgtcccccccatgttcgcccacttcgtcaccaacttcccggccttccaccgggtcctcatcttcgtctcgctgcagacgctcgccgtgcccaaggtctcgccggaggagaggttcttggtcggcaggatcggctcgccggcgaaccgcctgttccggtgcatcgtccggtatgggtacaaggagggcaggtgggaccacttcaacttcgagaaccaactgctgatgaaggtcgtcgagttcctccgccaccaggacggcagcggcggaggcggcggcgatcggatgtccgccgccgcctccggcgaggacgaggccatgtcggtcatccccgccacgtcgtcctccggcggaagcaatcagcacgcctttgacgccgggacgacgacgagctcgtgcgagatcgacgccaccgcaggcggcggcggcaggaggaaggtacggttcgacaacgacggcggcggcggcggcgaggaggaggaggaggcggcggaggtgaaggagctgatggaggagaaggaggccggcgtgtcgtacatgatcgggcacacgtgcgtgttcgcgcacgagtcatcgtcggcggtgaag

SEQ ID NO: 43902 - DNA, 11947 bp, Oryza sativa
gagtcattctaatagtcaactcacaatcaaagctaggttgacttggttacatccaaattagttacgggaggggagggatgaattatgaatagattagttgtgtagaacacctgggccgtgatttgcagatgggtcgcccatcagccatcccctaggtaagggactcaaaatgaacttattcctccccagaacatcaaacaaatctttcttccctccctgtgcgtgcagaatctttggcccatgacgtgatgccactcccgtcaccgaattccacggtcaagtcgctgccgtttttgtcaccactccacccgcaaaatctctacgcatcctcccgatgatcgatcgctatccccaacagtctcacacacaccaatgctccagtgcagcagctgccacagtagcagtagcatggccttgctctgctactatacaaccatacaagccatgctctgcaatgttcatctatccatccatgcgatagataacatctagtatctatctgctcgatggatggacacgtggtgatcactgcgtagggtttatttggggagcttaagattctaagaagcagctggttggtaaccagtttctgagaatatgaaaaaagctaggttttccttgcatctggcttctagttcattttctggattctacaactacaacttcttagaatctagaccaaaagctaaactatttgggaaagcttccgattctgggagaagctgcagcagctagaagctcccccaaacatacccgtacagtgccatgtggtggcacattggatgcaacgtgccatggcgaagcggagcaggtgtgagactgaaactattgtccgagagcgttcttgctcgccggtcgggcctcgattgggcaatcggacagcgcgtgcttcatcttcaattgtggcctctcacttgcttcctgcacatggcatggcctagctgcagtagcagcatgcagcatgcaggaggcagccaggtcgtcctcatcaaactgttcatctcctcctgcttccgtgctccgatgccgctaaaatctgccggtttctgcattgcttttgcacaggtttttcttcagtgttgttcatcgatccagctctgtgcccggcaggcaaaatcttgccacaatctctgcacttttgctgtgtttctatacttttgcaaaatttttgtcttggggatttggagaggtgtgcaaaatttttgtcttggggatttggagaggtggcagtgtagcaatgtgatgacaatgcattcatgtcgtggagaggagtctgttgacctgctgaattttcataacaaaactgagctgttgtcttattgaaaaaccggcatgtgttatatactactcgtatttataaacttgtactcggaagaaattattagcactgttgcatataaaaactccagcctccaattcagtttcccggtgtgatatcctttcacatctgttcaaaccagcaaaaattcagaatgaccaatccatcattacgaagcatttagcatgagcaccgcctgcaagaagaaaaaaaaaccaaaaaagaaaatcaaatttgcagattaggctgcacatgccagtgcaggctaatccattcacgacgatgatctacgccgcctttgcttactaatttttcctcctggacatgtgattgacacagatataagttgattcctgacacaaatgattccaacttccatttccaagtagtagtagtaggaatcaaacaatgtgataatgcaagagttagttgcttttaagcacaagttaagctggtgctctaaaatcttcccaggtatcatcatcgtcatcaacaacaacatcgtccccgtgagctcagccacagtgtggcgcagttgtcagctgtactggccaagatttctgcacatgggagctgctacctcctgtcaattgatgatccatgctttggccggcccacggatttcgtttttttttgtgtggcaatttaacatcctcatatgctagatttttcttaggccaatatggtctctctctctctctctctctctctctctctctctctctctctctctctctctctctctctctttgagcaatgaaaaagatttgatggggatatttgatgaaagcttaactgattactattaaatttataatgatcattgtgcgtcttctttctgctggaaggtattgaaacatttatagctttctctctctcttttgttgatgagtacgcaccaatttctgagatagtaacagtgaagaacaagcaacaaaatgtgagtgtgagcttaaccaagtgtgaaaaattttcatgtcaatctctctcacaatggtggttggtgaaaggctgaaaggggggcaaatgcgatgatagtccacagtagcactatcatccctgtcagttttcactcatttgtcaacttgttttcgctgaattttggcagctggaacattcacattaagacgttgatacctcgatcaatcagagcataatcatgccgtacagaagacattcacagatcaaatacgggcaagtaatctgatcagcttatcatctcgtacggcaatgcattcggacaaaaacgcgtaactcacggaacggatcaaacaaggtcagaaattccggctgcaattctcctctttactccactctgcaccacgatccaagaaacttagtacaagttggtaccaatcagtcaatcaaactgtgtggtttgatctgaagaagacaagctgacgacgacgatcagcttaccactgtgccacgctgccagtgctctgaattcagaaaacacagcaatctaacacagcaagaatgctgtgtactctgagaatggctgatcttggaaatgtggcacatgaaaatcaaccgaatcagcaaaagaatccaggggagaaatgcaaatgcaaggacattgctgattaattccctcggatcttggatgaagcatggcaaagttcattcagttcaacagattttgcattagcaagttcaaccatttttcacatgagattagccttgcggcttacatgtatcatcgacaactcatcatatccctagcaaaaaaaacaagagtaaatactgcattaccactagctagctacagaagctagagcttagatctagatggaaagaagctcaaatggagaagaacacaaaaaaaaagaagagggaaaaaataatatcccctaattcccaccaaacagcaggtgctaaaaaaatttgagctgcaggagaaaatgcggcgaaatccccgtcctacccccaccaacccattcggaggtggagttaaccctccctatgtacacacacccacacaggggtaggtcagtaaaatgccagcagctaaagcaattgggcgctgcggctgctgctgcggatttaccgtttcaccctggggcaaatgacaactatgccctcgatgggtaaagcgtaaataccgcgagcgagaagggcaaaacggggagacggacggggaaggggaagaaggggggggtctctagtagtagaccaggccgccgccgtcttcgtcgtcgtcgtcgccgtcgccggcggcggcggcggagaggcggaggaggagctggtggaagtcggcgacggggcaggggatgcggagcgcgcccgggtggccgtagccgtactcctgggcggcccgccggagcagcgccgcgaacgccggctggccgaggaggtccgtccgcacggcgtagcgctccacgggcccgccctcctcgccgacgcacaccggcacgtgcccctccgggacgcgcgcgccgcaccccagccgcctcgcgccggcgagggaggaggaggaggacgcggacagcttcgccgtccggtcagcccggagcggctggtacgcggcggcggcgcaggcgtcggccgcggcgacgcgggagaggcgcctgaggagacgcttcatgatggctgcttcacgtcgaggcttggcaatggcggcgccggcggcggaagcggaggcggcggaggtggtgggttcttggagaggcggaggagggtacagttgagaggacgcaaggtgtttgtactggggtggtggtggccatggctccttcttatataacggaagatatgggagttatgagttgccaaagtctttttgtgattttttttttggctattcctttcctcctctcctctctctctctctctctctccgggcctttacaaattcttttgtccagaatgggttgtaggattattaattttgtgcacctgctttggggacaacttcagattacccaatgatgacatattctgttcaccgttcgtgggaaatatgtataaccgctagttacgcacacgtgaagattattgtatataattaaatcgctaacgactaataaatatattttattggattagtatctcttgaaatcaaccgttgactttattcttcaccattgctctaatatccctacatcaagcaattaagcaattaaatatacctaatggttttttcagcaagaattttgtttcaataaaaacctaatcaattattttttttaggtggtagaggatttattggtttggctttgtaaaaatgcacataaaccttgcccataacattgatagcatattcaagctatcaagacacatccaatcttcaggtcaaattgacatatccaatcttcttccatttattttcttaagtaatgaatataaatctgacatttatattcacaagtggatatacacagccaaaagataaaaaaaataaaaaattggattggactaactcgatagttatgtcatcatgtatctactaatgcgtcgtaatctagttgacatttaaggtttttaacatatggagtatatgagttgtctcgagtatgtcagatttgatagaattcaaaattgaagggaccgaaaaccagcactagtagatgctcatcctatccgttgaaatttgtaaagcctagcatgtatatgtgtttcccacaaataaaagaaaaatgccgattgatacaaacctgggggacgatgggcgtgtgaggttagcaaaacatgcagggaaagaacgtggctagggggaggaggtacaagtgcgcgtaccgtacgagtacccggaaggtacaagcggcaataagccggtgaggtgtgggcccggtcgggccggtgccttaactagcacccggtttttctccggctggaccctgaccgaccggccagtcaggctccgggtcgggtcgggtcgggaccgcttcgcgtcatccgtgagtgagaacgtgccaggcggccgcatccttccgtaacaccggtcgtacggtgtgcgacgacgaggaggtgggagaattggtgggggtcactgctgcagtggggcccaccctactgacctggcacatggaagagagagagtgagtgagtgagtgagcacttgacttcgtcgacttctccttttggtcggaaatgcccacgaccagtgatgagtcaccttgtgaaaactttgttggacagtaataaaataacaaaagataccctaaccgtaatttggataatctttcgtttgttgttcttattttatttatctcattacatgtatgtatatattatcccatcgtttggcctaaagctaatagataaaaataagtaattctttatccctataatatttttagcgatttaaaatccaacgctgaaaagaaatcacgataaaaagaaaccctcaaaacaacacctaagttaaattttaacacaatgaaacgttccgttttttaattaacccacatgcataaaagccgtcgatgatgatcgacttgtttcacctgtgtttcggatgcagttgagcacacactaccagttataccaccaggctgaactagctagtgccttttttgtatggacttttgtgtggagaaatcatgaatggaggccaccgtcgtctgtacgtagtgcacgcgtgaaaactaaacacagcctagcgccagtgttaacccatcatcacacgcttacacgcgtggagtgcatgcgtaggacgtgcccaattaattaattaacctaattatacatagtatcaagtatatataaaacagcatattccctatagctagtatctgttcaccgtctcaccgaagatatatgtgctagctatatagcttcactagggcactataccaaacccggccacacaggacatgaagtttgcacggtgaacgattgatatactatctcatcccctaaatgtttgacgctattgacttttttaaacatgtttgaccgttcgtcttattcaaaaacttttgtgaaatatgtaaaactatatgtatatataaaagtatatttaacaataaatcaaatggtagtaaaagaattaataattacttaaattttttgaataaaatgaacggtcaaacatatttaaaaaagtcaacggtgtcaaacattttgggatggagggagtacaaccatatactccctccatttataagtatttgacgtcgttgacttttttaaacatgtttgattattcgtcttattaaaaaaatatataattattaattctttttctatcatttgattcattgtaaaatatactttcatgtatactacatatagctttacatatttcacaaaaaaattttaataaaatgaacggtcaaacatgtgcttaaaaagtcaacggtgtcaaacatttagaaacggagggagtatataattaagcggcatttgcacacacttcgcacgaaatactagtgcacaagatatagttcatgaggccattcctaacccaagacactagacatagtttccataaactccacataatcaagaaactagtactagacaccactctttcaatgccaaattttttattcatagtaattaatgatccttaaattaaataaacagtaaatctcagattaaatttgtgaaaataggatggacgttgttcccaatagcgtccaagacttggacacactttcgaagagcgtccaaaggtggacgctgttctgggcggcgtccaacctgctgcacctcatcctgctcggtttggatgctcttcggtgctctccccaaccatttgccacggcacgcgaagaaacgccatcaccggcttccctctcctcgggcccaatgtttggattggtgatcgatcttgataaatttgtttgcaggttggaaaaaccggccgctaatgatgtgttatggatgccttggtcattcaatatatcaaaactatccgaaaactagacattgctgtttattttgctttattctgtaaaattatttgtgtgctcaacatttgtacttacagtgctctactttcaaatattagtgaattccattcataccactacctagttaattgtcacaatctgctaaaaaatactgctgcaacatttgactagattgaaaggatatcgcttcattttttatgtggtcagaacttattgtattctgatatgtggtggtatcatttgaatatttttttgaatcgtctgagccaacgcaattgctgaacccgtagcatatatgtattcttctgtgcagccttctagacgctaataggagtaacaagctagagcaaatgactgcatcacattgacaaaattgataacgtgtacagtctgttagagaaagggatgaaggcaaagctatttgcacttcaatagctaaatacaggggcgcagaaaataattaaggacgcaaaacgtcaatcgccgatctttttttttcggtgatagatgaatggagaggaaactcactgacttctagtagccagcagcgtagacttcggcacccagagaccctaaatgcgcgatccattctggctggacacatgacgcgtgcgaaccaggttatggacgttgttacaagcaacgtcccgacctggacgcacatagctacagcgtccaatcctggacgttagagtcaagagcgtccttcctatataggtaaatcccatcccataattactaaatatttaatttaggcataactaattatcacaaataaaaaaatcggcttccaatgcaaacaccactatttcatacttaactttaatgctacttatctcacatggtgtcttgatgttgtgtagaaaccatgtccatgcaagacatggtttccttctcttttctcatttattcacttgccatatcatttttcattctaggtggcagcttatttaatgctatagatcgacatcataatagtcattgggttgggaatggcctgatgcacatatgcatgtttctcgatcgatggaacatttatactgcaaaggcgaaatcgatgcatgcaaatcagcaaaaaatgtcatcggagtatcaagtagagtggcgaatggtaatcatattctccacgttttggaggccttctctttttctacaaatgggcaggcattgtgtttgggggcatatcactagattcgagctatgccaattggactacgcatatgtgtgtcgtgaatgcatacaggagattaattgctgattgacatgtggtcgatcgaagagactaattaacgaagaagatttgcattgccatgtggtgtgactatgagacgtacacacactctctctcaacttttgtgagaacgaaacgggatggtttattttccttagttttgactcatttggcggcggcaggtcgatcgtacggccattgcatagcattggcacgttttcttcttggattcctcttgtttgccggtttggattaattgattaggtttggcagagagtgagagagaggggtaagctagcttagcttagggcacccataatggttatctatacgctctctacaaaatatctatgtcagcatatttttctatttggaaggtattaaatgaagagagagagcaaaactatctactaacttagagatagtctatagagaaaaacgaggcaatgtatgagagagctatagataccacctaggccccactgctggaaaggctcggcttcaaaaccctgtagacatactattaaggtgatttactattaatcgagtttattgctgagatatacatgttatatagagagtaccttactttaccattgcgggtgctcttagcttgacgtcgtacatgccatatgccctcctaatttccatgcaattgcggcgacgaaattaagtggtcatgcatgctggatggatgcatgagcacatggcgtgccgcgacgacaggagtggggctttgattgctagctgatcgatcgatcgatagaccatcaatcggcgacaaatatggcgtcgtacgtcgatctgattcggcaacagtacgttcgaatcgaactccatcatcatcgatcgtcgttgcccacgcaaaaactgtgcagtagctaagctaaaacctagcttaattaaatgtccagttgtaggacgactttactccctccgtcgtaaaatataaaaaatataaaattggatgaaacatttctaccataaatctagacaatctgttcatgcatatacgtgttattaggaaatgtcctattctatctatatattttgagatggggaaatgagtagtattacaaatcaaagctagcaacacggtgtaaccagttaaacgtgtaagctaataaggagaatattaagtggcatagtgtttgcttgtcaatttgctcataaacaattaaattaaatggcgcgtgacagcatacatgcatggatggatcatctcgaaaactaaacaacatgcatatgcatgcagatcgacattgagtaacctccagacaaaagctattgacgggaagacttttgcgcgggtaaagcaagtccgagcatcatgtggcgccggatgcatgttgaagttgaccagttgacctcataggccaagctaggcccaacaacatcgtgcagtcgtcctcgttggtccatgagctgcaacattgtactccttctgtcccataatataagtgattttgagtttttgcctactttgtttgaccactcgtcttattcaaaaaatttgtgcaaatataaaaaataaaaagttgcgctcaaagtactttggataataaagtaagtcaaaaaaagtaaataataattctaattttttttaaataagacgagtggtcaaacggtgcaagcaaaaactcaaaatcccttatattatgggacagggggagtagtaggtacgttctctgtatatatttgtctaggctttaaatatataaaaaacagtgaaaatgctttaacaccgtaaaatatactccctccgtattttaatgaatgacgccgttgatttgttaactaacatttgaccattcgttttattcacaatttttgtgcaaatatgaaaataattatgtcatgcttaaagaacatttgatgacgaatcaagtcacaatgaaataaatggtagctacataattttttttaataagacgaatggtcaaacgttggataaaaagtcaacggcgccatacattaaaatatggaggtagtatatattttacactataagcactattaatagcatatataagcatactctatacatcccataatattgcaatttggaaccggattggatattttaaaatacaacgaatctagacataagacatgtatttgtctgtttatcttgtctaagcatttttaaagataaaattaatcatgtaaaagtctatggtatcatagagtaaattacagatgtactcactccgtcccataatataagggattttgacattttgtttacattatttgatcacccgcattattcaaaaaatttgtgcaaaaataaaaaaatgaaaagttgtgcttaaagttctttggataataaagtaagttataaaataataataataattctaatttttttaataaaataaatgatcaaacagtacaagtaaaatattaaaattccttatattagataacagagggagcagtacatgcttacgcataaacacatgcccttcgatattaacgaaagaaaagatactataaccacgatgagggtaattcagtaaagtcacatgaaacagtaatactccctccgtcaaaaaaaaaaaaagacaaaccctggattttcgtatccaattttaacggtccgtcttatataaaaattttttataattcgtatttttattattgttaaatgataaaacatgattaatattttatgcgtgacttgtctttttaatatttttcatatttttttcaaataagacaccgtcgggcacagaaaacagagttttttttttttttttttttacggagggagtagagatcacgatgagcactgagccgtggcatactgtgcccatgtccgtacagacgccggtgtccgtcgctgggttttaactgcaccaacatctaccgactccccttcccactttgtcccgggtcgacgcggtgggacccacctcttgccggcctttaaacagcagacgactatggcaggtgggtccagatgccactccccgaccgtcggtccgtgccatcctgccctctagtacacgcaatttggagtataatttgattctgaatttcgaaatcagaccgaatttgacagaccgtccctctgcaaggtttgaatttttcagacgcatggcggcacagttacctacccctactccgtggatcggttcgtaggcttggagaattttgaggccgtcacgggcgcagatagagaagaaaaaacatcgtgtggcgcctgaatctgattcattttgcgtccatgaatccatgatgcatccacgtgttgtgccgttttggagagaagttgtcgcaggctggagctgaagccatctatgtgagcgcaagtagtatgatctccaatatgttgcccttaaaaataccatattggattaagtgatgaggtggataagagaagtgaggagagatataatgagccacccctaaatcaagaggcaactttcacataaattttaagaaaaatatgatagtattagagatattgatttttgtgtaatagaggtgatatattgtatgagttaactcttagttcatgagtgaataaaa

SEQ ID NO: 43903 - DNA, 718 bp, Oryza sativa
caaattaatgccaatatagatatatattggcacacgtgggtgtaatgtttttcaccagaatgaaaacttcaaaaagcaccaaaacttgattttttgacatattggagtctgtttggtgagtctgtgtcgaaaaatcactctgtgactcgcgcgcgaagttttgtcaattaatgccaatattggcccgtattggtacatgtgggtgcgatgtttttcaccggaatgaaaaacttcaaaaagcaccaaaacatgatttttggacttattggagtatgttgggtgagttcgtgtcgaaaaatcactccgtgactcgcgcgacgaactttttgtcaaataatgccaatattggcatatattaacacacgtggctgcgatgtttttcaccggaatgaaaaagttcagaaagcacacaaacatgtttttggacatactgtagagaattgggtgcgtctgtgtcgaaaaatcactctgtgactcgcgtggcaaacttttgtcaattaatgccaatattggcctatactggcacacgtgggtgcgatgttttttaccggaatgaaaaacttcaaaaaggaccaaaacatgatttttgcatattggagtgtattgggtgcgttcttggcaaaaaataacttcgtgtttcgcgtggcgaagtttgtcaattaatgccaatattggccaatattgccacaagtgggtgcgatgtttttcaccggaataa

SEQ ID NO: 43904 - DNA, 747 bp, Oryza sativa; identical to SEQ ID NO: 39204

SEQ ID NO: 43905 - DNA, 775 bp, Oryza sativa
ttccctgcttggtagattgatctcggttttgtatatttcacctgtgctaatatctaggtataaggtggtatcggactactagctgatacatgttaggtttgccctatcggctatgctgcgagcatacataatccctactgtggggcacatttagatactgagtgatttatactgtctcggcataatgtccgatctatcccaatcactcgatctaagcacgttccattggatggattacgtatcatctacagccgatcgagtaggcctaataatctctaagttttatctacctttgctgatctgatgcaagttatatcagcttgcctttgctgatctatcgttgatggatttaactctttgtcttttttctatcttgttggttgcaggatcaaaccagctggcacgctcagaacccaaaggcaatctctttggacctgcactagagttaagcagatctcttaggccagtgcgtgttttttgcgtcaacagaggtgtacaactttacccacaagacacgattccacacatgttaccatgccctgaagtaccgccacgatactacaaaggtggaaatcgtgacaaaaccccccgtacaaccctccctaaccaaacatacccacctcaggtttcaccccctccttgtgccaagttgggcagtcccttctcgcgcctaggtaaatccagctacgcagagaccaatatcaaggtccgaactgcaccatcgcctctacctttgccatggtatgtcagctaggttaagttatactgtagattt

SEQ ID NO: 43906 - DNA, 1364 bp, Oryza sativa
tattccatcaagcccagttgtatcccacatcctatcagcctccttattcagatgctcatttgatctcatgaaaacagttttacttccttgccattgcccaccaaatttgcttgactcggcctctggtgctggatcaccattctcaacaactgaaatatcttgaactttttcaggtgcaaaagttacagatgctgaagcatcctcgccagtattcttttcagcttctccgaccaactcaaactttggtgttcctaaaagttctaatggctcttctgttctattccagtggcatactatatcaaacttaccatccttcggcagctcaacaacacggttattaccatcttcccatattttatcttttcctcccaccaaaaatataacaaatttaaactccacaagtgtttctccagggagcttaagctggcagacccaaccatttgtagtccattccagttcaacctgctcctcccatgaaccaagctcctttgtggaaccgataatgcctacatgctcaccaaacttaacctggtgctctagacaaacctggagatgcaccaatggctgctttgaagaatctcttctctttttctcctttgttctgtacaatgtacagtcaaattatagcaactgtaaccaattaattgtccagaaaatttaagtttgtaaactggaaagtaaatgtgtgcaataaaactctttaaaatgaaccttttcaggttcacaattttagttaatcacttgaagccagaaaagaaaaggcaaaccaccattgtggaaaaataataataatgacagacagattgtcaaggaatatggagatagtcagttagtatacagaagtctagataatgaaattacgttacattatctctcattcaaaatttaaatagcaatcaagtgtaaccatgtttcattgatcctgaaggaactataataacttaagtaaacaaataacgaatgcagtctatctcagtttattatgcttttattttctcatataccgctacgttggtccaatatttggcatttctttgattgatcccttggttacattaggtagacttgttgtgttgttgcttactagtttccatataaacttgttctattgggctgtatcacaagtttattagtagcaatttccaatcgtacgatgttgacagaactagagttgcaatggataatatccaacacgaaagacatctcggaacaaactatacaatacaactgcccccaacacacagagcttcgctctaccaggtttattgcacgcagcctcatgaaagcataagagagaggaggaaaaaaagaacaagatatcacctctctgccgccgaggccgcggatctcccgcggcacgcgaa

SEQ ID NO: 43907 - DNA, 17596 bp, Oryza sativa
  unsure (1)..(17596): unsure at all n locations
tgctataaatctgtagcccgctttcctctctctcttcttttctctactccacatgtgcttacagctgacttatagcatgttattgtactcgctcttagcatgttattgtactcgctcttagttcacgaaaagaaaatttttggttgtcacatcagatgtttgaccggatatcggaaagggttttcagacacgaatgacaaaactaatttcataacttacctagaaaccgcgagacgaatcttttgagcctaattaatcngtcattagcacatgtgggtactgtagcattatggctaatcatgnantaantaggnnnaaaanattcgtctcgcgatttcccctctaactgtgcaattagttttatttaaatatatatttaatgctcaatgcatgtgtccaaagattcgatgtgatgctcttaggaaaattttttgggggaactaaaccaggccttaggtcgacgccatgtgttactaccataatccctcatgttccgcgtgcacgcttttcaaactgttaaacggtacgttttagcaaaaagtttctataggaaaattgcttaaaaaatcatattgatctattttttgaaaaaaatagcgaatacttaattaatcacgcgctaatggagtgcttcgttttccgtacgcgagatatgtgttgccaacctagctgccgaatacaaccttagaccattcacagttcatcacactattttgaggagccttagagtgccatgtaggctaaagctacgggtccaaaatctggttcatcacagtgcaagtggctctaggagtggctttaattttactccctccatccacaaaagttagacatatttcacatttgagtttttccaaataagttgttcctatttgtagtctttatgcattcaagacttaaagacttaaagaagagataaattaaatgtttgattagaacccaaggagtcatataaatactcattggttgcatggtagcattcgcccaccaatttatcatatgcctctattaatctagtcttagcatatcgatttagctctatcggttgcttcttgctttagggtttctgctagtatcggctaaatcgtcttgctagattagattagcttagacatccaccaccctgaaaatcagtcaagggcttgattgtttagatattgtgtttcttttcatacttagtgctgcatcagttaagtttaatctactaagtcgtacttaaaaccataatctctagcatactttttgattgccaataagggtttcatcagagtttcagccgatgaagtatctagacgtcgcatcggcttgtaaggattacatactgttgatgtgaaaacacgacggcctgggagatctgcttaactccagtgcagttccaaagctaggctcgagtgtgtcaatgccagctgatttgatcctacaatcagcaagaaagaataaaagcagaatcagtcgatcgatagcgtatcagccgacggagttagaccaaatcggctatggactggatatatcaaagaataataaaccctaaacatacccaatcgactgtaatactatctatgagttcaatagattgatttaagacaatattatgaaagtagtcaatgtgcagtctgttgacggtcattatcgatcagttgcgcccgtcaatattaccaaaataaaagataactagttatgctcgcaatgcatatttatgttagaataagttatattccactagcactaggattctaacctcttcaagagaataaatacaaaatggaggagaatcagtagcaaaacatacaatcgatcaatcagacgctatcgagaatcagacttgcggacaagtgggctgagaacaccaaattgacacgtccaaaacagcccaaaattcacaagtatacagaaaggagcaaaagaggaggccaccagccgagacttgcgaacaagtgggctgagaacaccaaattgacacgtccaaaacagcccaaaattcacaagtatacagaaaggagcaaaagaggaggccgctagccaagattgtgctggtttggcctagcccatgaacccgccgtgcaaccgtttgatgcagggctggcgctggacggtctagatttcttccctacagcggttggagggtattaccgcacatttccaactgccataaccatcattactaggctatttaaggccttcacctccttacttcttccacatactcaagcaaagggcttctcatacattctctcaagttcagttagtctctacaatatagtggaatagaaatagaatagagtcttcagtcctcggagttttcggaagaattcgggtatggctctagtagcttttccttcttttgtaagacatgtaatatttatagaattttcttttcaatatatttacgatactttgcttcattctaatcatttgggtaccgacttttcgatatattattcgagatatacttgtctagctagcttactcaggagatgcaattatgtgggtataatgttcatttatatgtttgcttatttcatgaggatgatagtagagtagtatttggtagcataagcgaggtgcttaggctattgaatattattatttggggttatatgctgcagaacagtagaggtgggccgctgatggtgatagctcagtatgggtattcctccatgttagtatataatcctaagttactttcctgtggagggtactcctccatattttgccccatttggatggcaatgaagggttgtcgtaaggaactcggcaaccaggggtggtctctcgaaacgccaggagggcatcgtaaggggggtattggctatataactatatagtagataatattgactaaagttgtatgtatgtatattagaagtataggaaatgattattttcttattcttttccactcagcctagaatcagtatgtatgagaatatcgagtgcttctgctttgtgtcactctacccttgaaatgaattaacccctgcttagattttgattatcacaagtaacatataaatattagcttggttctctctattataatcttcccatgggattaaacaaatacgatacccttggaatacttttaggtaaaatgctacaatggtatatccgtgcgcttgcggatatggtctgtaaccataatataccatgaatatttctgtgctattgctaggaattatatttctagtaatgtcgttaagaaatacaaccacagtccaacttcgaattcagttagattcaacaccaaatccgctttgatcttctttcttcttctccgaatttgctgccaaattccgttgttaacacatacaagttagagttagccgatcgtaacagaggtttcactatttatctaatctcgtggattttatgacatcggacctctagccgatgtatgctataaccttcggatcagtgcttattctatcatatcattattagccgattggtttctactagattatattgttgttttgttacattatcatcagctgattgtctttatatcatttatttactcaagtatcagactctgcattggacatacaaccgattgcttaaaaccctatcggcatcgacatacagccgattgcttaaaaccctatcggcaccggctaatataggcatcggctggaattactccatcggcttgatcagctcattgatctactatttgcatatcttatcagttgcaggatcaaactgactggcacgcccacatctcatcaacttttggacctgcactggagctaagcagatctcctaggctgttgtgttcgtcgacttagttcgtgccaatacatttccggcaccatcaaccgagcgtggatttttcatcaacaccaccccaccgtcggcgcgctctctccctaccaccacaccaccggtgcacctctctccctaccaccccaccgtcggcgccacttttcctcctcatctccgccgggctatccctccaccttccccgtcggggtgtcggcggaaatcgagcgacgagctcggcaccgcgtgcggggagaggcgaccgaagtggcggcgcccgggcggagaggtggtcgaagcggcggtgaccccgggcggagaggcgccggatcccccctctctcctgtgggatgagctcggggatgacgcagcggcttgctggaactccctctctcctgcgggatgaactcgacgacaatgcgggcctactcgcttgtaacgtcccgcctctcccaggccgggaccacttacatctggcagcttttcttggatatagactgccctcacagacgaacacaagtcttttctgcacactttgtcctcactcatgtgcacaggggaagaatttcctggtcagtcacccatcccgaaattgctccaggccaagaaaaagaagttgcaacttgttggtatgagtattctattaatcctattaaaccctgggccaggatgtcacatcgctcactcgtacacacgggacggcaaggacaagcgcaggaacgacgaaacgaggtaacgacctccacaacgtgcgcaagtgctcgctcctcacgccgcttgccctggatttggccgaggaacacgtgaccaaagttggacgcgcggacttcaggtagatgcggcataagctaatgtggcgtggaatattcgttcgggaacgacgaagccgaatgtcaactagactgtcacacccggagtttctcctttttcgtagtttctgattcaccaataaatcgtctatagaaattactttggttaaccaggagaaaacccaaattaacaatgtatttaataattggaaatgtcagggagaatttttttcgaattctctttgctctaaaatcattaataggattttagagcaaagaatgttgttaatttaaattgtaaagatttgacttaataataatctttctctctcacctttggtcatgaatagtgcccaattcactccctcttcgtctgcggtttcgttttgcatgatgagtcgggtccgtttctgtccgcgggtccgtttccgttcttttccaaaaacggcaccgcatttcttttccaatttgggaaagtccctatcctaatccttttcctatttttgtcctcccactccctatcggcagctgctccccctctccccctgccgcgcgccgccctcccctccccgagtccgaatcggcatcctctcccctctcctttgccgactcccctccggccccatctcttttagtttttcccctctcctataagttagaacccctatttttcctattcgattttggtttagccctagccgccggccgcccaccctagcgccaccgcccgccgctgtgccgccgcctcccgtcgtggccgtcatcaccctagcgttgccggtaatccgttttccctctccgtgccatggctatcgccattatctatccagttctaatttatctttgttctaagttttgatctaacatcgccgtcatctctgcgtgttgccgccggaccgtcgtcaccatcatcaccctagcattgccggtaatccgttttccctctctgtgtcatggctatcaccattatctatccggttctaatttttctccgtcctaggttttgatctaacgttgcagtcgtctccgcgtgttgctgccggaccatcgtcgccgtctcctcctcgccgatcatctcggtttggtgaggaatctatccgtaatctcctgttttaggtgttaattcttttagtatcgttgttgaaactctagttttttagccccgcgcaaaaccctagccgccgccgccaccgctgctctcgcgtcgtcgtggtggtttgccgctgtgccgtagcttggtagccgagttgcaaagcgtaggtgcatccctaaattcctaccggcctatcgtttgtcgtaccgagtctttgccgtaaatcgtgtctagttttctgttgtcgttctgagccatcggttccgttcgccggttcggttgaccgtttggatggtcccatgtcatgaagtattggctcgttgagtcattaattcatgaggctcgctgttgatgtgaaaacacgaggcctaggatatatgcttaactccatcgcaggtccaaaatcttgccttttaggttcgtgggcgtgccagttgatttgatcctgcaatcaacaagaaataaagacaaagaaactgtagttaaatccaaaaatgatagccgatcagccagccgccgatgacatatcatttatctccgagccgatgtcatatgtgaatcgatcgatagttataaataagtaaattaaaactaaatctactcgatcggctgtagatgttaacagtgcataatttttatgtcgatatatacttaaatcaagtgattgggatagattggtcgccatgccgagacagtataaatcacttagatcgaaatatatattaacaatgagattatagatgttcacagcataatcgatcagatagatctagcgcgtatcggctaatactccgataccactctatattaagatattaaagcaagtaaaatatatcaaacaaaaagcttaacatatctaaaaagcaataagatctcaatataaagggcagatttagcatatcaattaagcacatgaaatataaggctaaatcaggtaagatcggctgaaaccccgatactactctaatcgacaaccaagaagcaggctagagattatagttctaagcacgacttatgaggtcaaacctaactgatgcagccataagtatgaaaagaaacacaatatctagacaatcaagccattggaagtttcgtagagtggtggatattctatataatctaaatcaacatcggtaattaacctggtcggctgcctcctagtaacagatgttagcctattagaggttaggtaacgatattgccggagattatatagaatatatgataactcgacaacttacatgcacaagattagagtgtcataatgatgcaagcactaatcccgagaacacaagccgccataacaagtcgtacctctagttgaagatcgaaaccgatgcagctcaacccgaaagcaagaactcatcgaaacaaaacgaaagtaaaaggtggcgatgcgccgagattgtatttgaacgtgtgttaattgattacatggggctcgaggtctatttatacccgagattacaaaatatgtccttgtcggacacaactctcatctctaacaaactctaagataccataagtctttgcggcagacttttgcccacacttatctctaaggaaattacataaaatatcctaattaatagatacaattgccttcttaggactcaatccacgtgtggcaatccatatgaagcacattaattcaacccgatgacgtacaccgtgtcatattgttagaatcggctgtatcggctaaccctgttcgactcgaactctgccaatcctgtctgtagccgatttggatcgtagccgattcttgctctgtttccgcaacgatcttcgtcttggattctgctttgatctaatcttcttttccaacactgatattaccaaatttggtcgttaacacatgccccccaagtccgaaatatttggtaatgtttcggatttgccatatgtcgactccgagtgaaaatcgcacttgccgttttccgaccgttactccagcgctttaaatgctaaccgtcaccttcgagaaacttcacgctgtttcctccgttttcactgctgaagcaaacctagttttctctctctccggcgatcccctcggtgcgctcggcgatttcaaggtgatctcctccccggccaagcttccgctcacgatgatgtcgacctctgccggcttgtccgctgcgccatcaaccagcccgtctgttgcgccgtcatccaagtacgcagaggtatgtatccatcggctagatccctttttcccgtgcagtagatcgattttcttcatctcatcttattttcttcttctctatctcttttgcacttgtagcatcttaccaatcttgttgcggttcccagtttgtcgcacgaccatcagtactttctcggcccaattggcaaccttgacccctctgaatttatcattgttgagaccaacagaatcccctttagactggccaacccaaacttaagtcactggaaaaacacctttaaatcatggccatctattgagaaaagtacccccgagaaaagctggcctttgtggttcgaatgggtatcggctagcaaacaagcccactgggatgaaatcggaatcagccaagcgctagcccttactacagcaaatttggctaaggatgagcctctgatggccgctgcaatctacttttggtccaacacccttaatgccttcttgttcaaccaagggccgatgacccctactttgttagatatcatcatgattactggtctggatgtgacctcatcggctaatcccatgagcttgaataccaaaagcacctttgaattcaagaccaaaagcattagggttggtcggggtatattgtagcatacatgggcaaagggccagtcacctctcgagagcatgtagcttttctactgatgtggttggagaaatttctttactgtggatcaagttgtggccctgcaactgtggagattatggataccccatacccacactgcatggttatccgactggttataggggataacttatatctatggaatatataacggatcatgacttgggtattacgtttccttgtatattatgtaacggcctaaagtcctggtttgataagattgtaaagtagatttaggaaatcaataccgtattggttaaggtttctatcttgtaatcctgccccccgtcctatataaggtgggcaggaggccctctagggggcatatgagcacatatgatcgtcagatctaatacacccggcggattcaaatccccaaacaggagtagggtattacctcacattgagagggcctgaacctgtctaaatcctttgtttccgcatccatccacttttaggtctcgtgcgctacccccttttattattgccgaattcatgttttgacagttggcgcgccaggtaggggttgcgtcgaattagccgtcgaaaagtgtgatggattcaactccataagaaacgccaagatcaatctcaccggtttcgacgactcaaatcttctatcgggtttgtcgttccaaataaacttttattagattaattttcaatcattatttgatcttcttacatttattggtttttttcatgccaactgagatcgtgacgaagcagtcggcgacctcgtgaatccaaccgacgtaaatttgatcacgctttgtgctgatctatacgccggcacatggcccggtgacagtcttcatgcatggagcatcgccggttataaggaacacacgtgcttatgttgattcaatcaacaagcacgaccaacttaatcatgccatatatccaatatatatgagtctatatgtttctttgtttaataacagattaatctactaatcgctttcttttgcatgttcgtatatgccgatcaagagcaaccatctgtccatgacagcctttgactgctgccacacgcgcgtcaactagcgattgttctggccgggatccatgtccgcgtgcacccacctgtcatggcgccgtcaatttaatcctccatgccagcatgcaaaagcatgcatctttcgatacatgtacatctgtactttttattactactaatctcagtttgatgtgtggtttattttttgcatgcaccctggtttcccgagtccgattccctatgacttggtttgatctggctggactcggacctgtgacttgtacgtgctcatgacatgcaggagcatgaatcggtttaatgatctgcttgtgtggacgcatctaatgttcatgctacatgagatcaatcggccaaccaaataatatatgcatgcttcatatatgcattgatatatgcagacatacatccacaagattaattttcttgatgctaattagagatttcttttgtctctttacatgtatcgccggccgtctccatcgccgctaactggtgccctcgcctacgcgattggatggtcacaccaccattgttgggcatctacgtcttcaccgaccggccgcctcgtccgccgccgactggtgtctccgcctacacggctggcctattatgccgctgttgttgggcgtctatgacttcaccgtcggcctgcctccgtcgccgccgactggtgtctccgcctgtacggctggcctattatgccaccgctgttaggcgtctacgacttcaccgccggcctgcctccgtcgccgccgactggtgtcctcgcctatacggttggttggtcacaccaccgttcatgggcatccacgtcttcaccgactggcttgccttagccaccgccgactggtgtctctgcctacacggctggcctattatgccgccgttggagggcatcttcgctttcaccgtcgaccgccttcgttgccgctgactggtgtcttcattgttattgatggacgactttgttcccacattggccacctctgccatcaccaaggggaatattacaaagttgagtcatcatttatttcattctttatatgatattttccttttcctctgcctcactatatcaactggttcgccgttgactagtgagtcgggggctacagatgttatatcatattttttaaacaatttttataatatttatcttgattgcttgcgatataatctgagtacaaaagtgcctatcgagttatggagttctatcttcctatgctttttgtttggtttgccgatggatagttgcctttgggccgattcctagcacccgggggctcgttggatggaccgagtaacgcaaggtgctaagtattattcggaataaatcaaaagcatagagataagataaatttattgtttgctcttaacaattgcaaaagtacccgagtagtaaattctgatccgtgaaactttgttccattaatgacgaactcatatcactcatatgcatgtttgggaagtgcctaggccgacacccgatgcttgggggctatgactagtcgggcagagtgtttaaacgtaatgagtcatctgctcggggaaatcaaaattgacaagaggagaaaaacatatttataaacattttaaaatgcttgaattttcctctagtattgtatttacatcagatactactcatcctatatgtttgttctgtaggatccagatccagatatgcacaatagggattcatggctttaagcttatttcctacgcttcaggaataggtcagtcagaacatcaccaccggcttgccttcgccgccgccgactggtgtcttcgcctgcacgattggcctattatgttgccgttgttgggcgtctacgtcttcactgccggcttgccttcgctgccgccgactggtgtctccgcctacacggctggcctattatgccgccgtttgttaggcgtctacgtcttcaccgaacggcttgccttcgccaccgccaactggtgtctccgcttgcatggctggcctattatcccgccgtttgttgggcgtctacgtctttaccgcgggcttgccatcaccgccgccgactggtgtctctgcctgcacggctggcctattatgccgccgttgttgggtgtctacgtcttcaccgaccggccgcctcgtccgccactgactggtgtttttgtctatacggttggttggtcacaccaccgttgttgggcatctacgacttcaccgctggctcgccttcgccaccgccgactggtgtctccgcctgcacggctggtttattatgtcgccgttgttggacgtctacatcttcatcgaccggccgcctcgtatgacgccaactggtgctatcgtcttcacggctggccacgccgccgccaccacaaataggcgtcatcaccttcaacacaagctgtctacgtctgttgccgactggtttcttcacttccatggctgcatgattctgccagtgttgattggccttatagtcttcaccgccggtcatctcgtctgctgctgactagtgccctcgcctctacggctggtttataccactaccactactgatggatatcatcgtcttcattgctggccaccttgtctgatgccgactggcttgttcgcctccacggctgcgcgtcttcgtcatcattgactggcgtcatcatgatcgctggtttgccttcgccgccgcccatggtttcttcactttcatggctgacttattttcgtcgttcaaggacgtcttcattttcgtcatcattctacttcttccgtcgccgactggttatgccgccgccgactggtgtttttatcttcacaactacgcatcttcgctaccggtttgcttctgttgccgccgactcgtgttcacttcatcacgactattcaactttgtcaccatggtggagcgacttcatctttattatcttcggcaccggcagactctattgtctctactttgtaagctttgctacttcaccaactacgacgtcttcaagagcctcgacatcttggtatgcgtcatcaaatatgatgccgtgttattttactacaacaagtggtgttccaatattcaagatttctactcggacatgttcaacacgtatcttcactcaagtgatggctactcgatgacaagaagctacaattcttgactctatgttcagttgtttctcaactaaccaaagagtctagggctacacaaataccagactcaaaattcgacaagctttatgtcaagacaattccccttgggcaaaattctccttagctatcagtaccaaattttgaacaatgcatcagctaagatagccgtcggttcgatggttggagcaggtgggccatggtggtttctacagacttggctgaacttagtagccatgaaagctgtcaatcggccatcagtgatagaagtagagttcccaagactagagccgattacagatgatgatggagaagagcgaacccattgcaggtgcatgtcttatggagaatatgcatccacaccagccgattctggagcaaagctatcggctgaactgctcaaagactggttctgcagtttctatgaaggcttccagagagatgctcgggtttggttcccatatgaggactcaatgaatttcgatctcccagcagatttcagatttgaggatatcaactccgaaaaatttgataagtctagagaagtcttttcagctgctattagtccatgcatccttccagttggcatctatcaaggaagaaacattcaagtttcttatgaattttatcacccaatgagttcagctaggcagttcggaatgggacaattgccgatcggcttgtactttgccgataagatccagtgcaggggtgatatatcttcagccttgatgatggatcggctgctgaatatcccaggacctcaacttggcagtattgagaatatagagtttgcaaggttcaggagcaaagcctttgacaaatggtggggtgaatggaaattgcatctgttccatcaatcggcttccatgtatatgacatacctcttcccagatgccatccctcaagtaagtcttttcattatcaattttgtaaacataactgttagccgattgataccttatctaatttctcttctttcttgcagacaacagaatcctcccctcctcgcaaaagcaacagtggcaaggacatcgagtatgctcctggccttattccaaatggaggtggactatctccccctgtcatcggctaccatgcccccaggacctcaagtctgctctaagggcaactgagagaaccagtcgatgccggcagaaaaaggaaaaccaagacatcggctattgatccatcggttctggctccaaagaagaaggccaaaaagaagaaatccaagctagccgatgacttgcctgccgtagatccatccattgaacaagctttggatgaagaagaacttagagaggatgttgatcaagctgcagccgaaatgagtgacccagaagataaaacaccatcggcttctccaaaacaaactcctccaactcctactgctccagctcattttaggagggtaaattacttgtttcaatcatccctttttagaataatcaaatttgaacagccaattgcttactagtcttgtacttgcagaagaagaaaactgccgtgaagaagaaatcggcaacaatagcatcaaagccagctccaccggtaaggttctttgtatctttaagtacaatcaaagccaacattatttaacacttgtctttttcagcttcctcctccttcgcctgctgtgcagccgatgtctagcgaatggactctatcggctacaggcagccacaacgttgaaggagaagaacaaccaactgttctgttttctttcgcaggtcttaaccgatctgttttcttttgacatcaaggattaccttgatgaagaagaagaagacaccactagcaaagcctcagctactctgtccgatgatgtgaagagaaatcttgaagacatatctcatcagctagggtcatcattaaacagcttggtagctgattgtgcttcaatccgggcaagatttaaggaaattcaacctctaatcccagatgatctagccaacgttattactctagctgcttatcttgagcaacaccaattcaagctgaagaaaggtaagcaaagattagtcgatcgccgagagcgtaaggatatcgaaactactatccaagccaatcgacagcttgtacatgaagtgaaatccaagcttgatcagctatctgaaggcccgatcaagtccaatattgatcggctcgaggctcggaagattgagctcttggcactacttcaagaatgtaacgctgagctgtctttggagcaacaaaaattggctaacctaccaaaggctattgaagagcagaagttgaggctgaaatcggctatcaggaatattgccgatatgactaagtccctcaaagtcatccctggaaccgatgctcaagacgcccaagccatagaagaagtaaagcaaattaggcaaagggctatatcggctattcagtaatatttgtctcaatgactatccatgtaatagggcttagaaaattcttgtaattggctaagatattttggtacttcaccaactaagtaactgctttgataatcctttatgccgattaacataacttctgaatttgcctcaaaaatttcaaaaatatccaactttgtatatatatatgccccccctaattttgtaatgacgaagacattgataaaattataaattagtctgtgggcgatataaccatatcggccatcatacaccggcaaaacacagccgattatgaagataaaacagctaagggcgatattactatatcggccatctcaaggcgatgcaaacacatcggctctacatgcatcggcaaattcagccgatcatgaattaacccatacacttgggtaatatttcttcaagtatttgccattaagggcccgtccataaacttccccatcaagtctttgcaacatataagctcccttggacacaacattgtggatttgaaacagtccttcccaatttggcgaccacttgccgaatttattatcacaagttcctatcggcaagatcaacttccaaacaagctctccttctgaaaaatatttaggcaccaccttcttgttataatgtcgagcaaccctctctttatcctaagtaactttttcaagagcccgcaatcttgattgaaccaggtcctcccgttcatcgaccatgagattgtaatactcatcgactgtcaatccatcctgtaaatctgttcttcttgagccgattctcacttcccatggtaaaacagcttcatgcccataaacaagcttatagggagaaacttgaatcgatccatgacaagccatccgataagaccataatgcttcagccaatcgagtatgccattgccgaggataatcagaaatctttcttttaatcaacttgatcaaacttttgttagatgcttcggcttgcccattggcttgtgcataatatggagaagaaaacttgatacccatgctatcggcaaaccgaacaaactcatcagacacaaatatcgaaccttgatcagttgtaatcgtctgaggaatgccaaatcggtagatgatatgttccttaacaaactgaatagctcccctgaatcaactttcttcaatggaatagcctctacccacttggtgaaataatcggtcgcaacgagtatgaacttatgccccttgcttgaaggtggattgatttggccgatcatatccataccccatcctctaaatggccatggcttaataataggattcatagctgatgctggtgccctctgaattgccctaaacttttgacaatcttgacaccttttataatatctgaaataatcttccaacattgttggccaaaaataccccacacgccgaagtaaccacttcatcttgtgagctgattgatgagttccacagattccttcatgtacttcgccgattgcagccttggcttgatcggcactcaaacacttgagtaacaccccatcaatcatccggtaatacaactcatcatccaacagggtgtatttcaaagctttatttcgtaattttcttgaagccaattgagacggatttcgcaaatactgaaatacatcatatctccaatcatcggctgtaatcgtagcaacctctatctcaacatctctcaacatcggcttatatcccgatgccccttgagccaaatcattagcttcaatgttttgctctcttgacacatgtttcaaagttaccagccgaaatccactcattaattctcggcacttctcattgtaaaccatcaatgtatcattcttggattcatattctcctgccaattgactgattaccaataaggaatcacccatgatttcgatagcgtcggcttcaacttccttaagcaattgcaatcctttgagaacagcttcatactcagcctgattgttagtcgcataaggtttaatagtgcaggcaaactcaaaacttgcccctcgaggagaaattatgaccaagccaataccacaaccatgagtgcataccaatccatcaaagaataaagtccatggcacaatttctaccgagtcgattgagtcatctcgatgatccacaataaaatcggctatagcttgtcccttaatcgcctttggtgactcatatcgaagatcaaattctgtcaaagcaaatatccacttgccaacccttcctttgaaaatcagagccgatagcatgtatttcaccacatcggccttacatatcacaatgcattcatttgacaatagatagtgccttaacttggtacaagagaaatataaacacaagcacaacttttccacaggagaatacctcgtttctgcatccaagagccgtcgacttaaataaaaaacaactctctctttcccttcaaactcctgaatcaaaactgaaccaatctacttatcaccagccaatagatataatctgaaaggcacccccttttgtggaggaataagaactggtggagaactaagatattccttgatactatccaaagctttctgttgttcgggctgcaggaa

SEQ ID NO: 43908 - DNA, 1406 bp, Oryza sativa
tcatattagtcttgatgagatcatctggatttctgcccaacttcctgagtgtggcatatggcatcaaattcacagcagctcctccatcgaccatcattttagaaattggcttcccattgacaaacccattgatatacaatggcttgagatgccaattttctatcccctctggcttctcaaagaccgcctgctctggtgacaaaactaacttagctgaagcttcctcaacatcatcaacatcggcttgcctagcttcaaattcggccggtagcataaaaaccatatttactgatgccgatgcaagagccttgcctttgagcaccctttttgccttttcggcttcgacctcatcggctgatacaactgtacttttaacacgccattcttgcttagtctttgttttcctcagccgatgattaatctcttgatgcaccctctgaaattgctccctgttcctcaacctttgaacccttctcttttgattcttggtgaaaatgcctgtaggtacaccactgtgtattcctattttcatctttatcttgataatgatcttgatttaccaggcccagcctttgatgaacaggtactctcttctgatttggccgattacctctattataggatcggcttgaactccctgtatcttcactgcatccagggcaattctcaatcgatggcaacctcataccttcattccagcaaaatctgaaaaactcacaatcccaatgagggtcaaaaccatcatctttttcatgatatttctcatgctgtttatcatactttctttggtatttgttgataatcctagtcgaattcatgtgaaaatttctattcatccccccatcggctgtccttctagatgtatgcaccttattaatagggaaaggattaccatcaaccttcatctgcttctttgaatcatcaaatttgatctttcccccttcaatggctgcctggatttgctgcctaaaaaccttgcaattattagttgaataggaactagaattatgccacttgcaataccttcttttgcccagctcttcggctgatgggatcacatgaccagccggaagctgaatttgtttttctcgaagcaataggtcgaaaatcttgtcatccttggtgatgtcgaagtcaaatttttcctcttttccagaacttttcacccattggcatggtattactttcttgctcttgacccattcggctgccgccacctcggaatcatcgtcttcatcatcagaaccatacatgtaaggatatacatgattaatctttttgaagttcttcttggccttagcaaacctctgctcatgaagagtcaccttttgtgtgagatgtgataaactctcaaaatcttgagccgaaaacttttctttgatcggtgctatcaacccctgaaaagc

SEQ ID NO: 43909 - DNA, 1527 bp, Oryza sativa
ttcaccatgttggttaaggtattaactaacactccagattggttaatcaaggcatgttgcacggcatagtcgatcctatcctgaaaattgttaaactgcaacggctcttggttgccatctgcaccaaaatcttcaacagtgccatcttgaggaacatcacctttgtcaccttgagatgaacccgaaccagcttcatcggctgcaactaccttcagcttgtacttctggacgatggttcctctgcgggtttcttggaaagaattcatgaactgatcctttacattgctcatcatctgctcgagctcatccctttgctcagtcgtcaatttatccaatgtgattggaacaataatactaggggccagttcggctgaacaagaaataaagacaaagaaacagtagttaaatccataatgatagccgattagccagccgccgatgacatatcatttatcttcgagccgatgtcatatgtgaatcgatcggcagttataaataagtaattaaaactaaatctactcgatcgggtatagacgttaacaatgcataatttttatgtcgatatatacttaaatcaagtgattgggatagatcggtcgccatgccgagacagtataaatcacttagatcgaaatatatattaacaatgagattatagatgttcacagcataaccgattagatagatctagcgcgtatcggctaatacaccgataccactctatattaagatattaaagcgagtaaaatatatcaaacaaaaagcttaacatatctaaaaaaagcaataagatctcaatataaagggcagatttagcatatcaattaagcacatgaaatataaggctaaatcaggtaagatcggctaaaaccccgatactactctaatcgacaaccaagaagcaggctagagattatagttctaagcacgacttatgaggtcaaacctaactgatgcagccataagtatgaaaagaaacacaatatctagacaatcaagccattggaagtttcgtagagtggtggatattctatataatctagatcaacatcggtaattaacctgatcggctgcctcccagtaacagatgttagcctattagaggttaggtaacaatgttgccggagattatatagaatatatgataactcgacaacttacatgcacaggattagagtgtcataatgatgcaagcactaatcccaagaacgcaagccgccataacaagtcgtacctctagttgaagatcgaaaccgatgcagctcaactcgaaagcaagaactcgtcgaaacaaaacgaaagtaaaaggtggcgatgcgccgagattgtatttgaacgtgtgttaattgattacatagggctcggggtctatttatacccgagattacaaaatatgtccttgtcggacacgactctcatctctaacaaactctaagataccataagtctttgcggcagacttttgcccacacttatctctaaggaaattacataaaatatcctaattaatagatacaattgccttct

SEQ ID NO: 43910 - DNA, 7437 bp, Oryza sativa
ttagcattcaaagaaagagctgataacacatttcaagacaatacttaacaggtcgaacctaaccgatgccgtgttaagcgtgaaaagaaacataagatctaagcaaatagatgaaaactcattcaagatggtagatacaccgcataatctaggctgacatcgacatctaaacctatcggccgttttcgatgatagaggctggccgatggggttagatgacgagatcaatctagattatgcggtatatatgataattcagcgattcacgtagacaggattagagtgtcatagcgatgtaagcactaatcccaacaacgcaaactgtcataacaagctttaccttttcgtcgaagatcgaacctgatgtagcccaacttgaaagcaaaaactcgtcgaaacaataaaaatagaaaagggtggtgatgcaccaaagtattattgaactgtcgtcccttgattacatggtgtcaggtcatattaatacccgaagtacataatgtgtccttgccggacacgcctcttgtctctaatataatttaaaatacgaatgagtcccctaggtgggctcttaccaaacatatctctaaggaaactgaaaaaatatcctaattaatagatacaattgcccctttttaggactccaatccttgtgtggcaatggctatgaagtgctttggctaaccctgatgaccaacgtgggaccatcattttcgagactggttgcatcggcttgattccgcggatttggcgctagccaatatgcgcagccaatattgcctgtagccgatcatgtggcagctgatgctgttcttagccaatgcgtattctaccttctcaaatggaatctcgccaaatcggctttgactctagctttgaatccggctcatggcattaccaaatttggtcgttaacacatgccccccaactattggaatagccatgcccgcagttattgggcggtcaaccagctcattgtgattagtcccacaataataatttgacttatagaactggagttgtttaggtggttttggttgggcgtgttgcaccgtggatttagcgttagatagtgatgatttaatactgcttaattatatattgtttttactatttcaaaatatgatttataaatgctgcttttaccgcaaatatccaatgctatttttatggtggttggtactcagtcttgctttatttcctccccacccccttcgaagcagagattggttcgggtggtgagttctttgaggaccgagcttgttctgggcgtcgaggattgcctgtgttttatggagtgttggtaattcttacgatcacagataaaatccgcaagcacacggatataccgatgtagcacttcccctacggagtattccaaagggtatcaaatcaagggaacatgtgtggtcagttcttcttccggttcatccaaggacaccaagcaaaggataggctaggatagagaggattcactggtaagaaacagtgtctagggaaagcttaagtttaatcctaaagcaatacttcaggcactggtaactcactgttcccagatgtcgctctattacgtacccgaacagggaggacttaagtgatctcgagggctgtcaccacctctacacctacctcaaacgtacaatgggatacgcagcaattactggataacaattacctaaacaccacgtctaagcaattaatatctacttcagtgtttataactcaccaaagcaatcactatatttcagttgattatagtgaacaataatcccgtatgctatttaggttaattcttataagataaatctaagttactcaagaagaatattatattgaaatcagagtaatgaacagaatacaagaaatgagagaagattagtgacaactccagaattcttccgacttcttctactctactctcttcctattctagtatacaatatagtacaatagagcctcttataattcagctcaagcttggaagtgtgtgtgagagtgaaggagtgaagctccttatatagaggtaggtatgatggttacacaatgcgaattgtcggaaatgccccgcaaccatcatcaggagatgatcaggactgtccacgccaaaccccagcctgaatggctgagattttggttcggccgaaccaaggggttcgggcaaacctgtgctgggcccacctggcctggccttcggcccatctcctccccttgtcctcctttatccatttctcggagttttgggctaagtctttgatattttgatgaagttcacaacccatccttgtatagataaattttcccctcactttagtctagatttccctccaacttcggggtttgacacctgcatacaaatatacaccaacacttgtggaatatgtgacattaagcacctatcactatgttggatgttttattgtctgaactttatgcagatgttggtggtatagaatcggtgtttaacagccgccaacatggaggaagcttcacgttggtcgtgaagattaagtctagtttatttgtttttccgctgcgtatgttagttttattttgttatttttgtaagacgtggatctgtctatcaaattgttgtttgtgtactctggctggtcctggacggagatttaatacacattctacttaaaattcgggttaacgaatttctgggcgtgacaagttggtattagagccggccttgatcgtaggataagccaagtggaaacactaagagccctatgattttctcatctgctctttccttttgtgaggtcgagtggtccagtgagtctagtaaggatagagtgagtcagtgagtagtcggagtttgcataaaagtgtaggtgaagtgtggtcagtcgtctgcatggttcatgaaatagagatcagtaagtgtcttttctttaaaaaatattacaaatataatgttttaatgttattcaccggaatgaaaaagaccaaaaagcaacaaaacataatttttagatatattggagtgtattgggtgcgtctgtgtcgaaaaatcagtttgtgacacgcgcggcgaacttttgacaattagtgccaatattggcttatattaccacacgtgggtgcaatttttctcaccggaatgaaaaagttcaaaaaccaccaaaacatgatttttggacacattggagtatattggatacgtctgtgtcgaaaaatcactctgtgactcatgcggtgaacttttgtcaattaatgccaggcctatattggcacacgtgggtgcgatgtttttcaccagaatgaaaaagattaaaaagcatcaaaacatgatttttcgacatactgtagagtattgggtgcgtccatctcgaaaagtcactgcgtgactcgcgtggcgaacatttatcaattaatgccaatattggcatgtattgccacacatgggtgcgttgtttttcataggaatgaaaaagttcaaaaagcaccaaaacataatttttgaacatattggagtgtattggatgagtccgtgtcgaaaaatcactccgtgactcacgcggcaaagttttgtcaattaattccaatattagtctatattggcacacgtgggtgcgatgtttttcactagaatgaaaaagttcaaaaagcaccaaaaaatgatttttggacataatggagtgtattgggtgcgtccgtgtcgaaaaatcactctgatactcgtgcagcgaacttttgtcaattaatgccaatattggcctatattagcacacgtgggtgcgatttatttcaccggaatgaaaagttcggaaagcaccaaaacatggtttttggacatactgtagattattgggtgcgtccatgtcgaaaaattactacgtaactcgcgcggtgacaatattggcctatattggtacacgtgtgtgcgagaaaaacttcaaaaatcaccaaaacatgatttttggacatattggagtatgttgggtgagtctgtgtcgaaaaatcactccgtgattcgcgcggcttatttttctcaattaatgcaaatattggcacacgtgggtgcgatgtttttcaccgaaatgaaaaagttcaaaaatcaccaaaacttgatttttggacatattggagtatgttgggtgaatccgtgtcgaaaactcacaccgtgactcgcgcggtgaacttttgtcaattaatgccaatattggcctatattggcacacgtgggtgcgatgtttttcacttgaatgaaaaagttcaaaatgcaccaaaacataatttttgaacatattggagtgtattgggtgcgtccgtgtcgaaaaatcactccgtgcctcgcgcggtgaacttttgtcatttaatgccaatattggcctatattggcacaagtgggtgcgatatttttcaccggaatgaaaaagttgaaaaagcacccaaaaaaatgatttttggacaaactggagtgtattcggtgcatccgtgtcgaaaaatcactccgtgactcgcgcatcgaacttttgtcaattaatgccaatattggcctatattagcacacgtgggtgcgatgtatttcaccggaatgaaaaagtttagaaagcaccgaaacatgtttttggacatactgtagagaattggatgagtccgtgtcgaaaaaacactccgtaactcgcgcagccagcttttgtcatttaatgccaaagttggcatatattgccacacgtgggtgtgatgtttttcactagaatgaaagagtccaaaaagcaccgaaacatgatttttggacatatagaagtgtattgggtgcgtccgtgtcgaaaaatcactccgtgactcgcgcagccagcttttgtcaattaatgccaaagttggcttatattggcccacgtgggtgcgatgtttttcaccggaatgaaaaatttcaaaaagcaccaaaacatgatttttggacatactggagtgtattgggtgcgtccgtgtcaaaaaataactccgtgacttgcgtagcaaacttttgtcaattaattccaatattggcctatgttggcgcacgtaggtgcgatgtttttcaccggaatgaaaaacctcaaaaatcaccaaaacatgatttttggacatattggagtctgttgggtgagtctgtgtcgaaaaatcactccgtgactggcgcagcgaacttttatcaattaatgccaatattggcccatattggcacacgtgggtgcgatgtttttcaccggaatgaaaagcttcagaaagcaccgaaacatggttttggacatactgtagagtattggatccgtccgtgtcaaaaaatcactccgtgactttcgcggtgaatttttgtcaattaatgcaaatattggcctatattggcatacgtgggtgcgatgtttttcacgagaataaaaaacatcaaaaagcaccaaaacatgattttaggacctattggagtgtgttgggtgcatctgtgtcgaaaaatcaccccgtgtctcgcgcggcgagcttttgtccattgatgccaaagttggccaatattggcccacgtgggtgcaatgtttttcaccagaatgaaagagttcaaaagcaccaaaacatgattttttgatatattggagtgtattgggtgcgtccatatggaaaattcactccgtgactcgcgcggcgagcttttgtcaatcaatgccaaagttggcctatattggagtggatatgtttttcaccggaatgaaaaagttcaaaaagcaccaaaacatgatttttggatatattggagtggatatggtgcgtctgtgttgaaaaatcactccgtaactcgcgcgatgaacttttgtaaattaatgcgaatattggcctatattgtcacacgtgggtgcgatgtttttcaccggaaccaaaaagctcagaatgcaccaaaacatggtttttgaacatactgtagagtattgggagcgtccgtattcaaaaatcactccgtgactcgcacggggaacctttgtcaattaatgctaatattggcccatattggcacacgtgggtgcgatgtttttcaccggaatgaaaaacttcaaaaagcaccaaaacatgatttttggacatattatagtatcttgggagagaccatgtcgaaaaattacttcgtgacttgcgtggggaattttgtcaattaatgccaatattgtcctgtattggcacacgtgggtgcgatgtctttcaccggaatgaaaaagttaagaaagcaccaaaacatgttttttggacattctgtagagtattgggtgagtccgtgtcaaaaaatcactccgtgaatcacgcagcgaacttttgtcaattaatgccaatattggcccatattggcacacgtgggtgcgatgtttttcaccggaatgaaaaacttcagaaggcaccaaaacatggtttttggacatactatagagtattgtatgcatccgtgttgaaaaatcactctgtgactttcgcggtgaatttttgtcaattaatgccaatattggcctatattggcacacgtgggtgcgatgtttttcaccggaataaaaaacatcaaaaagcaccaaaacatgattctaggacttattggagtgtattgggtgcatccatgtcgaaaattcaccccgtgtctcacgcggcgagcttttatccattgatgccaatgttggccaatattggcccacgtgggtgcgatgttttttacccgaatgaaagagttcacaagcatgaaaaaatgatttttggatatattggagtgtattgggtgcgtccgtgtggaaaaaatcactccgtgactcgcgcggggagcttttcttaattaatgccaaagttggcctatattggcacacgtgggtgcgatgttttttaccgaaataaaaaacttcaaaaagcatcaaaacatgatttttgcatattggagtgtattgggtgcgttcgtggcaaaaaataacttcgtgattccgcggcgaagttttgtcaattaatgccaatattggcctatattggcacacgtaggtgcgatgtttttcaccggaatgaaaaacttcagaaagcaccaaaacatgatttttggacttattgaagtatgttgggtgagttcgtgtcaaaaaatcactccgtgactcgcgtgacgaacttttgtcaattaataccaatattggcctatattggcacacgtgggtgcgatgtttttcaccgcaatggaaaagttcagaaagcacacaaacatgtttttggacatactgtagagagttgggtgcgttcgtgtcgaaaaatcattccgtgactcgcgcgacgaacttttgcaaattaatgccaatatagatatatattggcacacgtgggtgtaatgtttttcaccagaatgaaaacttcaaaaagcaccaaaacttgattttttgacatattggagtctgtttggtgagtctgtgtcgaaaaatcactctgtgactcgcgcgcgaagttttg

SEQ ID NO: 43911 - DNA, 36027 bp, Oryza sativa
  unsure (1)..(36027): unsure at all n locations
attgggtgcgttcttggcaaaaaataacttcgtgtttcgcgtggcgaagttttgtcaattaatgccaatattggccaatattgccacaagtgggtgcgatgtttttcaccggaataaaaaagttcaggaagcaccaaaacaagatttttggaaatattggagtgtactgggtgcgtccgtgtctaaaattcactccgtgattcgcgcaacgaacttttgtcaattaatgccaatattggcctatgttggcacacatgagtgcgatgtttttccccataaagaaaaccttcaaaaagcaccaaaacatgatttttggacatattggagtgtattgggtgtgtccgcgtcgaaaaatcatttcgtgactcgcgcggcgaacttttgtcaattaatgccaatattgatatatattggcacacgtgggtgcaatgtttttcaccggaatgaaaaacttcaaaaagcaccaaaacatgatttttggacatattggagtttgttgggtgattccgtgtcgaaaaatcactccgtgactcgcgcggcgaacttttgtcaagtaatgtcaatattggcccgtgttggcacacgtgggtgcgatatttttcaccggaataaaaaacttcaaaaagcaccaaaacatgatttttggacttattggagtatgttgggtgagtccgtgtcggaaaatcactccgtgactcgcgcggcgaacttttgtcaattaatgccaatattggcctatattggcacatgtgggtgcgatgtttttcaccggaaggaaaaagttcaaaaagcatcgaaacatgatttttggacatattggagtgtattgtgtgcgtccgtgtcgaaaaatcactccgtgactcgcgcagccagcttttttcaattaatgccaaagttggcttatattggcccacgtgcgtgctcggagtacgtgcctagcccggatgaaggaagaagcaaactgtgcgatgtttttcataggaatgaaaaagttcaaaaagcactaaaacatgatttttggacatattggagtgtattgtgtgcatccgtgtcgaaaaataactccatgactcgcacgacgaacttttgtctattgatgccaatattggcatatattgcgacacgtgggtgcgatgtttttcaccggaatgaaaaatttcaaaaagctcgaaaacatgatttttggacttattgaactatgttgggtgtgttcatgtcgaaaaatcactccgtgactcgcgcaacgaacttttgtcaaataatgccaatattggcctatattggcacacgtgggtgcgatgtttttcaccggaatgaaaaagttcagaaagcacacaaacatgtttttggacatactatagagaattgggttcgtccgtgtcgaaaaatcactcgtgactcgcgcggtgaagttttgtcaattaatgccaatattggcctatattggcacacgtgggtgtgttgtttttcaccggaatgaaaaagttcaaaaagcaccaaaacatgatttttagacatattggagtgtcgaaacaagatttcggcaataataaaagggggtggctatcaagctagcaaagtggatgggtttggagacaaggaattttatacaggttcaggtcttcttattcaagaagtaataccctactcctgtccggggatgattccaccgagtatgttattgattatatatattggagaaaagaattgcgccccgagaggcacacggaccctccttatataggggaaggagtccgctttacaaaatacagtccatatcctaacggaatatgggattatagataaaatacaatcctaaccgactaagatctcgggtatttccttgacatacaagtaaaaaactaactcgagtcttcataaagatattctatctatatttggtaccatatatccgactaaattataactgtcatgtagatatgggatatccatattctccacagtagtcccgagaccttcgcagttgacaaaatagccttctcgaaacaaaaaacagcaatccgagtgcttcaattcaacttgctccagtttgccgagtgctaaaatcaaagactgcgaagggcgaaaataaaacatggtgcatcgagtagatgcacctaattaggtgtagcgcccgactatgtgattagttgaaaaactaaacacgtagtcaagaaccgagtggttttatcaacactccttgaacatatcaaggataaaaacatgaaagggccaagtgataaacactcaaaagatccaaaaatagacatatttgataggaatccgagtaagaaactcttaaaatgattcaccaaacatgataaaaaatcacgggaattaatgagtctaatagcctaggctgggacccttaccataaccaaaataagcatataacatgctaaaagaatgactattagtaaaccagtcatctcaaatcaacccaaacagcttttgcagcctaataaggcttacaaaaacggtataacacctttctgtcgggcaccttttgtttgcatcgttttaattccaaagaattatcaaaccgcattaaaaagggttttaacagcattggaccacatcattgtgagcacaaattgccaaagcaaaaagtgcctaagtccctaaggatcacaatgggccacgctggaaataaaattgggctgaagtactgtgccggcccaggcctgctagcactcccgataccctaatatcaccgaagtgaaaaacgtctcttcgtcatccccgccgagactctcgccattttccccatttcctgctacagtacaaactgcgccggccaagctagggttcagcaatccgctccaatccatcctcaaacactccacaaaatttctgccggcatccaccactccaattccccattcctttccagccgtatctcagaccaaatcaaaccatccagtccacattcatggcggaagagagagaaagcttcgagagccagtaggcgccctccgatgtgacggaagataatctctagctttatgtgaagctggttctaagtgacgacaaaggcgacactcctagaaagcttggagaccgagaggcaaccaataaactgccgaagcaggctactccaaggaagaaaacatccagtcgtcctgtgccaaaaatcaggaagaactctaggtgcaactcatattacgatctccgttgcattgatgcgcacccattgcgataatagtactgacaatcaaacttgcaggaaaccatctgatatagatctatctagaaaagactctgacccgaccaacatggaggcgggttcctcaaaagaaaccgggccgactgcaaaagatctcccgagtgataatctgcaggccagcgacaatgtagaacccagcgacgaacccctgactggaaaccagtcggccgaagccgaagctggagttaatcaggagcccccgactggaaacctgtcggacgcagggccaagccaagagattccagaagttgaaacccaagcagacaaccctcgcggacaagacgccagcaatgaccggagatctggatctactttaaaggcatctgaatccactcgtcctcgtccagaaatcattacgggtaaacactttgtctgaaaccatgtcgacccaaataactctgatcaatcgtctaacctttgtcagtagatacattaggaccaatgattggtgatgaagaagaaattccccgtatacaagcagccgaagattcgtgccctcccattctggtcaagtggtgggatgacaacttgcaacctcaaggaattataataaaccggcaaaaagaagacgaagaggtctgcctaatgaagaaggcactcaaccaagcgactcgcattgtaaatgtaagttccttgatgcctgacctcagccatcttgtttgccgtctggctcgagcgctgattaaactgctctgcagaggattcatcttaggaacgaggcgaaaaccgcaacccttgagaaactagttcctcatcttggaaccctcgaaaccaccaggagtcaactgcacgaggccagagaacttgccagaaagaatgaacacgatttgagggattggattgctgagctccaggaatccaattataaactgagtggctcatccaaaggttcgcgcaaactctgcccaactgatttgggctgttatctctgtaatcttgattaaccgaagttaatgtactgcaagctgccaagatatctgaactagagaagaagatccaaactatggaaaatgacaaggcagagctggcaagatagagggattcagctttaaaggaggttgaaggtaccaataatcaatacctcaaaagccattatcttctatatgctgattcattaatgtgaatctgttgatgcagaccgcaagatcaagtctcaagcacagtttgatgtcttagttgacaagatcaacaagcttgaaggagccagggataaagtcgctaatgatgctactccactcatccgggccatgttcttcaataacgccggttcgagtacacttgatgctgccaaaatcttcgacaagctgagagtcgctccagatacttatttcaagaacatcaaagaagctggaagtatgggagcaagtctggcgttggcgatgaccaaatccctttatccaagggttgatatggatgccattgatggctttgcagatgggacgagcgaagaagctgctcttgacctcattaacgatgcgcagaaagccgctgacaagattgctgctgatgtggttgaaagattccaagaagtcgaccttcggccgactgggtctgataagtctgatgatgaaaaaactgatactgattgatataacaatgattttgataattaatgatgatgaaggctcaatttgtacaatactgatgaatttatgctatgcttggtgttccatacttagcttttgatttcttaaaagcctttatctagccttattgagcctaaaacccgcaaaagctattaaaaaccttcagtcctcatcgactaagtcgaaagaccaaatagggcaatgataaatcaagtaagcaaattgaattgataaaaatcacactccattattatcatagtagcccccgactgaaaacttcaaggaaaaacttgagattagcagtcaaagaggaaagatacaaacgaaacgcctaagcataaaatcgacgaaggtgttcaatattccaagaattgttgatgagagtaccatcttcgcgcttgagtcgataagaacctggccaagtgacttcagcaattatgaacggtcctgcccataagggagataatttatgccgatcctgtgtggtttgaattttcctcagaaccaggtcgccgactaaaaaggctcacgatcgaacattccgattatgataacggcgcaacccttgcaaataccgagtcgactgaattaaagctgcttcacgggcttcttctaatcgattgatgtcgtctacttggccctcttcataacgctcctcgttgaagttccgaaatcgtagtgattcaaattccacttcactggcaacattgcttctgcaccataaaccaaaaagaacggcgactggccggtagcccgactgggagtagtgtgtaaagactaaagtacggacggcagctgattgacccacttgccagcatagggatgtagtcggtcgaaaactcgtgcttttatcccttgaagtatcatgccattagcacgctcgacttgtccgttactcatggggtgtgccacggaggcatagcaaatttttataccgaagtcttcacaaaagtctttaaatgctccgccagtgaattgagtgccattatcagtgatgatccgattaggtaccccaaaccgatgcacaatgttaatgaaaaaatctctagctttatctgccgtaatcgtgatgaccggtttagcctcaatccatttggagaatttgtcaatagccataaagagatgcgtgtaacccccgactgcccttttaaacaggccgaccatgtcaagcccccagaccgcaaacggccaggacaacgggatggtttgcaactcttgggctggtaggtgaatttgtctggcaaaaaattgacaaccctcgcacgtccgcacaatcttgtcagcatcagatacagctgtaggccagaaaaaaccttgccggtaagctttgccgacaatagtccatgcagcggcatggttaccacaaataccagaatgtatatccttcaacaattgtcttccttcttccaaagacacacagcgttgcagtattcctgatggatttttcttgtacatatcagtttcatgaataatgtaaagtctgctgcgccgggaaatctgctcggcttcatttttgtcttgaggaagttcttgtttgctcaaaaattttatgaacggttctctccagtcggcttcgatcatgcttacgccttgagtatccatggcttcaattgtctcttttctgggcacggttggttcgtaaagatgttcaacgaacacatctgaaggagcagcttcctgttttgaaccaaaattggccagcctgtcggctgcctcattgttatgtcggagaacatgggtgagctcgagtccatcgaatttgtcttccaacatgcgtacctcttgtcgataagcagtcatagtatcatctagataggaccactctttcatgacttgattaacaaccaactgagagtcccctcggacaattaatcggcgaatgcctagagagatggcaatccttaatccatggagtagcgcctcgtattccgccacgttatgggacgcagaaaaatgtatccacaatacgtagctcaatctttctcaagtcgggagattaaaacaaccccagctccagtgcctgtaagcctcttcgacccatcaaaatgcatagtccaatattccctcttttcctctggcatgtcttcttggcactcggtccactcggcaaggaaatcagctaaagcttgtgacttgatcgaagttcgtggtttgaacgatatgtccaaagacatcaattctaaggcccacttcgcaatccgtccgtttgcttcgcgattatgatgtatatccccgagtggaaacgatgtgaccaccgtgaccgagtgactttgaaagtagtgagataatttcatgacggtaattaagacaccatataataacttttgaacctgaggataccttgtcttggagtcggctaaaacctcactgacaaaataaattggtcgttggactttttgaatatggccttcctcttcacgctcaacaaccaggaccgtgctcacaacctgggaggtcgccgtcatatataacagtagcggctcttgtagatgcggcgaggccaaaactggtggagtggtgagaagtctcttgaagtcttcaaaggctttttgtgcttcgggtccccactgaaaattgtcagtcttcttcagcagcttgaaaaagggcatcccccgctcgccgagtcatgagacgaaccggctgagcgccgccatacaaccagtcagcttttggacgtctttttgggagcttggcggtttcatgttgaggatggcgttgattttctccgggttggcctgtatgcctctttgagataccataaatccgagcaacttccctgacggtactccgaagatgcacttttcagggtttagtttcatcctgaaagcacgaatgcttgtaaaagtttcctctaaatctgtgatcaggtcatccttctgcttggtcttgacaactacatcatcaacgtaagcttcaacattgcggccgatctgagtcgagaaacatctctgaatcatgcgttgataggttactcctgcgttcttccatccaaagggcatggtgatgtagcagtaggccccgaagggtgtaataaacgagatcttcaagcagtcggattctttcagtcggatctgatgatatcccgagtagcagtccaagaaactgagtaactcgcagccggccgttgagtcaaccacctggtcaatgcgaggtaacccaaaagggtctttggggcaagacttgttgaggtcggtgtaatcaacacacatgtgccattgccccgtctttttccgaactaggactgggttagccagccagtctggatgaaggacttccttgatgaagcccgctgctaacagcttggttaattcctccttgattgcatccttcctgtcctgtgcaaaacggtggagtcgttgcttgatgggtttggcgtcttccttaacatgtaaagagtgctcaatcacctctctaggaataccaggcatatcggatggtttccatgcaaagatatctttattattttgaagaaaggtgatgagcgcgctttcctatttacaatctaactcagcgcctattacagcaatcttatcaggatcagagggatctaagggaatctttttcgtcttaccattgctttctccgcttttgagcatcttggttgcgggcacttctccttcgcttgccatggtcgcagccagtcggatctcttctcggtcgagtgtaatctcgcgggtctgggccatctcgcaactttctttgtcacatgtgacggctttcttgatgttgcttcgtagtgatatgactcctcgaggaccaagcatcttcatcatcatgtaggtgtagtgtgggacggccatgaatttggctagggccggtcgtccaagtatagcatggtatgctgtctcgaaatcagcgacttcgaaacaaacattttctgtgcgaaaattctcccgagtgccgaaagtgaccggaagagtgatctagccgagtggtgtagctgataatccagggataacaccgtggaagggtgcattgctcggctttaattccgtgcgaggaatctgcatatcgtccagggtcttagcgaaaaggatgttgagtgcactgccaccatcaatgagagttcttcggagcttgacattgcgaaccactaggtatagtactagggggtaccgccccgggtggaccactcggtcgggatgatccgagcggtcaaacttgattgctatttctgaccaccgaaggtattggggcgtgttgggctgaaccgcattgatctcccgttctgttagcttctgctttctcttagattcataagccagaggtccgccgaagatgtgattgagttctttgcgatgatcttgaaaaccagtcgaggcatcgtcttcatcgtctttcttctttgatgtgccttgctctccgtctgaaggcttacgtgcattcttgacgtattgctccgcaaattgtttgtagacgaagcagtctttggccacgtggttggagttaggatgatgcggacattgggagttcattatcttgtcgaatgtgttgacgcggggacgttgtcgggaagatggagaggttgttgccacaagttcttcgggcttacgcttgcgatccttgcggttgttacttccactccctcctgcggtcggcgtgtccttctttggcttccaagtggtgcccgactgcttggacgctgtaatagcatcttcggctttggcatactcgttggctttttcaaacatttgcttgaccgtcttgggaggtttgcatccgaacttgccgactaggtcctcgtggcgaatgcctttagtaaaggcagcaatgatgacgtcgtcggtgatgtcggagatcttgttgcgttgctcggagaagcgccggatgtaatcttgaagggatcctctagacttctgaacgacgttgtagagatcaaactgtgtgccggggcgttcaaaggtgccctggaagttggcgatgaagtgatcacgaagttctgcccatgatccgattgtgccacggggtagtccgtggagccaggatcgggcggaatccgctagagccacaggcagatagtttgccatggccttgctgtctcctcctgctgcgcggattgcgagaccatagacggtgagccaagactcagggttggtggtgccatcatatttctcaattccagtcggcttaaagccggctggccaatccactcgacgcagatcgcttgtgaaggcagcaactccgtccacatcgttgtcgtaacgatctggtgaatggtggcctcttgctggacggcgctagttgatggtgtcgcgaagatcgatggggcgccttcgatgtggggagtgtggtcgttcaactcgacgctccctataccgttcgggaggtgaacgaacagaccgttcatcatgtcctctgctcctgtgactagatccggcactggcaatgctgaggcatggctggtgatagtcttgagatcgaagatgagggactcggctaccagtcaaggtgcgggtgcttgcggagttggctggacccgaggaagcgatcatggtcttcgtctggttcaagatgttgacaacatgatcagcttggttgagtgcgtcttccttgaggagggtgtcgaggagagtgattgctgcaaccgcgttctgctggggggtgcgaaagaccgctgttccgtcgacgtcttgttgcccaatgagctctctcgctcgcctcccggattccaaggtgcgttgccgtcgatcttcagcctcctttgcaatccgttcgcgatcttgttgctcacgctatagtcgttctcgctcctgtcgctgtcgctcttcctccagtcggcgacgttcagcttcttgccgtgcgcgatcttggtccgcttctcgggctcggcgctgttcctccgtttcgttgtcagccatgaatacaccgaagaagaggggcgtgtagttatcctcatagctgtcgtcgaagttgtcgaggtcgtcgtggtcgtcgtagtcgaggatctcggttggtcgagaactgacgccgggggagctgaggtagccatccaaatcttccgtcgagactgtcccaagaagttggagtataacgccaacctccctggatctagactggatcagggccgatgccggagctcgcctagatctctgagtgggagatgttttgactgtgaagacggcgtccaagtcatcaggaagtttcatcaagattgaaggataggacccgtcgtcttgatctggtcgcggaggagtagattggatctcgtccgagtggtttgaagccgactcggaagatatgatcttggagtaggcctcggccgagttcggaataccgaacggcacggggacctggtctctccctgactggttcgaatccgagtcaaggagagagatcttgctgaagtcgttggtgatgaagttgaggctgccgaaccggaacgcctgcccgggagggaaggcgaagtcgtcgatgccagaaatggaacccatcgcacttagtcggcaaaaacttgacgctgcccctacctggcgcgccaactgtcgaaacaagatttcggcaataataaaagggggtggctatcaagctaggaaagtggatgggtttggagacaaggaattttatacaggttcaggccttcttattcaagaagtaataccctactcctgtccggggatgattccgccgagtatgttattgattgtatatattggaaaaaagaattgcgccccgagaggcacacggaccctccttatataggggaaggagtccgctttacaaaatacagtccatatcctaacggaatatgggattatagataaaatacaatcctaaccgactaagatctcgggtatttccttgacatacaagtaaaaaacaaacccgagtcttcataaagatattctatctatatttggtaccgtatatccgactaaattataactgtcatgtagatatgggatatccatattctccacatggagtgtactgggtgcgtccgtgtcgaaaattcactctgtgattcgcgcagcgaacttttgtcacttaatgccaatattggcctatattagcatacatgggtgcgatgaattttagcggaataaaaaagttcagaaagcaccaaaacatgtttttggacatactgtagagaattgggtgcgtccgtgtcgaaaaatcactccgtgactcgcgcggcaaagttttgtcaattaatgccaatattggcctatgttggcacacgtgggtgcggagttttacaccggaaagaataacttcaaaaagcaccaaaacatgatttttggacatattggaatatgctgggtgagtccgtgtcgaaaaatcactccgtgactcgcgcggcgaacttttgtcaattaatgccaatatagatatatattggcacacgtaggtgcaatgtttttcaccggaatgaaaaacttcaaaaagcaccaaaacatgatttttggacttattggagtatattgggtgcgtccgtgtagaaaaattaatttgtgactcgcgcggcgaacttttatcaactaatgccaatatctttggacatatttgagtatgttgggtgagttggtgtcgaaaaatcgctccgtgactcgcgcgacgaacttttgtcaaataacgccaatattggcctatattggcacacgtgggtgcgatgtttttcaccggaatgaaaaagttcagaaagcacacaaacatgtttttggacatactgtagataattgggtgtgtccgtgtcgaaaaattactccatgactcacgcggcgaagttttgtcaactaataccaatattggcctatgttggacacgtgggtgcgatgtttttcaccggaatgaaaaacttgaaaaagcacgaaaacgtgattttttggacatattggagtatgttgggttagtccgtgtcgaaaaatcactccgtgactcgcgtggcgaacttttgtcaattagtgccactattggcctatattggcacacgtgggtgagttctttttcaccggaatgaaaaagttaaaaaaaaaaccaaaacatgatttttggacatattggagtgtacagggtgcgtccgtgtcgaaaaatcactctgtgactcgcgcggcgaacttttgtcaattaataccgatattggcctatattggcacacgtgggtgcaatgtttttcaccggaaagaaaaacttccaaaagcaccaaaacatgatttttggacatattggagtatgttgggtgagtccgtgtcgaaaaatcactccgtaactcgcgcggcgaacttttgtcaattattgccaatatagacatctattggcacacgtgggtgcaatgtttttcaccggaatgaaaaatttcaaaaagcaccaaaacatgatttttggacatattggagtatattgggtgcgtccgtgtagaaaaatcaatttgtcactcgcgcggcgaacttttatcaattgatgccaatattgccacacgtgggtttcaccgtaatgaaaaagatcaaaaagcaccaaaacatgatttttcgacatattggagtgtattgggtgcgtccgcttcgaaaaatcactccgtgactcgcgcggcgaacttttgtcaattaatgccaatatagatatatactggcacacgtgggtgcaatgtttttcaccggaatgaaaaacttgaaaaagcaccaaaaaatgattcttggacatattggagtctgttgggtgagtctgtatcgaaaaatcactccgtgactcgcgcggtgaacttttgtcaattaatgccaatactggcccatattggcacacgtgggtgcgatgtttttcaccgaaatgaaagacttcaaaaagcaccaaaatatgatttttgggcaaattggagtatgttgggttagtccgtgacgaaaaattactccgtgactcacgcggcgaagttttgtcaattaataccaaaattggcctatgttggcacacgtgggtgtgatgtttttcaccggaatgaaaaacttgaaaaagcaccaaaacgtgatttttggacatattggagtatgttgggtgagtccgtgtcgaaaaataactccgtaactcgcgcggcgaacttttgtcaattaatgccagtattggcctatattgccagacgtgggtgagttgtttttcaccggaatgaaaaagttcaaaaagcaccaaaaacatgatttttggacatattggagtgtacagggtgcgtccgtctcgaaaaatcactctgtgactcgcgcggtgaagttttgtcaattaatgccaatattggcctatattcgcacacgtgggtgcgctgttttttcccggaatgaaaaagttcaaaaagcaccaaaacatgattttaggacttattggagtttactaggtgcatcagtgtcgaaaattcactccgtgattcgcgcaacgaacttttgtcacttaatgccaatattggcctatattagcatacgtgggtgcgatgtattttaccggaatgaaaacgttcagaaagcaccaaaacatgtttttggacatacttgtagagaattgggtgtgtccgtgtcgaaaaatcactccgtgaatcgcgcggcgaacttttgtaaattaatgccaatattggcctatgttggcacacgtgggtgcgatgtttttcaccggaatgaaaaagttcaaaaagcaccaaaacaagatttttggacatattggagtatcttgggtgagtgtcacaccctgagatttttctcccaagcctaaattgaatttataaatggtctcaacaaaataccgctgcaaaagcaagagagaaaccctaaaataattgatgcaaataataatcggaactggcatgtgggattttttcctgagttctacatgtcgaaatacgctaacaagattttagtggaattttaagagctctagaaataattttaatcaattaaaaatgaccacaagcaatatttaattccctagaaattcttttccttatttttctttctttttccctcttttcttttcggaatggtccgccggcccattctctcctccctccccttcccgctgggctggccgcccgagcccctcctctctcccggggtcgccgataggtggggcccacctgtcgagtcctcccccaacctccagccgccgccgcaccctcactaccgcgttttccgggccacgtcggccttgcccgcgcgtgcgcccacgtctcccgcgcccactccctctctctcccgcccgcgcccgcgctcgagacggccaggattcgattttcaaatcccgcctctctctcctctcccactaccccacgtcggctggcgattcccgcctctcctagccacgttcgagctccctctcccctatttaagcatccccactctcccctctctctttttctccatttcgcgagctctcccgtgccctctatcgccctagcgctgtcgccctcctttccgccgccgccgccaccgctccggtcgctgctagccgccgctagccgctgcgccgagccgcgtcgtcgacgccgtcacgttcgccgtcgtgcaggtcaccccgtccgcccctctcccgtcggattccgcctccggaacccactccgcgccttgcgccggtgagcaccgccatggccaccgccttcggccggcgtcctcgccctcttccatcttcctctctctctaacccctttcatcgtgttcgctaggtggttccagagctcgtcccgttgccgtcatcgccctccgtcgctcgccgtcatcaatcgccgtcggtgagacacctcctccccttcctccctctctctcccacgccgcttagtcgccgcgctgccgcctagctgcttagccgccgctagcatcacccgcgccgtcgcgccgccgccgcttgccgtcggtcaccgctgtctgccgccgccgccctgcggtagcgccgctgtgcaccgtggccatcgggccggcttgggccgcccgtgtgtgccggccgcgtgctccccgccgccgtccgatctactctcgggtagatcggggccgtcggttcggccacccgcgtggcgtgccatgtggccgccacgtgtgcgccacgtcggcgccacgtcagcgccacgtcgtgtgcctcccccttctccggtccgtggactcggtccactgtggaccgccacccgagtcactgccatgtggggcccacatgttggcgccgcccctctctcctagggtctatttattgcgcaataaatcaattaaggatttttctgtttatagtaaaagcacagtgaatcttctaaaattcatatctaattcatccgagctccgtttaagcccattcaagtctcagtaaatcaagaaaaatgagtagaatccattaaaaatggttttgttctctgtttcagtagtcttattgcctgtttgtattgtttgctttgtatgtcgcttagattccggctctcccgacgctccggtgtactttgaaatagtcgccgaggttcctccagcagcagagcaaggcaagtcatgcttgtcacttgaagatgttgatcctatattgcaaatgttctattgttttccttcaaatattgcattgtttcataatgatactatgggatgtttacctactgttacagccatgctatttctgtaccatgctcctttgttagcttgggatataaacatgactagagattggactagggattgcttagccatgcttagttcaactagcacacaatgggggaaatcacattaatgcatagatatcagattctagtaatgacgttggttaatgccaccgctccggtgttggttaattaaaatatatcaaatggtgggctgtgggtgcatggttttgttggtcgcgcccatggcatttaaggaccggttcgcgggatgccctggaagaacttatcatacttaccacaagccagcgtgtgcaacggctgggcttgtagtgtagttttcctctagttgacgcatccaggaaagggtgggcgtgatggagcagggcgggccctgtgacggcctctgtcgcttccggattcacctaggcacgagaggggactgcccgttgcccgctggggacggggtgaaacctgaggtgtggtgtgcttggctagagggggttatgcgaagagtcctgtcacggcctctttccggtatgtcgtggtggcatgtcggcgcacggaaacgtgtcgtggggctgtgttttgtgggtacagttgtacacctctgatcagagtaaaactatttgaatagccttgcccgcggttatgggcggtcaaccagattcaccgtgattagtctcaccctagtttaatatgatggaactgattagttcaggtggttggttgggcctgttgcaacgtggtgtagcgttggacagtggatggctaatattgattaattattacacctgatttcctgctttcaactactgtttataaatgctcgttttacgcaaaagaacctctctagctatcctttggtaatatcctgcatcataccccctgttccggtatgacttgctgagtgtggtggttatactcagtcttgctctattttccccaaaccccagagtttgagtatgcgttagatggtggtttctccgaggaataggcttcgttcgtgccgtcgaggatgcctgtggactggtgttcccgctgcagtccaagtcaaggcttagctccagttatcttttatttttccgctacatttatgtaagacttttataatttttgtaagacgtggatctgtatgtcaactttgtcgtttgtgtaccccccggccggtcctggatggggattttaatgcacattctgcttggaattctattcgggaatttctgggcgtgacaacttggtatcagagccaaccttgaccgtaggacaagccaaatgggaaaaaacctaagagccctctgaatccttttcattgcatatgttctttgcaattggatttgttccgggaaaattgggatctgttcttgtggttcaagggaaaaatcttggtcgctcgtttaagtgagatttgtcaaattaggtcagtctagggtttgatgggaggaatgcattaggtcctaactcaggaatatgggttgcaaggtattaatgctcttattattattattagtatgtatctaatttctcattattttatcgctatgtaagtccgtcttatttattcgccctcatgcaaaaatggtctatgcacaaaactctgctctcaattgttcattttaattgagtcttttactactttatttaaattggatttgagcatgcattgatcctacccctttgtcttctctagatggccgaccacccacccaaccaccacggagaaggcatggatgattttgtggcagagttggctcgcatgaccctggtggtgggctacctgttaacaaccgaatttggtaacatcagcatcatgaaagaagattagatcgaagcaaaattggaggcggagatcgagttcggaaacagggcaggaatcgctggagtccaaatcggctacgattaggatcggctgggtctgagtcagactaggtaagccgatacagctgattccgacaatgcagcttgatgtatgatatcgggttggattgaggtgcttcaaggtgattgccgcacatggatagagtcctgagaaggcaattgtatctattaattagggtgttttatgtaatctccttagagatacgattgggcaaaagtctgccacaaagacttatgctatcttagagtttgctagagatagtagtcgtgtccgttatgtacatatcttgtaattcagagtatcataaagctgcatcggtttcgatcttcaacaagaggtaaaacttgttatgacgacttgtgttctcgggattagtgcttccatctttatgatactctgatctcgtttatgtaattcgtcgagttatcatatatcttacataatctccggcaatactgctatctaatctacaatcggctaacatctgtctgtagaaggcagccgattaggttagatatcgatgttgacttagattgtataaggtatctaccactctatgaaacttctagcggcttgattgtctagatattgttcttcttttcatacttaatgctgcatcagttgagtttgatctattaagtcgtgcttagaatatcaatctctagcctgccttctggttgccgattagggtagcatcggagtttcagccgaccttatctgatttaactatatttgctctatatgcttcattgacatgttaaatctgcccattatgtcaagatattgctgtatctaagtatcttaggcctttgtttgatatattatacctgttttaatatcctgatatagagtagtatcagagtattagccgatacatgctagatctatctgatcggctatgctataaacatatatagccctgttattaatatatacttcgatctaagtgatttataatgtcttggcatggcggccgatctatcccaatcacttgatttaagtatatatcgatataagaactatatattggaaatatctacagccgatcgaatagatttggttctttattgtctatttacaactgccgatcaattcacatatgacatcggctcaaagataaatgatatgtcatcggcacctagccgatcggctatcatttatagatttaaccgcggtttctttgcctttatttcttgttaattacaggatcaaatcaactggcatgctagtacacccgaaggcgagctttggacctgcactggagttaagcagatctcccaggcctcgtgttttctctcaacactaccccaacgtgccggagtactcgaccgttcctccactcagtggcgagcttccccaccattttcgtctggaggttcatggctatgtgggcacctgcctcgctaatacggtggttgaggcatctggaggctccgcagatcacgcttgtcaggaggcagcatatctgatgatggctagacttcgtgatcgccacaactacatcttctacaacacggcgtaccgcttccaccctcgccgagcaagtggcgacgacgccagcaccttccgcccgacagccggcgagaacaacaccaccttcggccacatgtgcgccgtgatgaggggaatggacaggatgcactctgacctgcacaaggcatccaaggccttgaatgatgggaagcttgtgaggatcatagctctaaaggatgagatagcacgcctgaagaaggagaacgctcaattgaagggtcttccagcgccaggaggagttcggatccgcaccacgccccgcaagtctacgactgctcccgtgcgcattcagcttgcacccaagaacccacctcttcccgcagctcctcccgcagcacccgtagctccagctccagccccagctcctgtgccagtgtcagctcccgcgtccgctctctccttcgctccagcgtcagccgccaggggtccagccagtggcaacggaggttggttgcctactactcctagtggcagccgcgaccatagcagcagcagttccagtggctcagagctgggcagcggtgagacgtatctgccagactccaggagccgctcagaggggcctggcgacgagcaggaggacgccttcgactccaccgactgcaggagccgttccgagcattaggctcattttcccttagtttatcgactgtttagtaattgcctgttagtttgtgtgtttaggattgttcgcttgtgggtcagtcgacagtcgatatcatgtgcctatgatatggctgtcttaataaggatttgcttgctgttttaagtgttttaattcagatcaaaacaattgcagtttaaattctgtcacgtcctgatttttcgctttctgttcttctcgcctatttgcgaaatttcacatttggtttattcgtctaaaatagcttaatgaaaatttcgttaaatcaaacggttttaaagtgattaattaattaattatgttgttcgctttgtgattcttaattggagttagttggatttaatttgtatttcggaagtggagctcaatccctaattcaaattccatccaaatccaatattccttttcaaatcctaaatccttcccaaaaatttcaaatactttatatttggaattttccagagaagtccctgtctttttccctttttccttcctctctgtttctctattctgcccttattcttctttctttttctttttcccccaccttcttctacctccagctctctctctccttcttgagctgcaggcccggggaggccaagccccgagcccacgtgccgccgcggcccggcctcctcctcctctctatgtcgccggcccaagccgccgccgaccgagcccgcgccggccgcgccgcaagcccacacggccgacgccaaatcccgcaagccgcgccaccaaattcggagccgccgcttttccaaagcttgcaccgtgcgccctaaccctagctactccctcccctataaataccatcggccaccgcccctttttccccctttttccaaagccgccgccatctccaccgtgagcagccgccgccaccgttgcttcgtgccgccgtcgggagccgcgccgtcgtcgtcaccatctccttcccgtgccgccgccgctggtaaagccccgaggctgagccctctctccctttcgagccgccgtttctctctccacctcaactccggcgtccgcctctcatcgccgtgcgccatctccacgccgtcccggagctcggtgctacgccaccgcgttggcctccacctcctctgcctccaccactatttgctgcagccgccatgcgccatcgccgacgaaagccgccgatgccgccgcgctggagccgccggtcctgccatggccagagcacgcccaggccgtgtgatggagcagctgctgcttgccttctcccctgtgacaccgacgtgtgggacctgccatccaaaatcctcaaataaatctaagccgtccaaatccctagatcaaatcccagcagttggatctacataatcccttctttcgccacgtcagccctatatccatccatgtcagtgccacctcatcgccttgtgtcgccacgtgtcgttccacgtcatcgagtccacatacaccgagtccacccatacactatgccaatgacagtgggcccacatatattttttcctatccaaaattaattcaatttccgaaattaaatatccagagaatattcttggaatattcctttttcttttatcctcggattttccccgaattcaaacttcaggaggccataacttttccgtttgaactccgattcgatccattcttcctcctaaattcttctaaaatcgagctttacctcctgatttaattggttatttcatttgatgttatttagttattttttctttgtgtttatttgtttttcgtttgcaatcgtgtagacgttggagcggaagagcagtttgcttcagaagacgctgtgcaaggacagtactaggatcaaggcaagtgcactctttgaacatattgaacccatttgtgaaatgttttgttttgaatacatgcattgttttgtttataaaccatcgatgggtagcgtgacctaattgttattattatcctacctttgataattattgattgcccatgattccttgtcaccctagtctttgtgaattgaacattgggctgaactcatggtagatcgtggcacaaaagaagagagaattccgagccctccaccagggcaacaggacagtgtctgagtatctccatgagttcaatcatctagcgcgatatgcaccggaggatgtccgcactgacgtagagaagcaggagaagttcctagcaggcctggatgacgagctgaccaaccagttgatctctagagactacgccaactttgagaactaggttgacaaggcaatccgtcaggaggatcagcgcaacaaaatggacaggaacagaaaggcagcgtagttccggtccaaccaaggaaaccaccagcgatcgcgcttcactccaggacagcagggtggacctactgttggcaactttttgtgacaagttgacaagcacgatcgcagcacctaaagccttgcggtgatcctagagtcgccaaccacctcgatctagcaaagagctaaacctagatgggttttgataactaaaccggctagcggagccgatttctagataactacccatcttgtgggcaaaacggaaggttttcaggacaaacctacaaagaggtgtcgcactctcgcagcggcggtggacggtttacggcgcaaaccgacaaagatggacaaactaagagaaaattaaaagcaatatgaaaaacgattcgattgattgattgtagattgattttttacaatgaaccggccatgtcccttatataggtgttggtcttgccctatacaggccctcctccaagtccaactgcggggtagaaaccaaaggaaacccaaaacatgccttcccgagcaaggaaccttgagacccgacgaaacacagtcggactagaacctgccggtcagaccggccacacaccgccggtctgaccggctctcaaccggcggtctgaccggccaagacacggcggtcagaccggcccactcggaggaaaccggtagacttccaaattttggcaatctttcctattttaatcctaggtgccaaatttgggtgtaaacatatgcccccctgcctttttgatgaacaacgtgaatctaaaagcatagaacatgttttggtcttaggacgataaatcaattaccagccatagtacctcctaagcgtcttgccaaacgctcgggaagtatttcttcaagtatttcccgttgattgctcgctgaaaacgctccccttgaagtgtctccaaaaaatatgcgttccctcgaacaatgccgcatacttgataaggaccctcccaactaggagaccactaactgaactccttggatcgagtacccaatggcaaaattgtcttccaaaccaagtctccaacttgaaacaactttgctttcacccttttgttttacgccttggccactctcttcttctctttctctatttattccaatgctttcaagcggttgtcgatgacttcatcaagattgtctcccatcaacgtcttgtaatcttcatttgacaaatcatcttgcttgatataacgaagagaaccaagatttacctccaccggtaaaacggcttcttgaccataaaccaactcaaaaggagtgactttagtggcaccatgtttagaaatcctatgcgcccacaatgcttcggaaagcatctcatgccacctctttgggtgttcctcaatcttcttcttcactaacttcaacaatgtcttattactcgactcggcttgtccattagcctgagcgtagtaaggagaagaactcaacaatttaataccataagattcggtaaaactcttcacttccttagacatagaagaagcaccttggtccgtagttaatgtttgtggaataccgaatctatggataatatgcttcaaaataaagtcaattacctctgtatgagtcatattcttcaaaggcacgaagcccacttggtgaagtaatccgtagcaactagcagaaacctatgcccctttgatgacgaaggataaatttgaccaatgaaatccaaagcccatcctcggaatgaccatggtttgattatgggattcaacacggcggcgggcgccaattgaacattgccgaaccgttgacaagcctcgcgtcctctataatatttgaagcaattatcaatcatcttcggccaatagaacccagctctcctaagcaaccaattcatcttgtgggccgattgatgagttccacaaattccttcatgtacctctcccatagccactttagattgatcttcatctaagcacttcaacaagacaccatctatatttcggcgatacaaatctccatcaagcaatgtatatttgaatgcttgccgccgaattttgcgatcaaccttcaaatatcgaattttgcgtaggatctttcaaatatcgaatcaaaggaattctccaatattcttctgttccctgggcacaaatgtctgaattcacagttaattcagcctctaaattgattgaaacgtgccccccagcattctgcccagaaccggtcagaccgaccacgcagggccggtcagaccgctctgggtcgccggtcagaccggcagcatgcggccggtcagaccgcccctggttaccggtcagaccggcagtgcaatgccggtcagaccatccctggtctccagttttgccaatttcgcacaaagatttaaaatcaagcaccggctcttctaatatcagaaataatcccttcttcacattatagccagatgcttgttgtgccaagtcatttgctctagaattatcatgcctaacaatatatctaatagaaaaattatcaaaattggcaataatatctaaacatgaattgaggtacctatttagtgatccgtccaagcatttgtagactccggtgacttgttgcaccaccaattccgaatcaccaaaagcttccatgtatttagctccaaccatcaccataacttgtaagccaaacaataaagcattgtattcgacttgcttatttgtacaataatactccaaacgaacagatgcttcataacacatgccattaggtgaaaagaaaactacccctatgccttgaccttctttgcaagaagaaccatcaaaataaatcttccaaggataacttcaactaagcaaacctctccctcataagcaatatctgtatgatggtctactataaaaccacatacaatttggcctttcatagatttcaatggttcataagccaaatcatattctatcaaaacatatgcccacttgccaattctcccacttagaattggcctttgcaacatgtgtttaataacatcggcttgacaagtaactatgcatgtactatataacaaataatgcctcaatttggtacaagcatagtataagcatagacaaagtctctctataaaaacatacctcgttttggcatctaaaagacggcggctcaaatatgtaatgatatattccttgccatcttcctcttgtgtcaaaacggcaccaataactttgtcttcggaggcaatatataaccgaaaaggctttccagctttaggcgctcgtacaacgggtggagtagacaaatatctcttcaactcttcaaacgcctcttgttgttttgcccccaagtaacatcggcttcttttttcaagcgaagtataggaacaaaagcatcgattttacccgctaggttagaaataaaccttctcaaataattcactttacctagcaacttttgggcctccttcttgcatgtcggcgctttgaaatcacgaatcttctctatcttcttaggatcaatctcaactcctctctcatacaccatgaatcctaagaacttccccgccgacacaccaaaagcacatttaagtgggttcatcttcaaaccataccggcgcatcctctcaaaagctaacctcaaatcggccatgtgtccttccataccatccgatttgacaacaatatcatcaatatagatctctaggataatacctaataaatcatgaaagattaaattcattgtcctttgatatgttgcaccggcattcttcaacccaaaagtcatgacaacccactcaaataaaccaacaaatcctgggcacctaaaagccatcttgtacatatcctcttccgccataaagatttgattgtagccggcattaccatctagaaagctaatcaccttatgacccgaggcatcattaatcatcatgtcggctataggcataggatactcatctttgggagtagctttatttagatctctaaaatatatgcaaactccaatcttaccactccccttcttctccactaggactctgctagagacccactccacataacgacatggcctaataaaccctgccttcaacaaccgatcaatctcctctttgactcggtcatatagcaaaggattaaaacgacgaggtggttgcttataaggcctaaaacctggtttaattggaagccgatgctcaacgagctcacggctaagacctggcatctcatgatattcccatgcagagcaatcaacatactctttaagtagctcgattatcttaaccttataatcggctcatatttttgtttacaaaagtcagccttggtttggttccatcacctatgtccacttcctccaatggatcggccgatgtaaacccttgtccaagcttctctacttcatcaaaatcttcaatggtttcgccaatatcgttctttgtagaccgatattcttgcaccctcttttgtaaccactctaaattagcctctttactcattatacaaatttatatggcttagccgtgctacactagccggctttacagaaataggtacaaatttgccatcggagatactaataaaatcatagctagaaagttccctccctgataagcattggatattcccatgacgccactcaaaagtagcatcggccattgcaacctcggccgatgtatccgcttgaacaatttcaacatcatcgccgtcccattgaattaaacattgatgcaaggtagaaggcacacaacaattggcatgaatcaaacaacgacccaaaataacattgtagttaccttgcacatcgacgatgaagaaagcggttggtagcgtcttgtttcccacggtgaacttcgccgaaaagataccctttgcctctgttggttcaccattgaagccattgagaatcatgttggtcttcttcaactcatcatcctcacgccccaacttcttgaacaatgaatacggcatcaagttcacggcggcacctctatccactagcatcgtagagaccggcttcccaccaacatggcctttgagatagagaggcttcatgtgacggtttgactcatcgggcttctcaaaaaccgcgtctttaggacctaatgagaattgagcaacctcggcttcatccatagcacaaaactccataggcaacatacataccatgttgatatccatgtcttcttttggagatgattcacctttatcaaccgattgctcctccctctcctctacaacaactggcttttccttctctatggatttacgcctccataccagtggcggtcgcaactcattgaaccttttatctctttgttcttcagcttttttctctcttatctcttgagcccgaagacgttgcaaccttctcttttgagtagccgtcaaatccttaggcatccacctaggattcggctctgttctaggaggtaaataatgtcccctattaatcttgtttgaagacgatgaagccttcatatcgccctttgcaattcccctgtcaaaccggcgctggagcctgatcagaccggacgtagaccaccggtcagaccggccagacatgccggtcagaccgacacttgacgcacggtcagaccggcccgaggcatcggtcggaccactgtcgggtcggcggtcagactgacctgatgacccggtcagaccggccgcatggctgcggtcagaccggccagaaggcctggtcagaccggccgactgcgaggagttggttttggcttcggattttttgtttgaggatactccaactccatctccagaaggtattggcacatcatgagaccccactttgatggtaattacttctgaagtccttgcctccaccttgacgcgctttccttccctcttttcattattagcccgattcttaccataaaaccgcctattgtttggtgaagagaaacgctcatgaattggcctcctcggtcctccccatccttggttaaattgcattggaggcatatgattgaaaatttgcggcgttgccccccatggcatgaagtaaggataaggataacccggcggcgacattcgataagaaccccatgacatgtcttgtggatgatgatatggaggtgaatgcgaccgtcttggtgaatgaccaaatcgctccctaggaggtgatcttggtcttttccccttgttgtgaaccctctcaccaccttgcttctcatacttctccaaaagcataccaaaagtcactttggtcttcctaggggctttagaagttgaagcgccactcttattctccttccaaacactaacttccggtttctttgtcactatcatcttaggccttggctcgccaatgaccactccttttcctttagtagattctgcttgctccggccgaattaacacctttttatcattgaaattaattgtattcaccgaaaaaggatcatgatcaagcttcatcttggagccatcagtgaacttcaatcgtccttcatctatggccgattgaacctgtcgtcgaaacacattgcaatcattagtagaatgagaatgagaatcatgccatttacaatatgctcggcgtttaaactcttcttgagatggtatgacatggcctttaggtaatctaatttgtttttcttgtaaaagataatcaaaaatcttatcacacttggccacatcaaaactatatttaacctcactttgccgatctttgcgaggagtcggcattaggttggagcaaacaaaaggcttgtttttgttagtccatgaccattcagcaacatatatatcatgatcaccctcctcctcactatcactagcctcagggtaatcaatcacattaacattaggctttttgtcataagatctgacaagttttttattatccttaactcggctttcttgagccagagccctttgcatgagttgactaacatcaagaaattgttggccatctagtctttctctaagaggagcaattaaaccattaaaagcaagatcagccaaatctctattagttatattcaaggtataacatcggtttctaacatctctaaatctcttaatataatcaatgacagattcattatatttttgcttaaccgatgttaaatcacataacctaagctcagtttctccagtatagaaataatcatgaaatttttcttctaattgagcccaagtatgaatagaatttgctggtaaagaagtaaaccatgtaaaagcattaccggacaaagataaagaaaacaagcgcagattaaaagtatcactattagcctcaccacattgcaccaaaaaattgacctacatgctcccatgtggtcttactatcctcaccactaaacttggtaaattcgggaactctataattacggggaaacggcacattatcataataatcaggatacggctttttgtaaaccctagcacaatacccagtttcaatcccgaatctattcctaataatctcactaattatgtcctccatattattaagcccatgttgatttggcggtggatttggtggcctaataggttgtgtttgttccgcaatatgattatattggccttgtctagtatcgggaggataccccctagcaacatcattataagcattaggaacatgtgggggaacttggagattatttgcagcagtagatataggaggatcaaatgttctaagatgatacaaataactagcattagtcatcggatcgatcccctgtatcggtataattgtgccgttctgatcggccgtttggccggtcagaccgacggctaagtcgtggtttgaccggccgtcaggcccggtcagaccggccgtgtgcgccgctccatcggttttactacccgtttgatctataggaggttggttagcagtggtagaggctttatcctttgacatgtaatcggccataagagggccgaatttaacccttaaaaactcatcaaatttaccctcaaaagttgcatctaacttatctttaaaagcaatcatagatgaatctattgtagatgctacttgttgttggatagattgtgttacctcatcattacttaccaagtcgggggcgagcttaggacgtggcccgggcttaataatcacgccttgacgagtcctagtgcttgccctcatcaacgcctcccgtgtgagctcgttgatgtactcctccatagctttgcggtcctctccttcggaatcctccaatgtgaccggtatcacattagatggctccacctccgtcttggatggcggcttcgtcatggtgaagtcgaagttgagttgacgatgaacggatctccttcccagtggagtcgccaaaaatcgtgttggcaactttttgtgacaagttgacaagcacgatcgcagcacctaaagccttgcggtgatcctagagtcgctaaccacctcgatctagcaaagagctaaacctagatgggttttggtaactaaaccggctagcggagccgatttctagataactacccgtctcgtgggcaaaacggaaggttttcaggacaaacctacaaagaggtgtcgcacactcgcagcggcggcagacggtttacggcgcaaaccgacaaagatggacaaactaagagaaaattaaaagcaatatgaaaaacgattcaactgattgattgtagatcgattttttacaatgaaccggccatgtcccttatataggggttggtcttgctgatgaaccctgagttcctctcgacactcaaggctgttgttggcccgatcttttggtgagttgtgataactacgatttgggagaaacgttgacaatccgactacaaccgtacgagacgttgtgttgcgccttagcgatcgatacacctctctgtgggttgttgatcttgccggtgcagatcaaccctatacctgcaagcaaatagaagaaacaagcaagaacaagataaaagcaatctgatattgcaaataggaatttaatacaaatgataagttggggttccgaagaacaagcagacggacggtctagccgacacgcgcgctgcaagcaagtagcaatggcttgcatcaaaaccctgaaggggtaactagctatatataggggtgggaggacgacctaggggtgcctagggtcgtactccaccagcttggggcgcaccccacatgggccccacctggaccggggtcccaaatgaagaagttacaagcccacaggttcatgacaggtgacgcagcaccttgtttcttcatctgtggatgacttcgatggaatttggcgatgatgccaaatccgttggaaagaggactccgagagctttccatcaagtactcatgggccgaaaaggaggtcgtatgcagattcggcggccatttgaagtcagcagtgtagcaggtggccgaatctgattccagcacttggaggacttgatctggatattatcttgttcatccatgatgtgagcaatggttgtatccatagtagccatggtcacatcacttgccctctacaggccctcctccacatccaactcgggttagaaaccaaagganacccaaaacatgccttcccgagcaagcaaacctcgagacctgacgaaacacagtcgaactcagacctgccggtcagaccggccacacaccgccggtctgaccggctctcaaccggcggtctgaccggccaagacatggctgtcagaccggcccactcggaggaaaccggtagacttccaattttcggcaatctttcctattttaatcctaggtgccaaatttgggtgtaaacacctaccaccatgatcgtccgccaacatcgccctttcaactcgagcagcttccaccagggcgctagtggcagccagaaccaccagggaggtcagcccaaccgcagtgcagctccacgcccaccattggcaccagcacagtcagctccatcagcccaagccaagaaggagactggagcaaagccaggatcctgcttcaactgtggcgagcatggccactttgctgacaaatgcccgaagccaaggcgtgccgggccaaggtttgcccaggctcgtgtcaaccacgcgtccgcagaagaggcgcaagtagcaccagaggtcgtactgggtacgtttcctgttaactcaatccctacaacagtacttttcgattctggtgcaacgcattcgttcattggaaagaagtttgttgggatacatgggttaataagggaagaacttagtacaccaatgcgggttcataccctagggaatagctccacttcggttcaattcagcccttctataacaatagaaatccaaagatcaccatttctagccaacctcattcttctcgaatccaaagacctagatatcaatcttgggatggattggctaaccaagttcaagggtgtcattgattgtgtgaatcgcacagtcaccttgaccaatgagaagggagaaacagtagtgtacaaatctccagtctcaccaaagcagggggtctccttgaatcagattgaggtggaaattccagtggtcaccgaggagaagagttcgaggaagttggaagatatccccatagtctgcaagtatccagaagtgttccccgaggacctcactaccatgccacccaagagagagattgaattccggattgatttggcaccgggaactgctccaatttacataagaccgtacagaatggcagccaacgagctagcagaggtcaagaagcaggttgatgagcagctgcagaaagggtacattcgaccgagtacttcactttggggtgctccagtcatttttgtggagaagaaggacaagacgaagagaatgtgtgtcgattatcgcacactcaatgaggtcactttcaagaacaaatacccgttgccgcggattgatgatctgttcaatcagctgaaaggagccaaggtgttttccataatagacctgcgatcaggctacaaccagttgaggatttgggaagaggatattcccaagtcagcctttaccacttggtatgggttgtatgagtgcacggttatatcttttggacttaccaatgcacctgcattcttcatgaacctgatgaacaaagtgttcatggaatttctcgataagtttgttgtggtattcattgacgacatacttatctattcaaagtctgaagaagaacatgagcaacatctccttctagtactcgagaagttgaaggagcaccagttatatgccaagttcagtaagtgtgacttctggttgtcggaagtcaaatttctgggtcacgtcattacagctcagggcgtggcagtcgatccaccgaatgtggagtcagttaccaaatggaccccacctaagaccgtgtcatagattcggagttttcttcgacttgcaggttattaccgtcggttcattgaaaatttctccaggatcgctagacccatgactcagttgcttaagaaagatgagaaatttaaatggacggccgagtgtgacaagagttttgaggagctcaagaagagattagtgtctgctccagttctgattctgcccgaccaaacaaaggacttccaagtctattgcgacgcgtcccgccacgggcttggatgtgttctaatgcaaaacggcaaagtggtcgcttatgcctcgcggcagttgcgtccacatgaagggaactatccaacacatgacctggaattggcagcggtggttcatgctttgaaaatctggaggcaatatctgattggcaaccactgcgaagtatatatagatcacaagagtctgaaatatatcttcacccaacctgatctaaatctccgacagcgaagatggttggagttaatcaaagattatgacatgagcattcactaccatccaggcaaagccaatgtggtggcagatgcattaagcaggaagagctactacaatgctttatgcaccgaaggcatgtgtaaggaattgcagcaagagcttgaacgtctcaacatgggaatcgtagaacacgggttcgtagctgctctagaggcacgtcctacgctcgtggatcaagtcagagcagctcaagtaaatgatcctgagatagctgaactgaaaaagaatatgtgggttggaaaagcccgggatttccttgaagatgaacatggcacaatctgcatgggagaaagattgtgtgtgcctgatgacaaagagctaaaagatctgatactcactgaggctcatcaaactcaatactccattcatcggggtagtaccaagatgtaccaagatctcaaagaaaatttttggtgggccagcatgaggagggaaatagctgaattcgtcgcgctctgcgatgtttgtcagcgagttaaagcagaacatcagaggcccgcaggattgttacaacctcttcagatcccggaatggaaatgggaagaaattgggatagatttcataacaggtctgccaggacatcatcgggccacgattcaatctgggtggtcgtggatcgacttaccaaagttgctcatttcattcctgtgcatactacatatacaggcaaaaggttggcagagctctatctctcgagaatcatgtgtctgcatggagtacccaaaaagatagtatctgatcgagggagccaattcacttcaaagttctggcagaaattgcaagaggaattgggaacccggctgaacttcagcacagcctaccatccgcagaccgatggtcagaccgagcgggtcaatcaaatattggaggatatgttaagggcttgtgcgcttgattttagtggagcatgggacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43912 - DNA, 12193 bp, Oryza sativa
ctctctactttagtgcttccgtgttggtctagttggttatgttagcaaacatatgtgtggagattatgggtttgaatctaatgaacaaatgcgagcggacagaggggagtcccccttgtgcattgagagttagggccggtgtaggtagttgttttgtagggaggtatattataaccctgtctacctaattatttatattaatttaattcatattttccttttcgcagttagaggttgttcgcgggatattgtcagaatcttttgatgaccagagtcgtctgggggcccttgtatactcagctatttatctgaaggtttctccttacaattgttttatgtcaatggtcctataaatctaattttcctctctaggattatataatttggagttaataagaccgtataacagtttattcatagctttctttgattttttttatattttatttcagtggatttatacaggtcagatatcgtgctttgaagatggtggccaccatcggcctaacaaacatgctgagatatcgaggcaaatattccgtgaacttgaaatgatgtattatgggaaaaccacatcagccaaggttaattgcccctttcatcgtagtaacaaaatgttacatcagcatcagcattttcaagtattgtgattatagtcagatcacaatgcctttaatcaagatgaactactacaattttgttcccttaaaaagtagagtgaatagtgtccacgacgtattgtagcaggactctgctgctttattttagtgagagctattattttttccccttaatgctccacccaatcatatctatataaggatatcctttgattaagcaagcaatatgaaataattaatctagtctctcatgtaatcatgttcttcgtcccaattgatagcctccttgacctaagatcccttatatttctctgtgctgtccttggtcccattcgtatggtagttatcccaattaactgaggctaagcacatgaaaatggtccaacttttatataattgctattaaatgattgctctgctaactatgtaatgcttgactgttagttaaatcttcaggtggatataggagtagggcagctagggctagagccctactcctatgcccaaatattcattgaaattatactttaaaatttgaaaaatggaagacaaaagacaaatttatgtagattatactagttcagccctactctcgagcacattctggctctgccagactaacatttgggaaaaggtatatctattatttgccaacttccaattatgtttgtgcaggatgttctcgtgattcgcaaaattcatccctttttaccttcatttaagtcagagtttacagcctctgtccctctaacacgaattcgtgatattgctcaccggaatgacatcccacatgatctcaaggtggtgatccctttctgcagttttgaacaatctcttcattggattactttacttagtttgatcttttcatgtcgacagcaagaaatcaagcatactatacaaaacaaacttcatcgtaatgctggacctgaggatcttattgctacagaagtcatgcttgctaggattactaagacccctggagaatacagtgaaacatttgttgaacaattcacgatattttatagcgaactaaaagatttcttcaatgctggcaggttatctaatttacaattttccattttcctacttccatagatataagttttctgtttgctgaaaaagctaacaaaattgtcactctctttttgaacttatctatcctactgtgtactaaaacatccttatgccagttatagctttccaattcatgactacttataactagaagcagtggtaattttacggtgatagagatagacagatggtagtcccccatcgacccatgaattcacacaaagaaagataaatcaaggtcttaacttgtgaaaaacaccagactggtgctgctagtatatgcacatatttcttgcaataatgctggtattaagaatttaatatatttattcagggcaccagtgaaggtaaggctgtgttcttttggaagggttgggaacccttccggccttcccctctggcacacaaaacagagcggtggattagcacattattaattaagtattagctaaaaaaattgaaaaatagattaatgtgattttttaaagcaacttttatatagaattttttttgtagaaaacacaccatttagtaatttggaagcgtgcgtaaaacgagggagtagaagttgagaaaggggataaaagaacacacccttaggctgtgttcgaacctgaggatttgtaactcattcatcccgcatggaaaacgaggtagctcattagtgcatggttaattaagtattagctaaaaaaacttgaagaatgaattaatatgatttttttaaaacaactttcctatagaaattttctggaaaaaaatgcaccgtttagtagttcgggaagcgtgcactcgtaaaacaagggagtagaagatgggaatttgtagttctgaacgagccttataatgcattcaacttcaacgcagtgacatggaatgaaataaggaattaaactttcaatttatattgtcaattctgggtttcatgtaattgttcaccagggttagaacttctaagttctagtcaggcaacagacatgcttaggaggccgtgtgctgcctaatgcctatgtggctgcccttttagatgtacactagaataaaaaaaaaaagttgccatgtactgctaacctgcaatcaaaccttaagaagtaataacagattactacaaaataaatttataaaacaaaattgaaaaaaagcagatgtttagtgtgttagatattcaaatgcctgttggtcatatagtgtccatgtaaatataaattgtctaacctgattaccgatttcacagcctatttgagcaactggagtccatcaaggaatctctgaacgagtcaggcttagaagttctctcatcctttgtggaaaccaaaagggtaaactttgctgaaaccagttaatttttctttatatgtatgatcatcaattaattatctccttatttcctttgcattggagttgcggataatgctctaccagggatcactctcaatcagacacttctgtgctctggttacctaacataacataatcaaataaacttataaatacgaatttatgtcaccttgcattgcactatgtccttgttatttctatgttttgacagttgataccgacatttgttactttctggtatttcaatagaggaacaagtagtactggtctggcatcattgcttatcattgtcatgcctaactcatattcctttcgtgtttatcttccttttcagagtttggaccaagtggatcatgcagaagatttggataaaaatgataccattcaaattttgatgactaccttgcaatcattatcttctctaagatcggttctaatgaagggccttgaaagtggccttagaaatgatgcgcctgataatgctatagcaatgcgacaaaaggttatcttgtctaacataattgataagtggttgaaattggctgcatatatcacaagcgatacttgattacgttttgcagtggcgcctttgtgaaattagtcttgaggattattcatttgttctgttaagcaggtaactgtcctagtttcaactaagtgattttaattggtgctttctcacaaaccttatgaaattgtacttttgaattgccttttctttccattctgaaatgttagtttcgcccttcatttgtcttactagtcaatagtcgtcactttttgagattttatgttctttgttgattagtttgtatgcacttgtaaaatgcatcagtgctctctaaaaaagcacatacctttccaaactagtgggcaatcgaaaatttattgacactaacatgccataatcaatctttaaataaagtatttactttgggtatatatgaagtgggggctgctctggtgaaaactgatggctgcatgaattgcaattttttcttgattatgtcagaacataaatttgattgcatactagatttctctttttgatccagaaggaccatattggattaagtaaacaaattgctaggggtttgatagaaacgttgtatggttactgtattagtttgagttatcccaataagatcaactaatttaccactagaattctgcaatgagaaaccaagaattgcttgaagcctctctatcatgataggaaaaagtcattggatagatgtggacgagtgccctacctctttttgacccctgtttcaagcttatctatatcatgtggtgtggagtcttgttgaatacaaatattaaaggaaaatactgacgaatatggataaaaagtgaatgtagaggttgcactctcatgtgatgtagtcatctttagtgaagccatattatctatgtgcatatatagagtggatattgatctattcgagggcatgcagagtcataattgttaggtgaatctaatgcttaggcatcaaatttgttaaataaaaccagcagcttactcatgtgtacaaacaatagattgtaggcaactgttgtcataggtagtgggccgagaggtggaggtcctagtgagccgatgggttgaggccctagggatcagttccatcatcctatggtagctcagttggatagagttggttggataggattagactgggtctttccctccatcttatccatctatataaggatggattgtatcgtcatttggaattttggattaagcgatgaatcagtctctcccaacctaagtccctctctcatccctagcagccgtcaccatcctcccggcggtgtttacccctatgaaccctaacccataacaactgatgtctgaacactagaaatgtttgtaggctgctgggctaataagtttcctttgacaagatagaagtcaggatagagttttcctgctctaggatcagtagtaatcagagacctgcagagattgcaagcagctgtagtatatgttggttttggagcagaatcgactgaaacatgttctctataattggtagtaatgcaagctagcagaagtagctattgtagcaaactgaaaacaccttcagtccatcacctacttgtgtgtgtgtgtgtgtgaagtgagaagaacagtgtatttcacttgttcgacttttgcaacagtgaactaatttcctttgtgctttagtgaaaagatagactttgcagtctgtttttccaaataatgctaatgcattgcattgattaaaatggtatcaatttttgctgacttatttgttatgatttataggttaattcactccatgactctatgttatcatttatagcttcaaaataaaatcgtagctaggcaaacttatattactcttggcggtatcagtgagcttatgtactttgctctggtactataacagattcatcaatactcttgaagccttaggtggatcagcttcacttgcaaaggatgtagctagaaatactactctatgggatactactcttgatgcccttgtcattggcatcaatcaagttagcttttcaggttggaaaacagatgaatgtattgccatagggaatgagattctttcctggaagcaaaaaggtctatctgaaagtgaaggtgctgtttcttctttaatatctatctattttatatgcccatgcctaaatacctttattgtagtcaagactcagaaataccctgactgtttcttgtcatgtgtgaaggttgtgaagatgggaaatatatttggtcactaagacttaaagctacactggacagagcacggagattaacggaagagtactctgaagcacttctttctatattccctgaaaaagtaatggtgagtgtattaaacgaagctagaggaccttaactccattaatgaaaaaaaatgttcaatggtatacaactatgttcatattgtttgacgtaggcttagtttgctgttatcatggtatggtttgctcttttcaaaacagaaaccattgtgtaatattactgcttggtaagtcaggttatagttagataaatcatttttttccccatttcttgtcacatttcatcttaaatggtctgaaaaaaataaacccattcgcaacttgattaagaaaaagagtagctagatggacacgggaaattaatagcattttaactgctaaactgaacgagattatcacaacctgcttcagactcaaaccaaaccttcgtatggaaaattccttaatgccatataaattttcctgtcctagatatgccactgaaatttcgattatttatttgtcactgctttagtctaacaagataaaatcggtagcctacaagaggttttaatccttgcctgaaaatgtgactgttgaccaactggtgttaaatcttggtgtgagaggtgggaaatgccaaatttacccttgctttgcaagtgagggaagtctcgtattcctgttctgtcaccatgttaggtttattactcgcatttacgccattgtattaaaactaacacatgttgcagaaatttgttaaaaatatcccatagaaattaggggtttaggccaggttggggtttggttggcattaatgaaaatcccttctaatttctccaggttctgcggcaagaaggcatatatcctgatcagcatgcacaactgtatgcatgcagttaaatgaaacaaatatgaagatacaatgttgtcaatattattatccaacaaacttaaacgcatagtataataagctgctgagtacaacctgttggtgtggttgactgccattatggcaacacacatccgccaccccaaacccactcagctcaaacacctgtgttgtgtgagctaaatcctggatactgcccaccacctctgcccttctcctttctactggttgtgttgtccatcacctgagaaggatagaagctaagatggaataacatggtgaatggatgcctagggttattgtcaatccattttcacatgttgagtaaagcaagggtaggactgccatgtcggaacaattgttggcacgtcagctgagctgatcccgcaacattgacaatgattgcaatttcaggcatgaattaaaaagcagtggtaaaactggaagaaccaaaatttcaggggcatatctgggatcagacattttcagtggcatgtaagcatggaaaattggttcatggacaactttactcagatggtcgttcctaaagatttacattttttttgtgatatttgaccatacaagttttgcactcagactttttgtcttgtttggttatgtttcaaacttagattctgtgtggctgtcttgttaataggttattgggaaagcccttggaataccagataacagtgtgagaacttacacagaggcagaaattcgtgctgggtaatccttttctgtacagagtctggaaattgtggttttctggagctgtaatcaatctaattattctgaacctaactttttatatatgtctagcattgtttttcaggtatctaaactatgcacagtacttcagaaagcaattcgagaagtacttggatcaactggctgggatgttcttgttcctggagtggcccatggaactctgatgcgggtattttctgtaactaagcagcagactttcttgcattgaacttccttctgtttgcattgccttgtttcctgagttgccaccataatcctaatatgaaattttgtgcatatccattgacacagcccagggactgattggggtaatttggcaaggtaggtggctttgccctcagttctctctggtagagagagagagagagagaggaaggagggggggggaggagggagggagggagggcgagtactgattggggtaatttggcaaggtaggttgctttgccctcagttctctctggtcaagggggagagagagagagacctcaatttttttttccttgtagtgttgctgcagtaggaaacactccttgacatcttctgttgcaccaacctgattacttacaatagagcaagggaaccttagcttagggcacttcagacaggaagtgcaatatcatgaccataaatgtgtggttttatggacaaagacatgtttgtatatatgttttcttctcccaaatattcatcatcctagcttatagtctcctagtcctttccactccatctatcacagtccacccttcctctgtgcattattctctgaagttttattacacatttggaattttgggtggacgtcacatgttttgggaggagtataagactcatttagcattaaccaagatctttatccttgtcagagtggcattctgagtagaattttattttcctgtgacaggcaagtaactagatctaggtttttggtgccttcaattttcattagtgacatatagaaatttctactgtttccatttttctactctctaggttcttgttttctgttggagatagtacatgtttatttgtttcataaacatgcatgtaaattattgtatgcttcatttctaattaaattagatcagcttgggccagtgccttgcaagagacatttccttcaggttactaaataaggaatggttataatatcctcagtccaactagaagtttttcctgggcctgagttattatctggtctgattgtctatgttttgtggaaacgatttctttattcaggtggaaagaattcttcctggatcattaccttcatctgtcaaagaacctgtggttctaattgtagataaggctgatggagatgaagaggtactttgggagcgccaagttcttatttgctgatcttatcacccccataactgataaaccatggttttgctcattatttgataggtcaaagctgctggggataatatagttggtgttattcttcttcaggaactacctcacctttcacatcttggtgttagagctcgtcaagttagtcttactacactcatttccttttacttatgatggtgccgtttctgaaagctacttttgatatatttacaggagaatgttgtatttgtaacttgtgaatatgatgacacagttacagatgtgtatttgcttgagggaaaatatatcaggtcatgttctgttctaatgatttgttctcatcggaaatgttatttcttttgctttgatcttttgaagtttctgttttatttgttcaagtgacaaatatgcccatgattcttcctgtgtgttgtgcaaatattaatatgagagacgattaagtgacaactatgaccttgtttgcgactttagatttgtatgtggtgtacactttaaaattgctctgctagaaattttgaatcgttgattgaataacaggctgaaattttaatctcgacttgtgtggttgaatgttttcagtatcttgttaaaagtttcgaatatctagttgtgctatttaaaccagctaactcataaatgctttatatcatgatgtaatccatatctttatctccactattataaaaattgatagcatttctgccagaaattttggtccgtcacctccgtagctgtgctggtctcaaacacaactcaatcgctgggagatgcccttacactgtgtgagggagcctcactcctccctgcccccacatggctggctcctcagctggccatgacccaccaaggccgatgagcctacttccgtaagccaagatctcatcacctctcccatgcatgatgtggtgaatagttccacaggaacagtagcctaagcagacaaagcacatatgatgtcccttgtgatttgaaaatttgatttcttctcctattctctttccatttctctagatattttcttctcgttttttgccacttataaaaatcgacttacacccatcacatcaatcgtgatgtaaggtgtttgtttgccaatgtgttttggctcttctcttagcgtaataccggtagcaaggttaactccaagcctcctacgtatcaatagtccaaacaaccatattgggaatagattcttcacaagctgacccatgttagtcaacacaggcaccaccgcaccactacatcaaagcattgcacttcgtaacttcaaaactaaataccattcacaaatgataacaatttttcattgtaattcatcaaccaagcacacatgtcttgtgatgacgactaccatgtacatgcattattgatacttcattttttttcacttcttttgaaattgttttctccgatggcaatgcatgggcattttgctagtaatctttatagaaaaatatgacagtagggaatcatgagttgtacgatctacaggttttgtagataatagaagtataatttctggttactgtgccaactgcgagcctagtgggtgaaggactgcaccactgcaacgttggtgcttcctccaaagaaggataacttgcagcctctccaactagggatgcgcatatccatttcattgtgggccaatggtgcttccctccctgctaactacataagatgtcatgactctccaacttactgagttgtgccaaaaggaacgaatggggatagaaaaggtgcaggaataaagtgtagaagaatattccagcacacgccatgaattaggctttattcttggataataagcataaactaaatctaagagaaatatcacttccaaaaatggcctcagtttttatttaaatcagattgaactttgaactctgaattttcatctaccattgtaacagacttgcgatttaaaattcacttgtgtatttgggttagcaaattccatagatgctttctcgtccttaatgagaattaattggccttgttctctcaacagtatatctctaggacttctcttttcccttttggtggactgaaattaacttagtttcttacagattagaagcatcatccatcaatgtcaatctctcaatagtttcagaaaaaaatgacaatgctgtctctacagaaccaaatagtacagggaatccatttcaacagaaactccaaaatgaattctctctaccatcggatatcgagatgccactgcaaatgtctaaggtgatgcttcatttcttatctttgatagggatcatccagaaagatgcatcctgcattcttgttgcagttgctcttacttatttttcattccgtgggcattgccacagcaaaaaagcaaatcaggagtgaatggtagttttgctgctcttgagctttcagaagcttcagtggaatcagctggtgcaaaagctgctgcatgcagaactctttctgttcttgcttcattgtctaataaaggtatcaagttttcatttaaatttttttttgtctaagttcttttgcaaatggaactttacaaggtttgcaagatatcgagggactttaagtttaaacaagtatttaaataagctccaattattatcaatggggaagtcgaaagttttgaacagaaaatactaggatatattacactgcacgattttgtatgtaatcaaagtataaggtaaacaattctgtgcataatttggtggatcatccaagtgcacgtatcattgtattttctttattaaaaaaaacagtttgccaagacagttaaaatgtagtgctatccatggtaagttggtaactgatggaaagtgtacatatggttcacaggaaaacaattgtagtgactctagtacagggttgatattatagagttgtttactgctaatgtttgttgaatggaaaacttctaggtgataaattcataagagaagacttctaattattattttctgatattttttttactgctgtgtagtctatagtgatcaaggagttccagcagcctttagagtcccttctggtgctgtgataccatttggatcaatggaggatgcgctcaagaaaagtggatcactggaatcctttacaagccttctagaaaagattgaaacagccaaagtcgaaaatggtgaagttgatagcctggcgttggagctacaagcaataatttcacatctttccccaccggaggagactattatatttctcaaaagaatcttcccacaggatgtccggttgattgttagatctagtgctaatgtggaggatttggctggtatgtcagctgctggtctctatgattcaattcccaatgtcagtctcatggacccatgtgcctttggaactgcggttgggaaagtttggg

SEQ ID NO: 43913 - DNA, 9139 bp, Oryza sativa
tcaaatttcagtgaggagatggtggtgcacaactctggtcctgccaatggagaagtaattcgtcttactgttgattacagcaagaagccattgtcggttgatacaacctttaggaagcagtttggtcagcgactggctgcgattggccagtatctggagcagaagttcgggagtgcacaggatgtggaaggttgcctggttgggaaagatatttttatagtgcaaagcaggccacagccatagcatggatgtgcgccaatatcagtatggttaggtaaataaagtttgccgcatggatcgactgttgtaatgcgaatagccttcacgcaaaactcgaagggttgtcattagtgtttctttactattttttttggaagcaaggggaaaaaataatgcctaaattctaaaggaaatagaagtttaaggcctaactaattcaaatctttcatgccatggcctgagaatgctaatattagcacaaatcgtatggaaatgtaactagtattcaaacaactagatctcgtacggcttgttggaaaatccgttgtaattgatgtagaatttggcataacatgtaataactacaatgcgatgtttgttactgtacacttcaaaccatcttactgcatattcacaaatctattattatattattatgcgtacaataaaatcaccattagaattatatattactgtagtaatatgagacaacaccattgtttagttcctatgagtaggagctaccaccacgttattgattgattttaatacaactaacctttactcacacgttactgtgccaattgtattatgtgttacttgagacctgtagtaccatcatgaaatcaatatagtaacaatataactcgtgtgcagtaacagcgtaaatatatctactttgtaataatatctttcctttgaactgctttagctgttaccgacccacgccctagcccgtatgcatcgtcctctgtcctgttccagagactgtgccttctccccaatattgatatcctcttcctatgcatctcgatcctgatccctaggggtaggcgtttggttttcctagtttaaccggttcggtttttgtggggacacgggataaaattaggtgtcccacgaatacgtaacctcctatgcatctcgatcctgatccctaggggtgggctttcggttttcctaatttaatcggttcggtttttgtggggacaccagataaagttaaggtgccccacgaatacataacctcctaggaagttcagttacgcatgaaatgatataaaatcataaactttgatatatgatcattccatatattacccataaaaccttataaacaaataaacagtccaactccaccacaggaactgcctgagcatagaatgacctagaaatcataatcgtcccactctaacgagtcacgggatctccacgagcatctttctcctcatgatctgaacccatttatgagtacaaaaggtactcagcaaaacatgcttataataacataataaaatgcaatataagaagttgaaaggtttaaacccaaaccttatcagttatttcatagggtctgtcctaatacacatttaatataagcaacataattaaacatttaatttaaacaatattaataagcataaaatatactacctctgtcccaaaatataagaaactaggaccaaatggaacgttgatacgttgtattaggaaatatctcatccagtcctaggttcttatattttggaatggagggagtaattgtttctaataacttaaacagaacatgagctaataacaaaattaaccaaattaattattagccaattagtttaacttgtgctcataatctggaatccacccatagacacaactccattaaccgggagcacaacgcattcaaatactctatgactctgcaacgtctacctagctttttacccacacgatacccacagcagaccaggctaaaaagtaacaaggtgtaatattgctccacatctctcttttttctgcctagtaagttaaaggacgcttgggtcattgctcggagtgatccggccccaagtgtgtaccaacttacctccgcatccacttaacattgttcgttactcgatgggcaactgagaacttcttcggcccatagggcagttctgaactcttagatgaacctttaatgccatcagcttcctatttctagtcagataccttgaatgcttcttttgaaccatgggtcgatgactccaacattacttgatatctctatgctgaccggcctagatacaacctctttcatcaacatcgtaagtttgagaacaaagtgcaactataagttggacaccaaaggtggaggtggttggtcagggtatatcaccagacattccaaccaaggttgtcagtatcccgattcgtattctagtatcttacgatactacgatcctaccaagcagaaacgataccgatcccacctctcgatcctactattcattactacacgatcctatgaaatcttaggtggtatctcgattctacgatccctacgatattacaaaatattatttaaaataagatggtttggaaataatgtaaacgaatatgctcaagtatatatagaaatcagttaaatatatcaaaaccaatgtgatttctcatgataaatgtctatatttgcataatatatattattactatatatttttatatagaatggctatatataattaatataaatattaattaaacttttcaaaaaagaaaatctcatagtatcccgatactatgatacgatcctacgatacaatactactttgagcaaaacgatactacctaatatccgatcctaacaacttgattccaacactagggctgttattgagaaggagcatgtagccttcttgaatctttggctggacagatttgttttctgtggaactaagttgtggaccaacagctaatatgccgttgctttagggcccgtttagttccccaaaatttttttcccaaaaacatcacatcgaatctttgaacacatacataaagcattaaatatagataaaaagaaaaactaattgcacagttatgaaggaaatcgcgagacaatcttttaaacctaattaaccataagtgctacaataacccacatgtgctaatgacggcttaattagtctcaaaagattcgtctcgcggttttaaggccagttcaagaattaattttttcattcgtgtccgaaaaccccttccaacatccggtcaaacgttcgatgtgaaatccaaaaattttcttttccccaactaaacacacccttggtaaactagaggatggggcgccgttgcgcgcgccgcctgtatgaaataccggcacactataccacaccttgctgatccaatgtgtataactgataattgaccgtacgcaacaaggttaccgaatccagtggatttctgagattttattactaaactgtttggtccaactgccctgccaacatcctcgcatgcttccgatatacgtacataaaattcaacgaaatagtttcagcataacaaacacatgtacagtctagcagtgaaatagactaagactgtttagttcagcgcaaagttttgattttggttaaaattggagatgatgtgactgaaaagttatatgtatgataggttgatgtgatggaaaaggactgaagtttggatctaaactttagatctaaacacagcctaacacaatggctaagtattgtctcccaccgatggaaaggggtcagaaaagcttttgtattgcaccaatatcagggagcaattctgataatttctcgatcccaccgatggaaaggggtcagataagcttttgtattgcaccaatatcagggagcaatgctgataatctctcgatcctgcttcaacattaagaaaaacaaatatatataaattgatgcttgctgaagataatgattagaggattgacaattaagacatcatgtgctgagatttcctctattagatcaaagcagaagtaattgcaaatatctgacatgtagctagcgtatgaattgagttatcaatgctcaatgatcaccaatgcaataccgatcacacactgttccatgagattttgggtctagcagaagtgtatgaatataaccaacacatgtatagtagatattgcaggagagtagctgcaggctagatgaactttccattcatgcataatatagacaaaactgtagaaaaatatctatagggatagaactgaaatgtaatacctgaaaaatgtctttgtggctaaaactgaaatgaatcgagatgagaagtaagagcaagcatgaatgtaatacctgactacatgagttatgtgggccattgaagatcatggcacacaaacatttctcatgtaaaagcatatgattagttgtttaaaattgccatacaacttcataattagttgcataattggtgataactttgatccaaattaagacacaaccgagaacacgaagtatatatgaagtatgttctaccacctgtccacctctgtatataagagtacttacagtatgacatttttttatatataagactacttaaagtatgacattttttttctttatactcctgtatcgttattgtgcctctagataatctgcagctcttatgcaatcttagttacagtttggccttttgggcttgtacaactctaccatggccattcccatgcatataatacatagggttctatgtaagaactatgtactgcactgcttgcagcaaataccccaatccgaatactacagagtaaattgtagttgctctaaaatttttatatataggaaacccatacagaacatagttccacgtgatttgatcgctagtcagctaaaacctttttccatgttattcatactcacctatcgaatttattttctttagcatggcactataatactattcatacataatgcaagaatcaaacttgctatataaacatgtaccaaatgaatcaagccgatttgatagaagcaaaattagcagataaatgcaatgtataatacctcacagttgtattatccagctgctttttgcatcaattgccacaaatgagcattgcgtcctctttctcatattagttccaaaatttcttcaaacttcatgcatccctctaatcctccaaacaaattagacctctcttcatagaaacaaccacactacaaacgaattcatctgaatattgctttttttcaagaggaatgcaaaagaaaaagtaatctatcacttcaacctctctaacatgagaggactgtaaaaaaggaagtggggcaacgttgctctggtgagcatcagcaacaaaactggatagtggatcatacctgagagcatcaagctgctcaccgctgattaattttaccctccgccactgccaactgatctacaattgctatagatcaatggatctggcattaatatcgtggatcaatcttatgtagccaagaacaacctacgaatgaatgcgtgctgatattagtatattggatttttattcatgatgaacaaaaaggtattcatgcagttttaactaataacacgaggtcattaagctttgacaagctaagtgcaacatttaggaaatcttatataaacttaagcctaaggccttctttgaataaaaggttgaaagcagatctcacaagtaacttgaacatattaattttgtcttaagatgttaagcatagtagattagatgttctttcagtatagatattaacatgcatgatcaaagctatgagaaaactgaaaagtatagttaagcacccattgtatagtgaacaggtagaacaaccataaataaattctaggtgttaagaacaatctcaagatttctccaaacgaaaagaacaatctccagatactgatgagacataatgataaaaaattgaaacaaatagtgcacataatgatcgaacactcatgtttttccatataactgactatagattctaaataagatcaaataatttgttatgttacaagcaaaagcattgtaaaaggtacggggcatttcctgccaagaacatcatatgcacatttacggtattggcaatatgatcaaacaggttgtaacaagaagaatgccttaaaataaagatgtgtccattagcagcacaatgataatataggtagatagcatatatattgatgccaggacgtatatagcacaatacaagtatataataatcgcacctatatgatagtattctacctctggaaatgtacagtttagctggcaaacttacaaaatgcactaaccaggccaaaatagcgatgcacttaattaatcactttagcgacttggttgcggccttgtgtttctgagtaaagtcacaaactgcacgcagcactgaagaaaggtaataaaatgggatagttataaacatcagtaataaagtggtttggttaaataaactattttcacactgaggaaactaaaaacggcatacctctcttttttcccttcattatatagaacaacatgatcctatgactaactaagctattttttaaaggcacatcagcatttttataagttgagttctaaacaaaaaccttaagaataataaagataatgattggctgttcataggatgacagatgaattacaatgtagcacgcttaggagagcatgacatagtgcctacaatggactgttactgactgagatttatgtgatccttagttactctcctattatgggaatagatagctcagctattaatcttaaattctctagcatcctttaattatagagatatgcttactattagccagctctgatatgcgtgcacatttccgcttagaggtgttgggttccaaagccagcttcctggatgagagcaaaggctttaacagttgtcaaatgtagcaatatcattagtatatcatgatatctgttagtacaattgtcagtatgtaaaaaggaaatgcttacaacttgtactacagctcattgttgtttgcactgtcagcctcatctatatcgaaaggaaatacatcagatcctaaactacattagttattatatttacattggagaatggagaataactccagtgtagatcaattattatttgaccgaacaaaaaggtggttgacaaatagaaaacatgtctagttagacttagtatccagggcaatgggtgtttaaaatgtactgcaaaatatatatgtcttgttagtttatgtttaaaaaatttccccaatgtacacaaatggcagcaacagctgtacctacaggaattcaaccaaacaactccaactcattttcgagaaatacaactaactaaaaacttgaatcattatattattcagccatggtatacttaatgtaaattacaaaattctgaacgattataattccttcaggttaaaatgcatcgatgtcatgataattcaacatggttagagataataccaagtgtggtgtatatagatcaaagctcatgtatgagatgctaacatcctataggaatatttaagaatgtcattgatcagaaaaataggacatatgcaaattacaattatttaggtcaaactgaagatcaaaataaattgcactaagatgaaatattgcatctaattgggacctgagactaacagatcaaccaccgttggtggaaaaaatgctctatttttcaaatgcacaatactggtagctatacatatatgctctagtatagttgattggaaatacaaaaggtttctcaatgtaatttaggatctaattttgtataagccacagtaaattggttagatatatttacatacaaaagttcatatacacacactcactgcaatggatcttacttaaataccaggactaaatgaatatgtatatatgaccttaaattttgaacagagaaaacatgctacgtattactctgtaggaagtacacaccatagagggtttgaggtgaaaaaacaaaattctttacatataaaggtacatgccagttctaatcttaaattaaccctagaaaaaacctgaaagataagaagcctaattctagcatgcatattctcaagtgataaaatccatggcaaaatgatgcaaccatgtatgcctagaccacactcaatgaacttgaggaaaaaataagtatccaaaaaatttcaatcacaagaatagtctctaaaaggtgaatttaaactaaaaaaatctgcacataattatagagctaaaggaagtgttaaactcgttggagtgcattaaaccatattcacgaaggtgttgtttgtatagataatttaaagcaagaagtaactaaagtaagaaaatatatctcagctacaatgataagtgataatttgaagtattcagagctaggattacttgaagatactctcttgattcaacgagtagaaagaataaatgccaaactctagcataagtttttgtatattctaatcttgtagttctctcatgtaaatattgttctttatatatatattaatataggacagaaggagtttctcctgctgtttttggtcaaaaaaaaagggatatagtaacttgtatatgccttccagtaaaggtaacaacttgtaaattgtaacttgtatatgccggcagtagtaatatataaatatgttctcaaatagaatgaatagggcaagaaacatggtgatgcatcaattattttgacctttcaaatacaacctgtaagggtatcattcaatacatagaagtccacaaatttggtaaaccagagagcatcagttagatagcatgcacatggatctcacctctaaacctaagaacatttacaattcctgaaacaaatgaagaaaaatgtttctcgccttaagtggagatgatcagcgacatacttgtcccatactttacccagcttctacgctgaaatgcttcaagttatttaacccaaaaaaactatgagcatgccatgtggcttgtcaattactgattttaataggcgacactccgtagaaggcattgaaaagggcaggtaaagccatataatcaggatagaagtacataccaaatatgcatgtgttagcagatttcatgtggaacaattgccatcatatcttgtctgaaagcaaataaaatatgatgcagtgaaattcatcacca

SEQ ID NO: 43914 - DNA, 4743 bp, Oryza sativa
atcataccttgaactgtagatgaatactcacaaggataccataccaatttacgtaagtccaaatctataatctgtcaccagtgatatatattcatttttcagaagcgctgtagaacatcataaaagagaattgttattaatatgaggaggacacgaagagtagaactttcatgtgaaatcgacaaatcgtggcacggaagatccattacaaattaatcttaacacttcgcacatgacgcctgtatactgactcaaaggctcaaagcacactgctaccaatgcaagaactctctaggattcctaatcacgtattatacatcgtttagataaaagcaacatgataaggtacatcgattactcattaacacagcacattacaaatagcatgtactgacttgatgtaacctgtatgattaatacttttttttgttttcataggtcaactggatggttccacttcctaaatcccttttgtaataaacaggatgaaatagtaagacatctcattccactttcatatataaacctttttgcattgctcaattaaattatatagctttgccacctctgtatataatactactttatacagcccttttgctttacacccctgtataaactgtacatctacataatgtgcatttctctatgtaaccgtacttacagtatagcctttctagcttctacagctctggcatgactatttccatatataacttatggtactatggaagaactatgtattgcactactcaatccccttaaatgaccttttttatttgtactaaatacttgaatttgaatactacatagagcaaattgtgtttgttgtacaattcttttattataggaaacccatacaatatatccacataattaggttacttgtgtttataatccttcaccatgtaatccaactcaactattgaaatttattttatttcatatcgcactgtaatacaatccaaacatatataaacatgtatagtacgaatcaagcgaattcgatagaaccaaatttagtccataaatgcagttataatacctcacaattgtcttgtgcagctgctttttgcaacaattttctcagaggaaacactgcatcctgaccaaactctatttttcttcgcccaatcaaccaaaccttagtgtcatgttaccactgtgaatgttgtactgcctccgtctgcatcaccactgagaatctcgcctgcacgcagaggtcatgttttctattttctgcaagtatagttctatcaactattacaccagttcttgaactgtcaaataagataaaagctgaaaaaatttcagatcgggtgagctcaggcttttgtcgttctatattgcggaataataatggtaaattggaaatggtttatggtttattcttgtaaaagaaactctccctttactattgtccataacagattccccaaagtacatgttttccttgtactatctttctcacctgttgtaacataggaaaacaatatcagctaacattttttttcatgtggcaacaaatacggccgtgaaaaataatgcaaaccttgaggaagcagcggcgatggcaatttccgtaggcgggatgctagtatctccttccccaagagcatgggactatggtgacatgagcttgctctattgctgccagggctggagggaagataaagacagtcaacgaggagaagtggttggctggacgcttttctcgttcacctatgcacatcagcaaagtaaagaacaaagaattcacctatgcacatcagcaaagtaaagaacaaagaaaaaggggaaaaaatcaaggaaggcagaggattgagaagccgagaacgaaccagagactcaccggagtgattcaaatcttgcagtcgcgtgagggagaggatgaggaggcatgcagcaccagacaagggcgtcactggggcgacccgattctaggacagtgtgatgacaggcttgccttgtgagtaagccatctagatcgatcgtagcgccagttaaccgagcttctccccgttgaggtcgatcgtatcatcaccggatcgagcaccttaccacctcgaacgccccggaagatgttggggagggaggcaatgctcgacgacggcagcggctcgtgtatcgcaagagcagaagatagagggacgtggcgaagggatgctggtggcatgggcaaggatttcgccccactgctccatcaccaccatcccctccatcatccgtcaaaccaccggattggccggccatgaacttgccgccataagatgcgacggccttgagggcttggccatcggatccagcttctccaacggcggggagcaaccacatggcgcggcggcggcggcggaggcggcgacgcgaggggaaggcggaggcggcgacgcgaggggaaggcggaggtggatatggacgcggcggctcgaggcgacagggacgacgatggcgacggcgcgaggcggaggtggcgtcgcgaggggcaggcggaggcggcggcgacgggagagaaagaggatgagacgagagggaggaggggacgcgtgccgcggcggcggaggtggacgtggccgttgcggcggaggtagacgcgctcgcgtcggcgagaggggaaggcggagacggaggcggcggcgcgtggcggcgacggtgggagatggggagggagagacgagagggagaagagaagggggcggcggcgtctagggtttggttaagtgggtggcattttgcgaaaaagcccctatacttccactttttacagcgcactcctaatccgcaatttttccctccttcacatgcaatatccagttttttaaagggcctccaaataaaaaatcgcctcagagcgactttcatgaggaacctactccgaattatggacaaatctaagggctttttttgcaaaaaatacacccgagcactgtagtactgtagcaaatcgctgacgtggacacgccgagcggccgcccagcccgccgctcttaatgatttttaatggtaaagagatgcctttaggaaaatatctattggggccacgtatcaacttctgcataaaacaacaagaaaattgctaactggcaagccgataggatgtggagggcctcggtggtttgtccaactttggctcaatctctatacagttcaagttgctaatcgtatgtccaccctcgaagaatatgtatttccaacgatgccgatgaaataactcaccaatgtatgtcctttagagaagcaacatcaatctaccctagattaggaccattggatgaaaaacttcaaatttggtttgaacacttctataatggtttcccagaagcactagaatttggtactccaacactgatttcagttcctatgagctcccaattgatttgagattggatgaaatcaacagtgacaacaagtccagagatatatttatatcagttgtctcaccctgcatcctttcgactggtatatctaccggccgttactctgaggtctcttacgaattctatcatttaatggtggcagcccgacaactaggatatggccaactcccaattggtctatacttcttaagaaaaattcaaactaggggaatagtgatctcaactctcttatttgatcggctgctaaaccttgaaggacctatcttacgctctcctgccgatatcgatatccatcccatgcgcagccgattgtttgattaatggtggattgagtggatgaaacatctttacgtcttgggatctaacttttacttaaccatagtcaatccttcaattagcccttgcaattcataaacttctctaccgttaatccatttttattgtaggccgccgatgtccttccacaattagtgatagtaatcagccgatagtatatgctcaagctttattaccatatagggaaatagctccgactatcatcggtttcagtgccgccatggaagatatcgaaaatgttgctgccgatatgggcgatgaacctaccaatgttactaatgaagatgaagatgccagcaatatccctgaggacaaaagcagcaaagccagtgagcaacctcctcctctacctcctcgtcgtcggccaaccccgagcaagagtaaatattgcatccttccactctatctggacaacattcatatcttctaacactttattatctttctgaagacaaaaaccatatcagcttctactcatcggcaaccaactcctcgactgacacctcctccattggcaagttctctttgaactctccatctttcattttgatcaatactatcaattctaacatctaacacttttcagcctaaggctccatcggcttcccctcattagcggcactgaaaccgatgatagtatattagtgagggcgatgtcatttcaggtccgacgagcaagactgtaccaccatcctatttagcatgacgatgtggcacccggctccggaggtgagggaccgaatgtcatctgtttcacccgccacaccttcttcatctttggtgtgacttgtggcttcttagcaactgatttcacaggctttctagcctgcgcccctggctttactggtgtatttcttggacgaggcttgctcatttctgcttccttctcgaggaagttcttcatgaaagctgttaggttgttcgtcgttagcggcttcacttcaacctcttgtatattatgtggatttggcccgtacttgatcttcaccatagagcaccactccgtcctaggtcaaaactcaaacttttcctc

SEQ ID NO: 43915 - DNA, 3707 bp, Oryza sativa
cagagggcttggtcgaaatgctgtgtcccaattgagcaggtgattgtgggacaccccggatctttcttcttctctggaagtcggtggagtaaagcgttgctacactccttcgtcagtttcaccacctctgtggttgctacactccttggtcagttcctcctttgtcagtctcttgttgtttagaatgtccttcaggtagcaagcgtgtgtgggtacttgcatcacatccaaaagtggcacgtttatgtggatcttttgaatgacttcaacaaaacgagaggactgctcgtccacggatggctttcgatatcattgaggaaatggcagcagattggtatcacgatattcctgaggtgctatctcctctgtccctgctgtgctagattgagatgtatcctcgctgttcctcctagttcatgcagtgttaagatacggtggatcctaagtcgattttcctcccctcatgatgattgccttaacattttctatggagggttcgggttgccctggaatcctcccagtctcattagcagggactagagtagctagttgcgtcagctgagtttctagcattttattaaatctcagctggttttggaaagcggaagcaaagccatctagcttaacatttatgttttctaagatcttgtcattggcagctagtttcttgcttagagcaccggtagttttagcctgaataaaaacaagatctttcaaggaaggctggttgttgaatgtatcgttattgttgtcgctgcctccttggtagttggagcggagctggttccacccctgacctccttgtggacgagcaaaggttcaagcttgggggggattattgacagtcgttatcgacaagtttcgaccatcaatattatccaatatatgaagactagctatgctcgcaatgcataattcccaaataaaataattacttccactatatgctttgctactaacatttatgcaggagaagcattcataaatgaagagaacgaggtggaaatatatcgatcaatcagtcaaaagtctgccggtgatctacaattacacgagaaggcccaaaagtccaatttaataatcacaaatgggcctagaatgtatgtcactgattcaggggcccacatggaagtctcctgaaggaagctgggggctagaagagccatagggggtcggccgaccccttgttgagcccaatccagtcgcattttggccaggacaaaagggaggccgaggagaaagcagcaggccaaaaaccaggcctgttgggcaattcccctttggcgtggacgctccggatgaactcctgatggcggttgcggggcatttccgacaattcccatgctctacaaccgtcattgggtgctataaaaggacctcacctccttcactttcaatacacactcaagcaaggataaaagctctctacaaagttagtattagtgttagtagagtagagttagaatagttccaagtccgtggaggcttcggggagttcggtaaaggttctatagcttttcctttcttctttgtaagacttccatttatcaatataatattcttctttgtacaagttcggtactttattccaatcatagagtatgagtatcagtcttagtttattcataagtagtataatctgtgtggttaaaccttctgggatttccattgatgctggtataatgtctgattactgggtcataagtctgctctggctaggccgagagctatggctcggggactcagatgctctgcaccgattgcaaggctgtagagtaataagtagtaacttaagcatagggtttaggttatcacttatcattatttggaggtatattctttgggtgatttgcatgccgctgatggtgacagctcagtacgggcgtctcccccgcagtttatattcctacatacaatttcctggggttggatacaccgccgtatcctacttcgattggagggttatgacaggttgtcataagaaactcggcaacccggggtaactttgcgatgcatcgggagggcatagctattcttgggcttagttatgttgcattgttaaaggggttatactacatagtgtatactagttagaatatactaagatgttgtatactagaagtataggaatagaacttatctaaattactaccacttagctataattaggagaatgtaggagttagctaaatccttagctgtgtgtcactcaacccttaagcttaacttacccctgcatagaccttgatgtatacatgtaatatataaactattaacatagtactctcttatcatatcttcccttgggataaaataaatacgataccttggaatactcccgggtgaaatgctacaatggtatatccgtgcgcttgcagatcacatctgtaaccataatatacctaggttatttctagtgctattgctgggaattatatttccagcagtgtcgctaagaaataccaatgagtatttctagcgccgttgccggggaagataaaagattaagagtttactacatgttaataattttatatgttacctccgtatagttattgtcctttgttggcaaaccttgtttgttttctcttttatatgaaaacagggtagtacaggactggttctgatctgccgaccaatttcatatctggagtcactggtgaagtgaagccgaccccgtgtcgttcatcctcaaggttactctatcggcaaccagaccagccaattccgcgccaccagaattgcacgatacggctgagaagtgtggacaccctgagtattataccatccagtgtccaacgcgaccaccacatactattggagaagtgggatccatacatgcataaatagccactcgtcctcaatgtgtccatgatcgcggttgacaaccttctgttataataaccgaaatgtcgagtagtgagtgcaagacataaccgtaagatagcttgccagtccaccacgtcatatgcccgtcaaccactcgaaggtggcgaccaaaagcataccccagtgactcgctatccccaattatttcaagcgatcaaaacccgttactcatgcttagctagtccccaggaatacgactatcctcacactttcatcgcaagcaattaataaacatagcaagtaccataatagggttaaagtgcagcgagatacatgacacataatagggtccgaggtcccaacatacaacacataaatatagcagcggaagtctcaaatagagttcataagcaaaagataaaaccggtggtgccacaaccccactagggcaaactaaccgggcaagagccaagttgcaagagatcactccttgccctcgccgccctcggcagagcaatgaccacacaagaagcataactcaaaactggattccactcctgaaattgcagacaccgggttaagtacaagattgtactcgcaagtcttacccaaaattatatatacataagggagagagaagcatgcaagctttctagcctacagtgggtctctaggttcaacatttgcataatgctaattttattgagcaattaatgagtaaaataagcaaggacaagtaaatctagcatcattttaatttatggacagcaagaacataattctgaaatgtataagcaaatgagcccaaacggcgctctcatcatcaaccatgttccaccaaagtccataccaacatgccacaacatgccaacaccacc

SEQ ID NO: 43916 - DNA, 9545 bp, Oryza sativa
gaatagattatactctgaccagaggtgtacaactggtcccacatgaaatgaaaaagatcaaatgctacacaccccgtcgagtgcggtacacaagtgattcaagctcattacatgccctttcttagccccaccacaaccacctataccacgctagggttcccgacgactcagtcacgtgcgtgcgtgacgtgaccaaggcgggcgcgccacgcgggaggcatccctggccaatataggcacccgaggccctccaaagggctacctgccctcaagtctctccaacgtggtataaatgatcacagtagaactagtaaaggacaagccggtcccaaataaggcatgtggtaagtacgaagggtgcttgaatagatgtcaaaatgttcggtccttaacgactcagacggggcttcttgcatcagaggaaaaccaacctcccttcatcgccctatcacccgtccaagtccaacatatttcatcaaccattatttagtgtaagtgctcaagttttatgcccaataatgcaagttgtctatatacaacaattaatagcactgtccatccctacagttctattagcactaagcatggctaagcattaatgaataagacatcccaagtaatcccaaccagtggtaatagggtataaggacagcaatattacaagaactaaatgcataaataggttcttcccatacaccataaaccggcaatattaatatctaggaatgcatgcatatatatacgtatagattgcaaccaaatcatttttagagaaagcataggttctatatgtttaggtgcttgccttgctactgagggtagtcactatccttctcgggatatggctctttactctccggaatctctgaatctatcgaaaagaagcaatatgcgaataagagccaaataaacatgcacatgcaaaatgatcaataaattatgaaataaatacagtgggtagatcatattttaacttgaatttaggtgaaagaatcaccagattatcacttatggtttgggagatatgaaaatgacaagctcttaggtgctgaaaatggcagttctgtaaatattaacgtttcctttagtactttacaagtaaaatgcatttcaaaccaagatttcataataatgattatttttagagtaaagtacatcactcacagctcctaagaaaaattatttcacagctatatgtgttgtcattatttatttatggattttacaagttaaaaacataggaatgataaataaactcctaaacatgatttaagaggtagttttgccaaaaacaacaccacaacagaaaagagtactaaaatataagctcaacaaaattggtttcacaattttagcttttaccaataatttcttacgaatttattaagagctagaccactcaagggatacatatagctatttatatttttactgggaaaaccagtacaaaagttggtcatttttattttacaacatagaagatcacatttttcttaatccacagaaatttggttcactgaattcagagttcatatgaattagttatgaatttttaaaacgcaaacctctttcagctcaaaagctatctcagaaatcgatttctattttcgctccccttttctccaacttccaccggacatccctcacatggcagcaacctggacgtagggtcatgcgaggctaaggcctcgggctgatggcaagagacagagcaaggcctcggctgacggtaagagacgttgcctagggctgcttcaaccgaaatcaaaagagattaacaccggatgagctgcagccacctcctagctgcaataatggagatggatgacctgttgaatgttgctataaatgttcaacatggagagaattcaaaagaggcaccatggatgaaaaggaagctcaccaaatagaggaaaacacaatgctgctgctgcagccctacaggctgaaaccaccactctcttcttccttctcgatctctctcaactctccatgcatgtgcaagatgttgggatggattgaaagcttagatgatggggattgttatggtctaacatgcagagcttgagtttgggttctttgatgggatttgggggaggagaagtgagttgggagctcagcttcagaaggaaaagaaagaaagcaagggaagtgaaaggggaggaagaaggggttttcctttgcccaccttatgtcttgaggtggggagaacacccaagggtgggttttgggctaaaaaggcacccaaggttagtgacaagtgggcccaagtcgtggtggtctaagaggtaagggctggaatagaggtggaacaagaatttgggtagatttccggaattttcagcaattttacacctcttccaatatgacactcagttagttcaagaaataatagtgatataattttatcctttggtgtggagatagacctggacacctagtttccatttttcaaagtttcactcaaaattcaaaatattttaattctggtgaaaagatgaaattggttaggctgaaatttttaggaggccaaaacagagagtaaaaattccacaaaatttatatttgttggtgataaataaactagtatttgaataaattattatacatgcgcatttctgttcaagttattgttcaaatagagtggtttcaattttaccgattagagttaactttgtcatcgcctatgatcaaattgcaatatagtaaatatgaaatctaaaggacaacaaaagcacttctaaatacctggttatgatcctagggctgttacaagaagtccctttgcaagttcgctgctcgctctgttggtaacatgctagttgcaacccaagtcagcaggggagatggtgactttgatttaaagaccagctaaattaacgatggcgtaggcttgcttgttccgtggcaaggctaaggaggatgcaagtgctcattttcagtaattcgtggaaagtcgtagcacgtataccgtcagaagaatcagactccaattattgccgttctccctcctcgagagagcagaacagcggttctacatcaaccgtgcaacagtgaatacccgaaacaattgctcaacggccttcctctcaagattcttcctgatgggcaaggccaacgctcttcgtggaagaatatccagcttttagcaaacgagggatgaaaccattcttgaagcctgggaaaggctgttggaatgcgtcaccgcccgtcctcatcatgggatggccgagtggctcatccaacagagtttcttgaacgaattaacccccttgtcctgggatcacctggatgctgctgctagagggacattcttctcaagtacagtcagatgccaaccgattgagaagatgctctcaaatatggggtggagcgaggaacgactccaaactcgtcaatgcggcatgtacactatcaagtggatggaaatgctagcagctcagttggatctccttatgaatagagtggacaacaacgagaaggaatccaagcagggtaccgttaatgctctgggctctcacacgacatctgaggtttatggcaatgccggtcactctgggacggatggtccgaaaacccgtaaagacgtcatgctcatgaacaacagcaacgggaaccgtccacaaggagaccaaggatggagcattgctccatggggtagatcaagaacggaccgaagcacaaggaggtcaaagtaaaaccccaaaggacggatagcctcaacaccttcatgatgaacttccgggaacagggagaaacgaggaaccaacaataccttaagctggcatccaagaagtcgggaatacaggctggtcaacctgagttcctagttacgaagaggccgcagcctacgcctaagacaaagaaggtgtggtgggttaaggagaagacacccattcctgtacctccggaactgggtgcctcatcgagctaaaacatcggaggtacggtcgtgctcgtcggacctgaaacgacgtcgcccttgccaacaggtaaattggtagttatctcatatttattttccattgcatcgaaacatgtttgaattttcaaaacgcacattgagatttgaatttgaggaaaattattcaaatgaatttttgtgagcaaaataaaataaattttttggcaaaattctacacaaccaccttcacactagtcgttggaacccaacaggtacttgtggggccgattgggtccaccaggggtcgggccgaactggcctagcaccggctggctgcaaatttttgcagggtagtggctagtggggcccacatgccatgactagccgttatccatgcactatatatgtagctcggctgggagagggaagtcacaccactttaactcattttcactccctctcaaaaccttgctctcaaaattaattcattcaaagttttgcaagtttgcctcaaattcacacaatttactgcatttagtttagacactttgcatgtacaagtttgctttagttcggtgcaaggttaatcggcgggtatttgcttaacccccgtccgagtagtcttgtattctttctctttgttatagctatgaagaaacgactttcgggcatattcaagagacgatcaagctcacggacaagtcgacacaataagccaagtacaccttcttccgtggatgcatccatggaggaggcgtatgttccaccgaggctgtacgacaactccgatctcgacctcgtgggcgaccgggaattgcaaagcctactacatactgaaaaaccgaacgtgtgctcacacctgagcatacgactcgaccttctgaaaatgataggtacggatgctgagtttcatactatttagcgtgctataggttgggataaatttgcatgtgtagacgagctgggttcccgtttgcttaccatgcagtttcatgtgccttgctagaggtgggcgatggtgttactttccggttattccgcaaggaatatcacctttcttggaaagactttagcttgcatctaggctttgacaaaacatgcaaaattaatttcaggatgcatttcctgattttaacaagcgtatgttttggcaatgtatttcgggtctgtcatcctgtaaaaagcctggaactagggacatccataatcctaccttgaggttgttgcataggttgcttggtttcgtgctgtttcctagagctgatatccagatagtacgaacttatccttttgcatgccatggatagaaaaatcaagtttcacccgttcaacccatgatcaagcaatggttagaaaatgtgaagttgtctggtcctgttaagtgtatttctttggtgactcatttagcatgaagagttgggactatgcttgatacgcaagtatcttgtattcctgttacccgctcttatgttgatgaggcctatctgattcaaggtcacatactgaaacatggtctaaatgattgtcacgcccggaatttctatccaaaattccaaacgcttacatgtgtgttaaaccctcgtccaggaatcaaccgaggcacacaataacaaattgataatagagtactattaaatattcgcaaataaaaaaaaattattacagaggtagatagttcctctcaaagaataacattctacgcagcggaaaaaaaaactataacaaactacggaacagctatggcaactccactccacaggcatcttaaccaagaacaagcctaatcctccagatcatcaccttcactgagatactcctcttctgatgaatgaatattgcaagaatgagcatatgacatactcaacaagacacacagcaaatatgcaagtgcacaggataacaaaggatggcataatatagatcatttgcagaaaacaacatttaataaatatttaagagaataataaaaacagttgaataattaatcaacattaaataaacaccatacaacacacccgtgttgcataggcccaaccacatttgaacaaccaaccccagttgaacaaattaaacctccaaaccaggaattatccattccaaaccaggagtcaaattaattatcacattattaacattgatgagtagagtgagactaatcacgaaaaacattgctcaactcacccataaccgcgggtacggctattcgaatagattaaactctgatcagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccatggacttctcgccacttctcagtctggcgcactataatgaatcacgctatacaaaagataaagccgttgcccacgctggcttgtggctggcacgataaatgtttcacaacagtagctcgcgaaccggtccttaattgtcatgagcacaaccatcaaaaccatatgctcacaacccaccttaaccaggttttaattatcaattaattaacatcgcacgattaaccatcgtgagctaccattgaatataaccttaattaataataataataataatttatatttaacccctttagttagctaatgtttctaagcaaggctaagcaaacttacatatagcatttagccgaaccaatccaatatataaggttcatgctaatcaagttataacccataggaaaacaaagtcatcttcggccattaattaattgggaaaggttcaccacccgattgacattcgaaaacaatgcacagttgaaataaaataatagctttaaacgggatcaacatgctcaaagggttgtttgggatctgtgtgacttgccttgggcttccgcaaacgcttcggaaccttcctcaacggaaacgctctcctccggaacgtcggaaactaaagcaattaaacaaaaaccaacaaaacagtacaacaacaagcataaacagtatatgtggatatttttaacatgtagatcttgattttagaaaaatttagcaacttgaaccactcgaaacggatctacggttatttagttatgattttccgaagttttaatctattagaaaattggaaaaaaaggaaaagaaaaggagatgatgacgtcagcatgacgtcaccccacggtagccggctagggttggcgagctcgccggagattagatggtcggccgcggatttggagggcacctacgcgtagaggacgacgaggcgaacccaacggtactcaccaaagtgccaaacggcgaacgatgacggccggcgactaggaagcggcggcggcggctcgggttggacggcgacggcgagctacggcggtcggcggcgaagggggacgggcggtgtcacgcccagaaattcccgaatagaattccaagcagaatgtgcattaaaatccccgtccaggaccagccggggtacacaaacgacaatgttgacatacagatccacgtcttacaaacatcataaagtcttacataaatgcagcagaaggaaagaaagacaacaggagctaagccttgactaaactgcagcgggaacaccactccacaggcatcctcgacggcacggacgaagcctactcctcggagaaaccttcatctgacccgaactcgaactctggggttgggaaaagtagagcaagactgagtactacccactgtactcagcaagtcataccggaatagaggtatgatgcagggaatcatcaaagaaaagctaaagtggttcatttgcataaagcgggcatttataaacagagattgaaagatttaaacagttgtaaaaattaagcagtattagtcatccactgtccaacgctacaccacgttgcaacaggcccaaccatccacctaaactatccaaattaaaggattacactaaggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggaccctctagccaagcacaccacacctcaggtttcacccccgtccccggcgggcaacgggcagtcccctctcgtgcctaggtgaatccggaagccgcataggccgtcgcagggcccatccaaactccatcacgcccacccttgcctggatgcgtcgactagagaaaagctacactacaagcccagccgttgcccacgctggcttgtggtaagtacgataagttcttccagggcatcccgcgaaccggtccttaattgccatgggcgcgactagcaaaaccatgcacccacagcccaccatgtgatacattttatttaaccaacaccagcgcggtggtactaatccaacattatcatgtaaacctatagtctaggttttaaattgagatttccccattgtgtgctagttgaactaagcatggctaagcaattcctagtccaaagtctaatcaagttatgacccaagctaacaaaggagcatggtatccaaaaggcatggctgtaacaataggtaaccatccccagtaatattataaaacaatgcaatatttgaaagaaaacaatagagcatttgcaatatagggtcaacatgttcaagtgacaagcatgacttgccttgctctgctgctggaggaacctcggcgactatctcaaagtacaccggagcgtcggaagagccggaatctagcgacatacaaggcaaacattgcaaacaggctataagactactgaaacagggaacaaaaccatttttaatggattctacacatttttcctgatttactgagacttgaatggacttaaacggagctcggatgaattagttatgaattttagaagattcactgtgtttattactataaccaaaatccttaaatactttattgcgcaataaattccagggctgacgtcagcacgggtggcgcggcgccgacatgcggggcccaccggtcagcggcacggggaggagagaggaggcgtcggcccgcgggcccaccggtcagcggcacggggagggcggtctaccgtggaccgggaccacgcgggtgatccaccgccgatccacgggaccgacggcccggatcgccctcgggccgatcggacggacggcggcggcggcagcccccgggctcggatcggcatcaaagccgatcggccgacccggggctagcggcggcggtgcgtgcgcgtcgcgtcgccggcgacggcatccggcggcggaggcgacgcgaaagcggcggcagcggacggcggcaacgacccaaagcgacggcgagcgcgggcggcggcgacgcacggggaaatggggaaggagaggagaggagatgcctcaccgagggtggccggcgcggaggaagacgatggcgaacggcgacggcaagccacgggaggcgacggcggccggcggacgagcttcggcgtgccctaaggaaggagaagagagggattagagagagggagatag

SEQ ID NO: 43917 - DNA, 1472 bp, Oryza sativa
cggctgggccggcttgggccggttcggccgcgcggagagagaagagagttgggccgaaatcggcccaacggcttaaaaggggttttttgaacttttttaaataaaacaatttgtgaaatgttgtttcaattattaaaaatacttcccttgctcaattaattcccagaaaattctagaaaatagaagagcaagcataatatttaataaaattttatctagctcattttcatgttgaaaaatttcctagaaaattagggtttagcttgtaggcttttaaaataatttctaaaaatgatttaaaatatgcatttttaatttagtcgatttttagggcgtaacaaacctaccccccttaaacagaatctcgtcctcgagattcagaagaactgacgaacagatgaggatgagctgacttcaattcatcttctcgctcccaagtggcttcttcttctgaatgattgctccactgaaccttgcaaaaccgtataacgcgattcctggtattcctctcgcttacttccaaaattctgactggcttctcaacataagttaaatcttcctgaagctctatacgatcaggatctgcttcctccgtaggtacacgtaaacatttcttcagctgagacacatggaacacgtcgtgtattcccgccattgacggaggcaactctaactgataagctacttcacctcttcgactcacaatcttaaaaggtcccacaaaacgcggtgccaatttccctttggtttggaaacgatgaacacctcgtaatggcgtaacccgaaggtatacataatctcctcttcgaaagccaaatctctgcgacgattatcggcatagctcttctgacgtgactgagcaacgcgcaacctttcttggataatctttactttttcttctgcctctcgcaatatgtctgtcccaaaaacttgacgttcaccggtttgatcccaaagaatcggcgtacgacattttcgaccatataatgcttcatacggagccatttgcaaactagcttgataactattgttatatgagaattccgcgtacggcaaattcttatcccaacttccaccaaaatctagaacacaggctctcaacatatcttctaaaatttggtttactctttccgtctgaccatctgtttgagggtgataggcggtactgaaattcaaacgggtacccatctctacttgtaatttctgccaaaacttcgaagtaaactggctacctctatctgacactatcttcttaggaacgccatgcaaacataccactctggccatgtataactctgcaagcttattccccgtataggttgttttgacaggtatgaagtgagcgacttttgtcaacctatcaaccactacccaaatagaatcatgtcctgctgacgttctgggtagaccggttataaaatccattcctatttcttcccacttccactctggaatcttcaacggttgtaaca

SEQ ID NO: 43918 - DNA, 1038 bp, Oryza sativa
acgtggggagtggggagggagagagagacgggattggaaattcgaatcccggccatctcgggcgcgggcgcgagcgggagagagaggggaatgggcgcggagagcgcggcgcacgcgcgaacgtggccaacgtggcccggagaaggcggaggcgtgggcgtgacggccgttacgagcgaggcggcgcgagcgggagaggcgggaggtgggagacgggtctgacaggtgggtcccacctgtcggcgaccccgggagggagggaggcgggcggccggctgggcctcggcctgcggccggcccagcagggaggagggggaggaaaggaggagatgggccggcggcccatccgaaagaaaggaggaaagagagaaaaaggaaaagaaaaagaaaaaggaatttttttcctggaattaaaaattgcactttggtgatttttaattggttacaattatttctagggctctgaaaattccactaaaaatcctgttagtgagtttcgacatgtagaactcaagaaaaattccacatgccaaatccaattattatttgcattgattttcaagggtttactcttgctttgcaccggtatttttcttagggtcatttataaattcaatttttggcttaggaggagaactacagggtgtgacaggcggccgagcttcctcacctccgtgcgcacctaacggcgacggcggcaagcggcggcaacggcggaggcgatgcggcggcgcggctggagaaggaagatgagtccgacatgtgggccccacatgtcggtctccacaggagagaggagcgggcggcgtcggctgggccggcttgggccggttcggccgcgcggagagagaagagagttgggccgaaatcggcccaacggcttaaaaggggttttttgaacttttttaaataaaacaatttgtgaaatgttgtttcaattattaaaaatacttcccttgctcaattaattcccagaaaattctagaaaatagaagagcaagcataatatttaataaaattttatctagctcattttca

SEQ ID NO: 43919 - DNA, 769 bp, Oryza sativa; identical to SEQ ID NO: 39220

SEQ ID NO: 43920 - DNA, 5181 bp, Oryza sativa
aagtttcatgagcttctttcatgatagtatctttcaactccttattttctgggacgcaaattctttctcccaaccacacagttccttgctcatcttctacataaccgatggctttacctcttctcatgttctttttaatttcttgtatgtcaggatcattcacttgagcttctctaacttgatcaaacagagtaggttgagcttccaaagtagccacaaaacctttgctgactattcccaagttcaacttttcaaattcttggcataacttccaaggtaaacgtcgaccttctgacatattacagtagcttttcctgctaagagcatcggctacaacatttgctttccccgggtgatagtggatttccatatcataatctttaatcaactctaaccatcttcgctgacgcatgttcaaatcaggttgagtgaaaatgtacttcaaacttttatgatccgtatacatctctgtacggttaccgaaaagataatgacgccaaatcttcaatgcatgcaccacagctgccaattctaggtcatgcgttgggtagttattctcatgaggacgtaactgcctagatgcataggcaaccacctttccttcttgcatcaacacacaacccaaaccgtgtcgggatgcatcacaatacacttggaaacctttcctcgaattaggcaaaattaatacaggtgcagtcactagccttttcttcagttcttggaaacttcgttcacaatcctctgtccacttgtacttcacttccttctgaagcagacgagtcattggtctggcgatctttgaaaagttctcaataaacctgcggtaataccttgcaagtccaaggaaactacgaatttctgaaaccgtcttgggttgcttccaacttaacactgactccacattgcttggatctactgccactcctccagacgagatgacatgtccaagaaacttcacttcggacaaccaaaattcacatttactgaacttggcataaagctgatgctcacgtagtttctctaaagctagacgaagatgctcctcatgttcttccttcgtcttggagtaaatgagaatgtcatcaataaacaccacgacaaacttatccagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcacctttcaattgatcaaagaggtcatcaattctgggtagaggatacttattcttgatagtgacctcattcaacgctcgataatccacgcacattctctgagtatgatctttcttctccacaaagatgactggtgctccccatggcgaagtactgggtctaatgtatcctttctgaagcaaatcatccacctgtctcttcacttcagctaactcattagctgccattctgtatggtctcttatggatagggttggttccaggtaccaagtctatccgaaactctatgtctctcttaggtggcagacctggcaaatcctcgggaaacacgtctgggtagtcttgtactatgggaatctcttgtagagcaacttggtttaagttcacaccatgagatttaggagaggacacaaagaaagaaacggtttccccattgctactagttaaagtcaccttacggttgacacaatctataactcctctgtgacgagataaccagtccatccctaagataacatctagatccttggattctagcaagataagtgaggatgggaaaggaacttcttctatttctatagtagcggaaggacaatactgtgtcgaaaatacttgattgcctggggtgttaactagtaaaggtctcccaagactaacaacttccatcccatgattgctcgcaaaacttttagacaaaaaggaatgtgtagcaccggaatcaaaaagcacagttgcgggtatagagttaacaggaaacgtacccaaaaccacatatggtgcattctgagcttctgctgctaccacatgattgacacgtgcctttggtactggaacattggagttgttcggagctggagcgttcttcacgcgccgaggcttaggacacttatcagcataatgtcctggatcaccacaattgaagcacaccactggtttgcttccctgttccttcctgacaggctggttctgagctggagttgctgcaggacgagcaaccacgttgcggttgtcattgccacgattaccagtattgttgttgtagaactggcgttgggggcggataactgatgaagatcctccttgagggtacgatggagcttgaggtccaataacgagacgtggcctctggttactgccctgttgtgccttgaattgggcagccctgcgcttcttctgctccatccggttatacttgtcttcctgacgaatcgccttgtccaccaattgctggaaatcccggaaatccgtagacatcaaggcataagacaactcatcattcagtccctctaaaaacttctcctgacgttcttcatcagtgcgaacatcctctggagcatagcgagctaaacggttgaaatcatggaggtactcagtgaccgaacgagatccctggttgagtgctctaaattctctcttctttagagctacaacacccgctggtatgtgtgtcttcttgaaagcagccgtgaattcctgccacgtaataggctctccttcagccctgccttggcgaaaatgatcccaccattcggcagcaggtccatgcagttgatgcgaagcaaaagaaactttctcctgctcagtacactggatcaaatccaacttcttttccaccgcatgcagccagtctcctgcttctactggattggtggtgcttgaaaaggtagggggtctcacacgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagtagctccactaccacttccacttccacttccagtgcgcgtgttcaccatctggcgataagcagagacaacaggaaagaacgacagagagacacccttagaacggagttatttaattaatttaaattctatattgctcttaactgtgtatgattacatttaagttgcactaacactatctcaccaactatcttacactccgacaagcaaaagagctagactcatgctgttacatcccaccaatgatgtaagcaacaactaaaacccacacactcacaagcaaacttaaacaagcaaactaacacagcgaactacggcaacgatctactaagcgactaaacccgccttgtgtcggaacgaagcgatggatcttcttcctctggagtagctggctctctttcttcagggtcttcctcttcttcctcatcacttatgatgtcgatgacaggttcagcacgatcgggcacagcttcgcccatcacacgaatcttcgaggctaactggagacgaggtggcggacaggttctctttcttgcgacgaggcgaagcttgggtgttggcggcggcgtttctcctttaagttcagctaattccttctgtagacggtacaccttgctctccaacttgcaaatcttgcctcgattccagttttccctgtcatgagctgctttgtctcgctccacacttactgcatccatagcactaagcatatgcaccacatgcatcagagtggcactctcttcaccatcaggacagatataggttccatagtcttgaccatgaggcttgtgaggatgatactagaaagctgatgaatccaactcttcttcaaagcgttgacgcaactctccaatggccaccaaagctgcttcttgacaagcatggctgtagatcttcctccagctttgaacttaatagacggaaggtcttcacgatcactagccaacgtcacacgaacatgacacttctcctcgtcggggtcatgggaaatttggcgatactcgggagcaacttcataacctacctcaaaaaccatcaatcttagctccctgacgaatcctaacacctcgatcaaatttctcggtgaatggggcggcatctaaagaaacatagaagggaagaattaatgcatattttaagttagctgcaccaactagacttaactgattttgaccaaaaaggaagaaagataaaagaaaagaccgtacaaagctattatataaatatatttttagaatttaacttttttggacagagacaaatatttttttttgacaaataactaaaataaaactaaaatacttatgatctattataagcacggtacagtgtcaccacaagaaagatgagtagtactagtgctatcatgattgtatcgataccataatagatgtacagtgccgactaatcaataagatttggtaaagagaaaaagaaacattttgagaagaacaactttttgcttttaaaagaaaagaaattgaattaaataaattttgtgcataaccttgcatgtgctgccaacttatttaatttataagagaatagagaagagcagttctatattttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaataacaaattgataatagagtactattaaatattcgcaaataaaaaaaattattacagaggtagatagttcctctcaaagaataacattctacgcagcggaaaaaaaaaactataacaaactacggaacagctatggcaactccactccacaggcatcttaaccaagaacaagcctaatcctccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaa

SEQ ID NO: 43921 - DNA, 2416 bp, Oryza sativa
  unsure (1)..(2416): unsure at all n locations
gcgatgcgtcggcgcggctgaagaaggaagatgagtccgacatgtgggccccacatgtcggtctccacagaagagaggagcggccggcgtcggctgggccggcttgggccggttcggccgcgcggagagagaagagagttgggccgaaatcggcccaacggcttaaaaggggttttttgaacttttttaaataaaacaatttgtgaaatgttgttttaattattaaaaatacttcccttgctcaattaattcccagaaaattctagaaaatagaagagcaagcataatatttaataaaattttatctagctcattttcatgttgaaaaattttcctagaaaattagggtttagcttgtaggcttttaaaataatttctaaaaatgatttaaaatatgcatttttaatttagtcgatttttagggcgtaacaatgattctcttatgtttttgtttcccggcaatacaaatgagattccgttatctaacccggagtttcatttgtataactgctgagaaaactaaccatttctctccaagcggtgttgcctcgtgaggtcccatgcagggtaacatgacgaatggcgagagaagcacctcaggaggcgtcttcttcttcaccaccagtgcagaagtatggagattgttgggacccgaccgtgcatgcccccggttggacccaattcctgcaacatgatgctggaggttcgtcctggcagagtgctagcgacagccggtggtatgagccgcaggagctgcactggggttattcgcgctccttcagttcaagtggtctacctccatcctcttggatgcattgctcaatctcctctcgaggggatctgggaaaattcatccgggggatggatacacttgaactgcaggcagggaacatgcagcacatgctggaagatcatgtggtacagtcacgggaatggcagcagactgttgatgcacagcttgcaaactttaacactatgatccaacaacaacaagttgactggcaagcgtttcaccgctaccagggatttgatccccgccatgagccatagcaagaagcaagcttggggggccactaaggtaacttgtatcacattgcatatttcccttttcaaattgcatgtttaaatttttgcattgcatttataaacctaaaaataacataaaaatttgcaaaactaaaaataccaaaaagataggttagatttaatatgctaggtaagacatgcttagttcttcatgttgaaatgatgaatagttgctctgttttatatctctcatatatgggttcatggttaagtactccctcaagaattgaataagagtagccaacaattatctgggaacctgaggtaagtgagctgcactttgctgatctgagtctagtgttggtatttgatacggttacagataaaatccgcaagcgcacggatataccgatgtagcacttcccctacggagtattccaagggtatcgaatccaagggaacatgtgtgatcagagcttcctccggttcatccaaggacaccaagcaattgataggccaggatagagaggatttactagtgagaaacagtgtagggaaagcttaattttaatcctcacgcaatacttcaggcactggcaacccgctgttcctagatgtcgctctacttcgtatccggacagggaggacttaagtgctctcgagggctgtcaccacctctacacccatctcaacgtactgtgggatatgcagcaattactggataataattacctaaacaccacgtctaagcaattaatatctactttagtgtttataactcaccaaagcaatcactatattttagttgattatagtgaacaataatcctgtatgctaattaggaactaaccaagaggtaattctcacaagataaatctaaattactcaagaagaatattatattgaattcagagtaataaacagaataaaagaaataggagaagattaccgacaactccggaattcttccgactccttctactctactctcttcctattctagtatacaatatagtacaatagagccttttataatttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcagga

SEQ ID NO: 43922 - DNA, 21116 bp, Oryza sativa
  unsure (1)..(21116): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggagttagtgggggataactttatagtaagataggattagtaccattaactcccaatttaatccgtccttagatttgaatttaacttgtacatttcattttgcagtgcaactttgcttatgttatgcttgtatttggacagaattttcaggtattgttcttcgcctttcttgattttatttaatttgcatacattgccagatttaggtatccatatttctcaattagcctctctaccattgggagaattagttacttgtactatttccagcaatggttaatagtaacacactagtacagtagtattacatgagtcaaggatataaataaaactatgcacttgaaatcttaaactgattgtgcatcggagttaacctacactgtgcatctttttttgtctgcatgctttaatattatcaaatgagaatgaaataatttaactcagtctaatgtatagaatatggttgaaaatttcttagtctgttgtattcattgtttcactagctggtttcattctttgatgattgggggctacattttatgtattgtcagaaccatgaaatttggcgaggttcacgaatttgactgacataattctgttacttatggtttagcaaccatatagcctgttagagttttctgattgtatctttgctagatatagccatgttaaaattttctgtccagatttcactgatggcggtggctattttaaaaacaggttatatctattctcacactagctgggtttatttcatatgaaaagaacctggttcttgaagatgcattcaatcaaaatatgcttggttcattccttctggtaagacagtttggtcacaattttagaaaataattttcccaaaacagaaatgttccaactaatagatcctcaatttgagtttctagtatatttggaacttatttttggtaagtctgtatggagtaacatttaacttcatcttacaggcaaacatcctaactggtgtagtaaatctctcagttgacacactctctgcctcttccggcaccgccttcatgattttgttagtatactcctttactctatgcatgattgctgctttagctcagttttgcggtattaggatgaaattttggtgaattcaagagttatctaatacgatgtatgtatattaattactttctcagcaagctttcttggaataaagccaattgttaaaccaattagtctttcctgtcatctattctgcctgttttctgtatcttagacctagatctagatgattgctctagttccgtcccatatgaaaccttcaacgttctgagaagctgcaatagctaagccaataggttatcgtgccgtgtactttaagaagacatatatcacagatatgttggctaaattacgatctatgaacagctcattgttccattaattaggcagtactcaagaatttgacaaaactacctgcttagcattcaacgacccaaccttaatttctttcagaggaatccaacagataaatggtactcattccgatattttttgatgtttagcacaaaaacttataaaacttaatcaccactcatttctcaaataattagttttgggaccacctatacatttgttgacaaattttctcctaaaaatttgaatttgacaggtgtaattatagtacaatcatagtgtaattacactgtaacttgtatgtaattacactgtaacttgcatataactaccgtgaaacttgtatgtaagttccacataattttgaatcgttagatctattacaagatttgttctggtgaggaagaaagaaaataacagtacacacatgtgtgaaaggatttgttcccacagcctcattttaccgaaataagatgttatggagagatttttgaaagttacatacaagttacattatagttagtgtaattacatgcaagttacagtgtaattacactacgattgtactgtaattgtatctgtcaaatttttgggagaaaatttgtcgacaaatatatagcaaaattgttaatttttttagaaactatttagaaattaataagccgaaaatagggccagcttcaattgggccagaatcagacacacatcccgaataggaataagtccactttgactcccttaaaaattgacccgaatctaatccgtgaccctcaaccgtaaaaccggataggatgactccccgaactattcaaactagtgcaatttgactccatcagtggttctggatggcggttttgctgacgtggcgatgttgacctgatctgtgttgttgatgtggcacttatatggcattaaaataaaaaattatatgggctccattcgtcattcaaatgaaaaaaaattgcgaggcccacatgtcatcctttatctatcctccttccccccttcctttctcccttctctgtatgtttctcttcctccagattcggtgcggaatctggagtggcggcggcggcggcagggtgagggccggcacggaggaaggaacttgagcgggtcgttcggcggcgacggcctcagctcgccggagaaggcgggggcgttcggctggtggcctcccccacgatggtgccgcgccaggctgggacgaacgagagggctaatgtagacggcgaagcctgagacgccgctggccccagccgtgcctcttggtctgcgccggcagggggtgccgcctctgtttctttctgcccgaagaacatgcatgtgcatagcgttgcctagcagatgcaagtgcagcgccggtgtggggtagcaaggcgcggccgccatggaatccagtcgaattttggcaggaccagtagctgcaggacgaatccgtcctaccagcgtggtccacctgagtcctgcagatcttgaggtcgtggactggtctgattttattctttgtggtcactgtttgcaaggtcttcaggtcgtagacaatagctacttcattaccgaggacaacgtcggcatgttgaagctcgccaaggaggctaacagcatcttggttcgtcgatcagcgcattgactcatgttaccaattcgcctatgaaaattgctaacatctaaccgtgacatcctgtgattaattggtacaagcagtttgactgccgtatcccgcgccggagacggtgggttgcgcagtggtgcactcaaacggccacaccgcggcggccatgtccatgggcgggctgatgaacaagatgaccgggcgcatcggcaaggccatcatacgctccacgctggcgcgcgacgtcgccgccgtgatgaagtaaggggcgccgggctgcaggaggccatcgactactgcgtcaaggaacggctggacaaagggttcatcgggctcatcgcggtgttcggcaccggcgaggtggcgcacgggttcaactgcaccggcatgttcagcgagtgcggctgcaggagaaaagagagagaagggagggagaggggggaggaataagggttggagagagaaaggatgacatgtgagtcccacaatatattttgtgtgcaaatgacagacgggccctacaaaatatttttaattgtaatgccacataagcgccacgtgggatgaagaccgggtcaacaccgccatgtcagcgccacgtcagcaaaaccgccatccaaaaccgctgagggagtcaaattgcactagtttgaatagttcggggagtcatcatatccggttttacggttgagggtcacggattagattcgggtgacttttaagggagtcaaaatggactttttcctcccgaataaacaggctggaactaccctcctgccatctttaatgggctgtaattagcccacgatacccgtttaatggactgaaactaaatacttggcccactaccttattatctcaaatgtttggcccaccagttacaataaaagggctcaaacagtttttaggccctgggtgatcttaaacaggccaggacaaattaggcctatatatgattttggtaaggcggaattaggagcggaacaaacataaacaggccaggacaaaatttaggcacacaacagtttttggaagagcgaattttgacccataaacacgtaataatcaggctgaattttgtcgatttgtaagtctatatatccaataggcttcgctagcagctgttttctagcctcatcgtttgccctgaaaaaaattagcagctaccaaaaattaaattataaaatttaattttggagttaactttagggtattcaatatagttttgttttcagcattggattttaagtcatcaagtacatgcatataagagctttacctacaaattatttttggtcatgttttgtcatgtactacctccgttttttaatagatgacatcgtcgactttttctcacaggtttgaccattcgtcttattcaaaaattttaagcaaatgtataagatataaatcacacaaagtattatgagtgataaaacaactcataacaaaataaattataattacgtaaattttttgaataagacgaatggtcaaacatgtgaaaaaaagtcaatggcgtcatctattaaaaaatggagggagtaatcaacagtcaaccttggccaaccgatgaatggagagcaaagttttcatatcgacagaaaaccatgaaagtttgtcagttcacaaatttcacaagtacatacttatgtactactactacttccgtatcaaaatataacaatttttagctatgaatatggaaacatgttagatatataattataaatgtttatgagcctgttcaatttgatgccattttcaaccatatcattttttttaaagttaccaaaaaatatctacgtctagtttgttcacaaatttagtcaatacataagaaatcctgccaaaattttgataatattgccatcttgctaaaattttggcattgccaaaacatggtatggtttattttggttacaatttgaataggccctatattttaggataaagggaatataggataaagggagtacttacttaaatactcttacttcataaggttttggcaacaaattggtcagcaagttttcttgaaatgtagccaagttgctaaaccaattggtccatcttgtcatcaattctgcctattttctgctcgagtttctctatgttctatcccatttgaaagcctcctaacgttctaaacagatcgcaactggtcaatcttattaaaactgccgtttacttttgagttttgacgttgaaaaagactctattacagatcagctgaccgaattgaatacaacatgtgaagagctcattgttacattaatttggcgttattgtcagaatttcacattcagtatcacatactgctctccagttctcgcctgtcacgatagggtttaaccatcaaatcagtatgaaaatggcacctcccttgattgttactttctgcaattgctgtcttaagatttttaaactcgatcgatgtcataattttaacctgctacagctaagaataaataaacatgatatataaactcgattcttttagatcgtccctctcaaaataataataataggtggggtcgctatctgtatctggacggtgatttctatgagactgaccaaatattaatctccctgtaattaggtcaacttaagtcaaatatttgctattttactgattcccggtgtaatatcaatttacgccatctttattttgtttcccttttagttaaaagtacatataatttcccagagccgtccccaaaaatcttggggaacaagaccttatgtacttggtgaaaccccgtgcattgttgcgggaatttagtatgataaaaaaaaataaagtgtaatatagctagataacatcagattaagtaaattaacgtggtttatgataatttaaacttgaattgtagaatggcgattcaaacgtaaaaagtaaggtggtatgactttatggaagaagaaaaatagggagatagtttggacagtagattaatcatctaaaggttaaaaacaattaatgtgatacgacttaattagaggaaaaaaaagagaaagataatttggaccatagattaattatttaagcactaactaagtgaggatgaactatataaatatataggatattataaaacataataaagatatatattgaaacattatgtgaattatattggatgataatttaacatgtttgtatttgaaaagctcttaaattataaaaactataaagatatagcatgtttgcatgatgtttaaatgtgggcatcttgttaattagtggatgatgatgtgtcatcttgttagtggatgatgatgggcatctttgcatgttaagcttaaggagttagtgggagataactttatttacagtgagataggataccgtggcgacaactgctataccaaagaacattcacctacttaagtaatggcgatctgatgaagcagaaaaaaaaatcattgcaccaattcagttttgctgactaataggtgcaaaaatggaatccttattgcttggaatgcaggttcacatcatgatgtacatttctttaagataactatgatatcgtcatcgaatatttaccggagccgacgaaaagatctcgttctggtctaatataacggagcagaaagatagaaaataaaaaaaaaggagtgcagaaatcctaaacacatcagaacgtatgggtatggattaaaacatgtacttctggggggcctaaatttttggaggccatgtacggtcgctcatcttgcatgtgtctatggacgggcctgtaaatgccgacctctgcaccgactctttaattatttaacaataattaataatataagttttagtctgtgcatcaagtaaggttacacacatctatatatttatggaatattgatgtacatgagatttacccttttatagggtttgcgtcatgcatgcacccacaactctgtcaacccaccaatggtgcatctctaattaagagaatgaaatataatggccaagggacaagggttacgtgacaatgggagctgatagtacatggtggcaaaagtacgatagagctaagcacggcctaattatcatctaatatctctccttctcaagtcctaaattggccaggcaattaattaatcaaaggacggtcctccgtttcaccaaagtatgccaatattttcttatacttgctataattaatggtatggctaaaaatttgaccaccttatttttattgataaaacattcatagtaaagtgtggctgacaactaaacaaccccttaatattcagatagaaaaaaaattaaagaactataattagcggtggtaactaatgggtaaagaccaatgcatgggttctttcacaattctacctagcccttctatatttttagattaaaaatacataaaattttaatccacactattttagattcagccctcaaattttgtatgctaaaaacttgttggatcatttaaaatcccttgctatagtatttgcagtgataactgggcttacaatgttgatgaagattagttgaaaaatgattttaattacaattctttttctctgggttctttagctcgtcacttcattttaaaatataagcatttattgctataaatcaaaatataagtatattcatacccatcacttatatttttgaatccgagaaagtgccatattttctaatgtaaatatggtcttgtatatatatatctcgaatattttggccatgccaatgcaaatattgggtatttggatgcattgaatcctcggcaactgtacgtaggacaagtccatcgttttgccggtagttattaggcatttaggctacaactgcaaggatcagacgcgtcaattaatagtaagaaggaagccaatcacgcaaacaacgaaattaaatttgaaaatatactgtgattcgtttttttcttagaaatattcatgatgtaatttttttagcagaaatataccgtcgatcttgcgcaatcgttgcgcgaaagtgacgagagcgtgacgatgcacgcggtgtcgcgcgagaccgcgtggtatcgcgagataaaacagcgagagcgaacggtcccgcacaaggaatcagcgagaccgaacgtcttgtccatcagtgctgcttaattagtgattaattactctaattaactattaattatcctaattagcgattaattaatattaattaattgctaattaggataatcaatcactactctctccgtttcgcaatgtaagttattctagcatttcctatatcatattggtgttaaagaatctagacatatatatctatctaaattcattaacattaatatgaatatgaaaaatactagaataacttgtattgtgaaacggagaaagtaactaacaattttcaaccgttgctatcgctcattgggtgagcgagattgctcggtctcgcggtttggccgtgcgagaccgcgtggtctgacgccgccaccacacacgtcctcgatttcgccgttcggtgtcgtagtttcatcgtgcgagaccgtgcggtctcacgctaccaccacgtgacatcgtgcggtctcgcgctgtcattgtgcgagaccgtttgcgtcgtcacatccacgtcactttcgcggaactgttgtgcgagatcgacgatatatttatgctaataaatttacattccaaatatttgtgagaaaaaaacgagtcaacaacagtgtattttcaaatttatttccaaacaacgcggaacgctctatatatcttcatattcgtgatgcctttaatttggcttaaatttgaaggaatgtaaacaagacaacaactatatatatagctttggattctttaatttgcatgtcattaattatagctacagctagtagctactagcttagtttgtgacacgttttaatacattttttatatgattaattgtcggtcatgattgataaattacatacgtaactcttggcgagattaggaattgaagctggccacagcttatatgattaaatgtcggtcatgcttttatttctgcttaccgtttcggcgtaactggaatatatccgggaagaaattgaatggtcttcttcttggctgtttctcaaacgcatgcaagaataagcctcaatataattactatcttttacttcatgccactgttgttagtctattactgccattattgtctaacaattaataattgatgaataatttttacggttgtccctactactaattgaaatgatagtgatctagagcttcctgaaaacattgctttgttattgcaggttagccgatttgtgtgaaccgatttggtttctcagcgatttgattaaaaatgctgaattgcacataaatcagtccattttctccgtgtagattaagatcaacagaacgtttttcaccattctaaatagggccttgattaactcttttgtatttttctactgtttctcgtctcataatagtgattgccggtgcatgctcctgcttgtctatattaattattgatggttgtgttagtgtgctgttcaggacatctagttgcacacttgcactgcatatttaattgctaggacgatgaacaagtacaactacaaggctgcttcttttttttttcagcctaggaaaatgtacgtgtacaaccacttactgtcgtgtcactagttatcaatgacacttataatactctctccgtttctaaatatttaacgccgttaacttttttaaatatgtttgaccgttcgtcttattcaaaaaatttaagtaatttttaattcttttcctatcatttaattcattgttaaatatacttatacgtatacatatagttttacatatttcacaaaagtttttgaataagacgaacggtcaaacatgtaataaaaaatcaacgatgtcaaatatttagaaacagagtgagtattataatattagaacatatgatcaactacctcttttcatttatgcttacaattaagctaaaatttcaattctaaaatttaattttgaaggtgactttatgatatttttcatcgtagtttattttacagtattttattttaaatcgttaaaaatatgtatataaaaattttattcataaattatttattggttctactaataaaccataattaaggataagtataagcaaaatgatggagctggttagtagtgagtactgagtagctcatttattttctcagtttgcttgtaggaatgaggctagtgcagtgtggagattttttttccatgattttgtaaaattggctgtgagctaagactgtgctgctatttcctaattaataaagcactccccttaaaaaatatatgaaagacttatatgtcagtggtaattaccggcttaccgcagacaatacctagctgcatgataattctctttgatttgatgtaagggataagtggaccaatctaaaaacctatataccgggttatccatctatttatattataaaataagtgggttcgtgagccggttcgtttgcatgatgggctaatcttcaatatcctgcacatatatttctcgagccaaattgatggatgtcagatctgtgatggcatacaccgcattgaatggtgtacgtggatggggagagctcatcggctgctagcaaagcatgcagctgactcggtcctcttttttcttcttcagactggttggtaggattgtgatcaggaggaagattagcttagctagcttttaatttctttctctcttgctgcatttagggcttcgattgaccacttgccgcccaatctgattgaacaagtcagccatctctggcgcaaggaacgcatgcgcctacacattttcttttattataatccaaatttaaatttttaaaattaatttaattttatagtttattaggttctttttatcttaatctattttctagctttggctctcaatagctagtaatgcaaatataaaggttttattcataaattatttttggttgcttcgtttttttcttatcagtcgtagtccaacacccttgagtgtttagtattcccttcgctccaaaatatgaggggttctaatgcgcgcacgctgacagattaagttgtgtgcccctttctctcaccttatccattctattcccttctctctctcaccttatccatttcttcccctcccttcctctcccctcccctcctctcattctttctctacgccaacagtgagcgacgagtctccagcgattgtgacggacctccagtgagccctctccttttccctcccgcgaactgctctaacggagaagaggacacgcagtcgagcaatgacagcggcgacggcaagcggagcaggttagggcgacagacaaagccctttggtgagctccctcctccctccggctcatcctccttctcccatccgcctcgccaacgctcaagttcactgccaacgtagtagcaaggaaggcggcagcaaggtttggattcatcacgacggcagctatcgcgatgtggctgaccgttgcggcggggtgaagggtgagctccaggttgcagcgttgcatggcgtatgcaacgtggcggtggcccttgcggtgcggttgcggcatcctcatcgctgcagctatccgttgttgcacggcaggaatgattgtggtggtggcgcggtgccatgacatcatcatgcacttacctctagcgaaagtcccgaagtatgcttgtcctcagatccatgtcataggtgttgatgacaggtgcggctgcggccacttctagttggagggccagctggatttggccgagagtcgaaggcagccgcggaccaccaagccagaggctgcttatcggtgctggttgtagtggcgacggaggggacgcatggcttaggtggcgatgtaggttgacggcagtgttcaacatcgatgatgcctgtggactccacacaccttcctgaaggcgatgtcgcaatgctctagctcatcttcatgctttcgagtagatacttcaggtttgcccataatagcgatgacgacaccatagatgccacgaccttcttagaggcgtcgtgttagaggtccctgttggtaggggtgaaaacggtacggaaactttccggattccaggcctgttttcggaaacggaatcagccggtcagaattttttcggaatttctcggaaacggaatcgaaaacggaaatattttcttggaaacggaattgaatatgataatagcagtttccgtcgaaactcggaatcggtcggaaaaattctggaaaatttgtcggaatttccgaagttaaaaagacccatagaatcaatagtctataactcatccctaagtttccagcccaacccaaatagtggctaaccctagagaggagagagacaggcacacgacttcgcgagaccgtgagccggcggcggagcatcgcgctccgcgcaccgccagcgcccaccgcccggtgcccgcgccaccgcttctctgccgtcctcggctcctcgcgacctcgcccccaccgttttcgccgtctcataccgccactatcttgcggcgctgtcccgccgtttcgcggccgtctcgcagccacggcgccatcccgctgtttcgccgccgctacaaccactgacgacgacgccacagccacaccgacgagccgacgacgcctcgcctcagcagtcccagcagcctagcgacgagccgacgagcctaaatcgatttgatttcttttgtgctgcagatttacgatggatcgaatcatcaaatgcaagtagctgttttgtgattgaactaagtactgtactgatggactgatgtgtgttgctgttctgtgatgactgatgaatgatgattgatgaactatgtactgatgatggagtgatagctcatagcagattagcagtatagcactgaataatagtgtatattgtataccttgtaccatggttttttgctgtaatttttttagaatatttgttatgcaaattatatgaagttatagaggaatatattttgttgttgagacgatttcatataattgtgttttatgatgaattgtggactgttgagagttgagaattggacttgacaaaagtttgaagcttagtttaaggggtttttgtattctaataatttttgttaccgtatccgcgccggttcgttttcgctccgttttcggtttcgataatattcgtttccgttttcgtttccggggtttccgattccgattccgattccggaaaaaatatgaaaacgaaaacgataaaagttgtttccgtctgtttccgtaccattttcacccctgcccgttggtgcagtgtacatccctgttgccgttttcgatggttaggctggtggtaagatttgagcgtaggatcaggggcggagctacaataatagggccggtgtcaggtgacaccaacgactttcggcaaaacctataacaaaactgcttatccatgtattattatactatgatttaagtataattagtatactatgacaccgatagacacgttatgacaccaatgaatcgattttctagattcgccactgcgtaggattgttttacatcttagttgctctccgacattatctttcgctgtgttgacatcgatgatatgcgcgtttcaatcggtaatgatcagtaattgtttttggatattctgcttcatagcttaggaagacaaagactatacgtacaacttataagccattggcttatcctggtctttaggttgtagtctaaatagttttctttgttttttaatcaagctatgattttgtcatttatagtcttttgagctataatctttgtaataattggttttagcttctttaaagcaaaggccggaatgaattccattatctaataataatattataagtactatgttaaatttgtcaattatatttcctagtccatttgtatttggctcatatatagcattaaaggtattgaccgatattgttgtaccacattgaagtttaataaattactatatgtacgtcattatacaatattttataatataaatgcacgcacgcggcgatactatcatcaacttaacaccgcatccgtccgtccgtcaccattcacaccgttcacgtaccgttgccttaaaatctctttctggactttgattaattaaggaagaatccaaagttacgattttgactcgaaagaatctaattttaatgaagtgattttacgtttgaaaggtaacacaattttaagtattattaattgacattacctcatagaagtataaaagtatagatttaaaatgatatatcacaaaactactacatatgtaataataaagttatcataaaactacaagtctaacgtcaagttaattaatcataaaatttgaatatttataactcaaacataatattaaaactttaaactctaaaatctataattttatcataattttattatatcatctgtagttttagatatttagctttaaacatatagttttgtaataaatttattatatacctataattttgtgataatttggtcaaagtatccatattttttgtaaaatttactcataaatcttaaatctgatgtagctttgtgaaatttactcattaaatcggcgataagtatttatgaacatagagagtacttactgttactttaaatctaaataactgaaacgattctaaactgatgcgaatatattcgccagttccttacaagtcatataaagggttgtgcaaaaaattaaaatatttcgataacatagataatatgtgatatattgctccgtacacatgcaagttttaaatattacttctacaacattaaaaacaaatttgcatgtaaatatatgttaactaagctaaagtttaatttattatttctacaacttatggatgtcgaattttaacttatatctttgtaaaatgcagtgtaatcgatcatgtattaattaatctatcttctctcttttttttaaaaaaaattcataactatttgaatgtcatacaagaaataaagagacaacacgtggatagtttaaaatccattctcctaaataaataattctgggtcaccatacaaaaactaaatctaatatggataccactgttgaaacaattatgacgatccagctagtcagctctaggctatatgtgcatacacacacatgcttgcctgggcattctccctgttttttttaattacacagtacaacacagacccttacaagacacgcacactcacctctataaacgcacgcacgcaaaccttaccctattgagaaccttcgaagaacgggctagcaaatcctggagattgatgaaatcaccccagacgcttcgctgtcaacgggtacgtacgtcgcttatcactaaaagcacaaagccgttaaattatggaaaattcactcccaaaagtactactaacgatcttataaccaccgggctacagtcactttcacatttttctccctctctctgtctctgtgtgtatatatatataaagctaagctcaagcttccttccatctggtatagctatagcaagtgttggaccacggatcgatcgatcgatggggcggccgccgtgttgcgagaaggagggggtgaagaaggggccatggacgccggaggaggacatggtgctggcgtcgtacgtgcaggagcacggcccgggcaactggcgcgccgtgccgcccaggacgggcctcctccgctgcagcaagagctgccgcctccgctggaccaactacctccgcccgggcatccgccgcggcggcttctcccaccacgaggagcgcctcatcctccacctccaggccctcctcggcaaccgctgggccgccatcgcctcctacctcccccaccgcaccgacaacgacgtcaagaacttctggaacacccacctcaagaagaagctcgccctcacctcctcctcctcctcgccgccgacgccgacgacgccgctcgtcgccagggggcagtgggagcgcaagctgcagaccgacatcgacctcgccaggcgcgccctccgcgacgccctctccgtcgacgacgccgcctccccggcgatgatcagcagcgggccgcccgcgccggcggcggcggcggcgtacgccctgagcgagcgcaacatctccgtgatgctgagcggctgggcggcgccgcctccggccaggaaaggattgtcagcctgcaacccggcggcggcgacgacgacgcccggtggcgccgccgcggagagcgcgtccacggccgggacgtcgttggagctcaccgccgactgctgctccggcggcggcgactccagcgcgtccaactgcctgccgtcgtccatgctcctcgcgtgcgacgacggcgacgcgacggcgacggcggccggggtggcgccgctgtcggcgatcgagtcgtggctgctgctcgacgacagcggagagccgcagctggcactggacgagcagctgctggacgtagctctccgtaattacgctttctaattaattaattaattaattactaccaatcaatgcaagtactggtactagagccacacgacttgattaagaattaattcgagttaattgcttagcttttagcctagctagcgagccagtggttactactactagttgttgctggattttactgtttactcttgctactagtgctctggatccgtacaacagtacacacatgaatatacactgatctgttacatggattagcaagagtcagtggagcaggtagaaaaataatacttatcaaaatgtaaaattattttttatatttattagtatcatgcatacgtgtctatattaatactactccctatggtgcataccatcttgttttttttaaataactataaaaaatgccagtgcgttgcaacgggtgaagtctattttaatcttattactgttatatggtttagttaagatgaagttcactgtgggagttcgcttggatatatatttttttggaaaataatgagctgcagttaggagtccgatcgttttaagttagcatgcgagtttttttttatacagatttcttatatgattccttctgtattaccaaaagtgaatgatcttaaaaccgactcaaatacggatatgtatttctaaaatcaaacgaacttaaaaaccgactcatacacggatgacgtaccaaaatatcggcaaaaacatctttaatttttataatagcagagattgaattgattctagtcttgctctaaactatatatatatatatatatatatatatatatatatatatatatatatatagccaattattattacacagattactggtcaaataactatgaattacaaaatcacaacttaaattaaaacgagaaaactgcttgaactatcaacctaaagacagaggtaaaactgctattgagaatctgtgtatataaccgttgtttcccaatagcttgcaagttatatttaattatgatcttctcaaacaaagaaacataatctctaaaaacatgagatgatcattacagattgaatctcactcacatcattgaccataagaaccacaaagaaagataacgttgcagattaactgggacgtaattcagtcattcgcctagatcttgccatcgctctaaccattgaagccggtctggttggaacatcgccacagagaacaccacaccaactgggggcctccaatgtgacgcaggagctcccatgccattagattattttggtgtcacaggagctcccatggattgagatcagctacagtcgtaactgcagttgatcttgtccatccatttttttgcacgaagaattcagatctattgcgctataatagctcatctatagcaaatccttacccttaaattcaaatcgaatagttgtagcctgtgattgcttatgttgcagtcacactacacttcagggaaccagcctcctttgaaatggagaaaccgtgaagaatttttagggaaatcgaactaatccctataaagaacttataaaatttatgtgttctaagattgaaaaggtggcttgttacttggcaggtataataacagaaaaaaatcgtgttgcgacttgcgactcgtgcaattgtgcgtatagaagcgcacactctctccgtgagaaatgcttttcctagaactacactgtgtaaaatttctctagtaaattttgtagacaagtcaactgtaatattcttgtactgtttttattcatacataattattttatcatacatctcgctaatatgttattaaaatatatacatatataaatagcttgttgatataaaatggaaatatttgtcggggatgctagctatatatattcggcaggtctaggacgatctagggtctagctggatgttttttccccgtacggtttatgagctaaaaacatgtgactggtggaattcaaaataattttagggtaaaattttacattttctagatctacttttaacatagaaaataataagacacagtgacaaaagaaaatccctaagctaatcctaaaattatgttctaccattcaaaactgatttcaatttataagccacaactcaaacaagctaacatttaattattcgataggatgtgaaacaaaagcacgtgtgctgtcatagtatatacatgattggtagtatagattttttttttctagaagcaagttaaggagattgattgggccgacaccttccagccactggtgccaaaaccccacggcaccatatatgccaacatcgagcagggcttggccgcaacgcgcaggtacccatctattagttagctaggtgattccccgcgctttgctgtgagattactaagtaattctgactatattttttcaacatgttgataaatttatgttaaatactataaaaatgatagatagatttgttaaaatattgtgtaaatgatgtgagggtggtgatttgatatgcttgtatgttgatttgtagaattaaatatattgtagatgatggtgtatgcttgcatgcaattattgctagtgggtgatgacactggtggagaaaggggctttactcccggttcgtaacccccctatagtcccggttttcaaaccgggacaaccaatccgggactaaagatcactatctttagtcccgggtgaaaaaaccgggagtaaaaatacatctttagtcccggttggtgttaccaactgggactaaagatagagcctttttagtcccggttggtaagatagagctagcctagctagctagatccggttgctctattattattttcttttcttcattgtgtttttaatatattgattttactctatccccatccaaaaatcccaaataaattatccccgatcctcaaatccccaaatcggcggcgcagtattgcaaaataagatgcagcaagaatgcttaagaacgaaaaattagcatgcacaagcttctagcaagaatttcatgcacagaatacatgcacgatattgtacggacgnatcacagcacaagatcagaatagcacagaatcacgaatcgacaagattcttagaaagaaaaagaagaaaaaacacaaggctgtcggccgctgcgtcgacagccggcgcgccgcccgccgctgcgccgacagccggcgcgccgcccgccacgaggccccgcggtccgccgccgcgccgcagcgccgcccaccgccgcgaggccgccgcccgggcctttgcccgtcggcgtgccgccgcgaggccgccggccgccggccgcccgatgggatgatggagggggaaggagaggagttataggagaagttagagaggaggaagaggaagggatgatgggggagggaaggagaggagttacaggagaggaggaggaggaagatgaagagatgggatgaagagataaggtcagtggaggaagaggtgaagagataaggctgcccgtctcctcctcctcgatctcgcagatggcagatgccctccgtactctccgccaaaaaaaatttgttgtggttggtatcaccaccagggagtaaacatagatctttagtcccggttggtaacaccaaccaggactaaagatagtaggcatcttttttcccggttggtgttaccaaccgggactaaaaatagaaaatagatcttaagtcccggttggtaacaccaccaaccgggactaaagattaaaaagcagctctaaactttttaaccgggactaaagataatctttaatcccggtttttattgcaaccgagactattgtggattttggctaaccgagcaaagatggtttctccaccagtgtgatgtggcatggttgcatgttataactttatagaaagtatagactgcgctttgcggcggaggaaattatgtgaaaaaaatagtaaatatgcgttgtaaaattttatctcataattaaaatacaattttctttaatgtgcttatatattttgtaacttgatcaattatccaaaggttataatgattcggttatatatggtgtggtttttggacaagagatgaaatttgcacccttgatgaatgatctgaaggttaaaagtaactgaagtgatgtggcttcatgagagtagagaaaattagcattaactatacttagtggggatgatatttatagatatataggatataggattaactgtagcgcccgttccgtcgtggcgcctagcgggaaaattatctcttaaaaaccctaattgcgaaatttgtttctttgcttattgtctagtgtccgtgccatctcaagatctcaaatccccgatctatcgtcgagttcaatcccgaatccaaatccttccaaatcaaattcctccgcaaaagtctattttgcctcccccggggtcgatgggccgaatctctctcggcccatctaccccgggggagg

SEQ ID NO: 43923 - DNA, 38698 bp, Oryza sativa
  unsure (1)..(38698): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgtgcccgagccgcgccactcaatccgccgcgcctcccgttgcaagccgcgcgcgcgtgccgtggtggccgaccgcctggtcgccgctgtcgttagcgcctgcccacgcctgtcgcccgtgtcaccgcttcgctccaaaccgccccgccgtcatcgccgtcgtcatcgcctcggccccgccactccgagcgcaagccgccaagggacggaggcagagcccctcctccctctgccgcgtcgcccccgctcccctcctccttttcccaaagaagcaaggggcgagcccccatttctctccctccttttccccttttcctcccgccggcgtcatcctccctccgccctgtcgccgatttggacgcgagcgccgagcgccagctcgcgccttgaccgcccaaagtcggtttccaaaccgacattgccgcccttaaagccccgggcgccctccctctcttctcctttcatcgcctccactccattgttgccgccgccttccgagctctgtctcgcctccgccgttcatcgccaagcgccgggagagccggtgcgttcgtggacgcggaaggggactccgggcgctcgtctcctccctcttccccggcccgaggccggagagattactcccgcgccgtcggcctctcgtctcttccccggcccgaggccggagagattacttccgcgccgtcagcctctcgtcacagcgcccctcctcatctcggtagtgcctccctccgttcttcctccccgctccatctcccccccttagttttcggtagtagctcgagtagcctccccgtagctagccggcgccgccccgaccgttgctgccgctcgcagtgtgctcgccgccgtcgccgcccgtgctccgtagcacccgctcgtcgccggcctcgctcggcgtagctccgctcaatccgacgctagcaacggattcccgtagccgcgtagatgctctcaccgccgggaatcggcccctcgagacctcgtcgccgtttcccccttctcccgccgccggttgccgccgccgcaattcgccgccgtcgggcatcctccggtgaatccgagccgttggctcgtctcccctcgtcctgtgcaaccacccggtgtgctcgctttcacctgtatcgccgtggatcgctccgccgctcgccgctgtcgtccgccgtccgttccggccggcatcgtcgtctaccttccgccagaccgcgtggcagccacgtaggcgccacggaggcgccacgtcggcgccagctcggccgagatcgggtcgggccgacccctgtcagcccctcccgtgcgcgcgttccaccgcgagccgtgaggctgcacgtgggcccgccgcatccgttccaccgcgaaccgcgcgcgtgcaccgcgtccctcccccgcccgcgcgcgtgcgccgcgtgctcgctccgcacggtgaaccgtgtcaccgacaagcgggtcccacccgggaccacgcgtggtgagcccggtccaccgactctctctctctcctcccctcccgcgcgcgcgccttgggccgccttgggccggccggcccatttagctcggccggaccgccccatttctctcgggccgcgccctagccgccgaggaaaagtctatattccctccctcttttcttttcttttcttttcttttccaaaaaggatttaattaaatccttttcctttagaccaaaaatccaataatcttagaaatttaatatcttcccaaccgtaaatccgtttgactccgttcaacttccaaaattcctcaaatctcgagatctatctaatggcacgcttagaggtcattaataaggctttatttttgccgtttgttgagttgtcccgtttcgcgtgtagtttcagagcccgaagacccgcagtgcgaggatttcgaggatcaagctccagatctcgagcaaggcaagccacctttgaacatcttgagcctatacttgaaatttaattatgttgcttgaaaaatattatgcattgataggatcgcacttaatctgttgtcccgtctacaaggcagattggcggacctacctaatttgttgcatttgatccttcctttgataattgttatatcgtgtccccttgtaaccatctagttgcgtctcgatattcgtgcaccctgtgcgagtatcgacggacgccttcaaacttaaaatctgaaaaacttcttgggtaaaacttgggttatacaaaagacttggaaaacccgacacctgggtcggtgcttgcgaactaaatggatttccaaaaccgcggaccgggaaacgtactgggtgtacggttttcccgctcttgcacctaaggaccgtttccttggaatttcatctgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgttggcatatggtaaacctgtgtcggctttggaaatgccttgtcatgaaagcttggaggtctcccgacgtggctgatccccacgagctgggtgatccgggttagtaatgtcgtgtgggtaaagtgtaccccctctgcagaggttaacaaactgttcgaacagccgtgcccacggtcatgggtggatgtgaggtgattcctagcgtagttttgtttgactactgcttgtgaaattgctgttgtggaaaggggttcgatgattgaaaaatctgcagctgatgggatcagctaggcccaggtggccgtttgaaagttgttggcccgggtggccgtttgaaaagctgttggccgggtgccaaccttgaatcatttcaaaagactgatacattgcacaaactccgaccggacgagacacactgtctcatccgtgtcgtttgagaagcactcacttagttgtttttagagaagagtttaaataaaatcaattgcaaaaacaacagtctttccttgaagcctgcattaaacacttatttcccatggcttgctgagtactcccgtactcacccttgctctatataaataatttcccccccagttgctgaagaagatgaagcggatcccgccgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgataatctgtcttcctgtgataccagcactgtttcctgggactggtatcgattaacagggtaatttggagcgtcacgggctagttccggtcggtactagtccggggcgtgacattaacttaagctcatctgatcttttatataagtatttttattataaacataaaaacacaagtgctcatgacacgagcaattatccctatgaacacgcacacctataagcacctttgaaaagctggaccggtatatcgaagtcaccacatttgccttagttagccaggcgccgggtactcgtctaccacttaaagaataattaaccgagcatcgggtaggtcgtctactaccaggtagtttggttccaccacaacgaacctaactagttgagccatgctcactttgctttacataaagaatttatttggtcccaaaacaattttatcttttctctatccatttgtcttaaagaaactttatttttaaataatcaatgcattaagatttgataaatttaggacaaatacgttgagaactgataaatttagagacaaaattcattagatctgttaaagttagaaacaatattaggatttaatacaagtaaagtgtagggagaaaactacgcatcggatgatcgatacctaaaaaaatcaggtggccaaatgtttcagttgagcaaaaagtgaaacatcaagttatacatggtgaaaaaaaaaacagaaacatttaaatattttatgaaataaggtacacatgttgaaacatatctctatcacatatgaaacaactaatgttaacggcttgaaacatatatttttcttttatcagaatataatcatatgatatctggttgtaaagatttagattagtagtttatgaaaaaaaagttattttaaaaattaatacatgtatgtatataaggatggagtgaaaagagcagttggatggaccggtccatcggtcaaccgatcgggagttttctcccaagtgtattatagtatcttttgaattttatattggtatatgttttatacttttattgggtagaaatgaaattatgtttggagggagctaatgttcacgttttaaattgaagggagctaatgtaccatatattgggggtaccttttaaattgctggtactcaatcgatcctaatgttcacgtttcatatggatcatcatctatcattcttttaattcacctgccggccggctatttaaattttactttttgtcatttaccacggacgacgaattaataatgaattaaagagaggcgtacttacattgggtatcactcactatatagtagatcccaaagccacgagctcgatcgatcggtctcgtcgcaattaagctagtaacttaattacatcatcgaccgatcgttacctaaccgatcgatcgagcagacgtacgaatttttccgttccactctccaggaaaccatgcctcccatggatcgccatcgtctcgccgacggcgacgattcgtcgatcccgttttgccattaaagggattattgattaattgtctgctgatcaaccactagatagctagatcgacagaaaccttgatcatagagtatacatagtgaaaaaagttcgagcaattcttaaacatatatagaagttagggtctgctagattttaagcaatgcacgattttagttcaatttatatttaattgtgttattatataagattttattttattttattatctattttatgtacttttgcatatttgcgtatgttaggataatttattatattcaacccttttatctaaagatgtgactttgtttataaataaataaaatgggataaaataaatgactgaacttaaaattttctttttttagataatggaaataataaaaaaaatctaaacactcttaattagttgtactttctttaagcaaacggtgaaaatgagctggagataagtctggcaccactaactctccattgttttataagaaaacaaaagtgtgggttaaacgatctacgtgtcaaccgaaaggtacgactaagtaatacgatgtataaaaagtaatgaaaaataaattaatgataatgctaagtttaaaaaatgtgttgcaactcgcggtccacgggcaatatatgctattactccctcggtaccagaatatagcaactaatgggatgagacacatcctaggacaatctaaaaaaatatattacctctcattgagagggcctgaacctgtctaaatcctttgtctccacatccatccacttttaggtctcgtgcgctacccccttttattattgccgaattcatgtttcgacagttggcgcgccaggtaggggttgcgtcgagtttcctatcaacgagcgcgatggaattaacttcatgagtcgccgacttcgttttcgcttcgggagttttcacttcctttccgtcgaccacttcttcaagctcctcttctctgacttgatccaaatcagtcagggggaaactcaatcgagggattacaacaatctaccgcggcaagtttcagattcaatctcctatggctgccgtcagcaccgccttcatcttcggaccggttcttttcttctggagttcggcttgcatcgccgccgccggaaattccgacgggacgtcagtcgtcaacttgatcgtttgacatgccgagtccatcatctgatgatgtcaaatctcctggcgatattcaattactaatctaaattggagtcgacgtggaatctgagccaatcaataggagcaattttcacgcagggaagtgcagcactcatgcatgtattgcatgtttgtcacaagctgccgatatgatctcctgtccacccattaacacatatatacggaggacactgagaaaaaagctaagtgcctttatttttcctctttatgtgatattttccattgagcaatttttttatatctactcatgctaactactcgtccagcgccggacgcctagttttatcattatttatcatattgatttttaatctcagattaatctcttgttattttttgttgttgttcgcatataattacgcggcactattgaggcgattaatgctggtcatggagtcgaggcgtctcagctttccggtcgatcggccgcgagtccactttgccggcttgtcttcgccaccgccattgctgataacaacaacgacttcaccgccggcctgcttccgtcgccgccgagtggtgcctccgcctacacggctggcctattatgccgccgctgttaggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgctgctgttgggcgtcaacgacttcaccgccggcctgcctccgttgccgccgagtggtgcctccgcctacacggctggcctattatgccgccgctgttaggcgtctacgacttcaccgccggcctgcctccgtcgccgccgagtggtgcctccgcctacacggctggcctattatgccgctgctgttgggcgtcaacggcttcaccgccggcctgcctctgttgccgccgagtggtgcctccgcctacacggctggcctattatgccgccgctgttgggcgtctacgacttcaccgccggcctgcctccgtcgccgccgactggtgcctccgcctacacggctagcctattatgccgccgatgttgggcgtctacgacttcaccgccggcctgcctccatcgccgccgactggtgtcctcgcctatacggttggttggtcacaccaccgttcatgggcgtccacgtcttcgccgaccggctggccttcgccgccgccgactggtgtttttgcctatacggttggcggacttcgccgctgttaatgggcttcatcatctacaccactggcttggttccactggcgccgactggtgtttttgtcaccattgatggactgcttcgttcccacatcggctacttttgctgtcatcgagggaatacgacaaagctaagtcatcatttattttattctttatatgatattttgctttttcctttgcctcgctacctcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccggggactcgttggatggaccgagtaacgcaaggtgctgagtattactcggaagaaatcaaaagcatagagataatataatttattttctgctcttaataattgcaaaagtacctgagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccaccgccgactggtgtttccgcctgcacggctggcctattatgccgccgttgttgggcgtctacgtcttcatcgaccggcttgccttcgccgccgccgactggtgtttctgcctgcacggctggcctattatgccgccgttgttgggcgtctacatcttcaccgaccggccgcctcgaccgccgccgactggtgtttccgcctgcacggctggcctattatgccgccgttgttgggcgtctactagtatgagtcttatcccattatagattgctatattctgggacggagagagagagagagtagcttttaacaaagatatgacacatgcctgtacatgtacggttcttgttgcctggctgccacaatataattcagatctgaactgggttggcaactgctgcctttgcctccattctataaaaatgtatggctagatttatagtattaaaatgtgttatatcagtactaggttgattttttatgggacggaggaagtatatcatactaaattacatggagtcatggatatatatttttgtacacctaccacgtttcaaatgcataacttaatttggaccattgaacgactaggctaacacacattttgttgttggagtgtgacgtggagtatcgtggagcacagatatatatgagcagcttaattagctagctagatcgtcatctttcgctctcattaattcccattaccgttagcctggatatgcaacagttttgcatttaaggcgccaaagctccatataggcatcaaaattttgcgaacctttaatcactgtcactgtatgaatgaatctttaattaggctgatatatatatgcggcatgtgtctaaattaattatgatcgatcagtagccatgaattaaatggttgatgcatttgcttgtaccttctgttggcccgttggagcgcgagtatcatgtagtgccacaatatgctgacataacaaatattgcattatttattattattattattattattattattattattattattattattattattattattattattattattattattattattattattattattatttcataggttagtttgattggatgcgcgtgcgcgtgcgtgcgtggagaacgagttacagtggagtacttatataatcgtgtatactgttctcacaacacgatacatcagtctgaattacgaaagctctcgagcataagtaagcttaataatgttgtgcacatgtaactaagatcatggactcgtggatgtgtgtggttgcccaaatttattttagttattaaaagaaaaggaaaaataaccgtgttcgtctatttatatttatgaacgaagggagtttgttacaatgatttattcgtgaactgtttctattcttcaattaatcgagagaaagggacacaaagtaacactcctttttgcccacgaaccgaaaaaaacactgctaattagtcatccatggatccatcttctcccttccgacaagggcaatagagacgacgacggttgctccactgctctccggccgccgtgtcgtggtggtcgcctcgtcggcacggtggtcaacttggcccatctatgtaagtcggttgatcgtcggcacggcgccattaattaattactccggccgaaagtgaccatatatacgtactgtacaactctccggcatgcagatttgttgatccgctataagttaatatcactcgcgttgttcttttcatctacttcatcgaatttgaagtaattatgtagaaattattggagaaatgttgtgattgattgacaagataaaaatagatgaataatttaaatggagaatgcttgtaaagaaatagtattattttgggtgaacagctaaagtgatcctccaagttttattctaggctcagtttagtccttaatgtttcaatttgtccatattagttcttcaagtttttattttagtttaaacttatccttaaacccacttagaagccacatgactaaacataacgaacaactcttaataaataacgcttatactccttcattcactagaaaaaattgcatgcaatgattttttttatagataatgcatagtacttatgtaaaacaaaaataaattatgtactttcaattgtatagatagccattaggcttaagtttcatgtgcacatattaaaataatagaaattacatctgcaatattgtttattcatcttgtttttctcttttatagtgtagtatacaaattaaaggcgaaagggacattttctaataaaaatgttgactaaaaatagccatatggcacatcaagtgggtaaaaggatgattttaatccaaaacaaatacttagaggacctatatggacaaaacgaaacctaaaggatcaaattgagccttcggtgaaacccgagggactgaattagctattcaccctattattttaagacaaaatactatactagacatatagctatattttaaaatgaaggtggtagagatcaatataaactgttgatttgattctatgtaaggggcaacatttatttatactatcgtctcaattaattaattgaaggtataaatattagagggtatatataatcttcaataatacaaatatatagaattgggtacttcaaaatttgggaccaaaatagccaatcgatacttcccaaattgtagcgataaaataagatatcaacgggtactttctaaacagtccaaataaatcgatatacttcacaaaaataaatgggatgagtagtaagaaaaataattatcgttcaaactatttcttctactattaatagtagaatattatatagagaaccataacaaataaagctcatggaaagtgtccacgtcgcaatgacggtgggaacatgtgggcggagtgtccatgctattttaatcccagcagaacgggagatgtaaccgacatacgggcggctcccctgtgatgaaaaccaacgtgatcatgatgcgtgcattatgtcagcttacacgtaatgtatgtacccctctgtctaaaaaaatattaatcctacctacgaatttagaaacatatatgttcgagttcgtggctaggaattcattttttaaggatggaatagtacgtttgaaatttggctggatacatttctatataaaattagaatcacccgtagtattctaccgctagtagaatactactatataaaccattaatttatgggcatgttcggctgcccgggctgcagctgcgccgcagccggcacgaacagtgccgcactcactgtgcgcagccgcagccacggctgcagctatcggcctgccgaacaggccctataagggcacgtaatatattctattaatatatagttagagataattgcaacattatttttttcttttcgagcctcgctacggtgctttctactagtagccgaaaacaatctgaagtgttaattttattttatcgaaggattccgatctatttatactaccaccccagttagcggtagtagaaatatggagatacattattgtcaaaaaaaataagtgtggagggatatatatacttgttatttagcaatgactaaactttttttcctcttttttggctttttgatgaaaaatgagtgatgccggcgtaatagatgatatgattacagatggatttagttgaaaaaaataaaagataaagtaacttctaatcattatattaataaattactctctttgttcctgatatttgacgtcgttgactttttttaaatatgtttaaccgttcgtcttattaaaaaattaagtaattattaattctttttctatcatttgattcattgttaaatatatacttttatgtatacatatagttttacatattttacaaaagttgttgataatatgaatggttaaacatattttaaaaaaatcaacaatgtcaaatatttagggacggatggagtactattttagctctcataatatactaccaataaagttcttttctttatagtgaccagtcactggtcctttcgttcccgcgtgcgctcaactccagcggcagtgccctctctcctccgtcgaacagacaaaatcaggcaagctattactatactgaacaaatcaatatatatagtcaacatcgagcagcaagaacacaagtaattaatgttagacactccccatgattatctttaaaacacatatatttgattagtttctccacatgctgtgttctgttcttaattaagtcgttaacagtgctgaatttctccaaaggatcgtacccaagtatttcagttcagaatagtcatttgcgcagttcagagtgcccattagaatggtgctcaaaacactgtaatgttgattggcgcttaaatccttgaattgacaaggtttcttgccctagtctcaaggtgcaccagccctggccagcgcatgacctaagtcacaaaagttaatggatggatggattgagaaactggaatgcaggacattattttctaaaaaaataaaacgacgaggtatacctcctcctaaaatatggaacgttagttggaacgtgttcctaagttatttggaatgcccctctatctcttcatggtcatcgcacagcgcgacaagagcaatgcttgtccagtctccactgcatgatggtgctgacgcccgtacatacacaacatgatattggcgagcagtgagggagcaacaacagcgcttgtcccatccagatgagttcaaatttagtgaaagttaatcaaattatagattttgcttgatttggattgtctttccatcattcgctccatcgtgttgtatttctttatcagaccgctctattgttactccatcataccttgtactaggatgacaagttccatccattttcgggacaaaaattccacatagttcccgcttctcaatccggaacgaggaacacacttaagttccacgttctatgtgacatagcgcatgacctccttatgtggtttccaacttatatttcaaaagtacaaatttacccctccacacatctgtattaatgtggactattataccctcttatgtttttattgttgttaattgaggtggtggtataataagatttgatcccttttgtagaactagcatagtggctcgcgcagattgcgcggctagtatcattatattttctctcatataatagtatatatgttttctcattatattattcaaatatattaaaatgataacataattttaaattttgcaataactttacaaaactactaatgtgtaatattcatattatattttatatacatgttagttattaattacttttaatatcaaattttagttatttgtaaattatatatattcctatatggactctagactcgtcttttaatatttctttttttttaattctgaattttctgtaaattgtatttctatatagactctatgctcttcttccaatattatttatttttatttttgaatttttattttttctaattgtattcttatgtggactctaaactcatctttcaacattctttaatttttaatttcgaatttcagttacttctaaattgtattcctatattgactttaaactattcttccaatatttttcttaatttagaattttagttatttgtaaattatatgtttatacggactctaaaatctacttttaattttattatgtttattccaaattttagttagttttaaatttcaatatggactctatactcaacttctaatatatatttttaattccgaatttatatgtttttcttaattgtatttctatatggactctatactctacttctaatattccttgtttttaattccgaatttcagttatttcctaattgtatttctatatggactctagtctcctcttctaatattccttattttttaattccgaatttcaactatttctaaattgtatttctatatggactctagtctccttttctaatattccttatttttttaattccaaatttcagctatttctaaattgtatttctacatggactctgctttttttttctccgattaatgtgagaatttataagccatgagagcgaacgtggaggctcatttttctattcctttaataatataatagatatgatcaacggattagattaatttgtaataccagtatagtgcattgtagtgtggcttaaagaaaatctaaaatgacctgtgtataatggaacctatataacatgttcacttctttttttttcttttttttttgaggagaacgacggcaggagatctgccggaattttattagagggagaaaataaagtgcttacagtccagagaaaatatgagagacttgcaccgaaacaaattaagattttcacggaatttcattagatgctctctgtttgttttttccttttcttctggcaatgaagtatcacggatgatgatgacttgttgctcacaacaatcctattatagtcacgaacaattcgccctgattccaagaaagttcgtcaactcgaaatatggctagaaaagcaacaagcagaactaggagctttgggtattcagaagctgacaaacacaccgcccacacacaggattcggcttcagaatagcccctgctttagtgttcaggccaaggactaggcaggattagttttctcaatgaacaaccaagcaaagctgattaacaataatgtgttcaggaaacctagctgtaatgaatgtgcaaggggaataagaatccatcctaagttgttcttagcctctgatgaggaatttgctatattacagtcaaactgaatggcctacattacagtattacactgaaccaaccctctgctgcttctgtcctaagctggctacgcaaagaaactaaacccgtcatcatcttgtccaccttctcatcatctcctaaaccggaggagcacataatctattaatcttgtccagaatcctcatgagcttcttcttcttcttctcatcatctctggacacaaaagttttgtctctaccaaatccacaaaaaccaacaccttcagctgccgaagaagttgcattttgttctgatgatgatgatcatcatcagctccggttgtgtatcgggtcggagcctcgccggactcgccacttgctcgtctgcgccgcggccgtcgtcgccgcgaaccgctccttcgccgcgtcgacgccgacgacattgttggccggaggcgccggcgccggcgccatagccggagccggagccaggacgagctcggctctcgtcaggccgtgcaccgccgtggcgtggtgcagcgccacaaccacgacgacgacggtgcagaccaagaaaaggtcgagacggcttgtgtgctgcaccatgttggcttctgctgctgctgctcagatggagacaaacaagtctctaccttggctctctctgtagctagaatggtttgtacaatgatcaatcatggtgatgtcttgtctctagatatagcaggggcaggcagtgtcgagtccaaaagcacaaagggacaagtgaagccaagcacagcatattagcatagcatgcctaaggctgtcaatggaaggttctgaaaacctgaaagtttgagggaggcagattttggcaaagtcatgaattggggggggtacttatctcccaacagacaaaacctaaagttgcaattgtagatttgtaggggataggaggagcaacagtatgctagaaacaaagacttgctttagctccttgttgttgttatcttccccttcttggccactgtctgcagtaaaacccccaacactaaagcagcaggcacagtggtgagtgaaacaagtgaggcttttttgcttttctatctttttttttgttgttgtttgttgttcttggttgaaacacacttttctctttgaatcttcttccaagctaaggccaccaaagatgggggagcattcaaaacttaaaaggaagtgcaccaagtttcaatagcctctttcctcacaattttctatgtgtgctacttgccatgcatcccaatgctttagttgctctcctagctttggtgcaggaatggaaagaatggtgaatcttaaagcattttcaggatccaacgacggttgtagcttcttggagctgtgtatgtgttggactggtcatggtctaaggaggccgttttattggtaccaaagcgaaaaaagaaagagagaaaacagtagctactgaatccttttaaagtggaggcaggccaccttagcttcaaatttgtaataaacacagcacttagatgcataaattttaaaccagaagaaaatcattataaagagatggaagattatgtaaagattgcttcttgctaagtgggttagggagcccacaaaatcttcctagcaagctgcaaaagaaaaaaggaggggaaattaaaggtaacagaatgaattatcaatggtttgcccttttgtttgaagagattcttaaagtgctaactcaaatacttggtaaagtcactatttgaaatatatgtatacttgctaaagtgcccagaaattgataatgggaggcttttgtccgggacagcaatctacaaaataggattccattagaaaaggagtaatcatattgtgctggttcatgacactaaattaggtctataggaatactctatcagaaagggcacagcaaataaattaacaaacaaatatttacttctaagttaagcaatgcagcatacaaggaattgatacaatgctggaaaagatcatgatcttagcagagacaagatattgatcttatcagagtaatgatgacaccgtgattaaagcagcagcacagttcaattcaaaaaaaaaatagcactgttatttttcctgctttcgtagttacatggaaagtttatgatgtgtctttaagtttatgatgttcataaagacactcaagtacagaacaaacaagcttttaccaaagattgcagagaatctaatactagtagttttacccacccactctttgagtatgaactgtaatgacctcccactttttgctatcggaggtaatcaaatatgaaacagtgaagttaagaaggtgcatttgtcatgtactcctgccagataaagttagaaccgaaagaacagttaactgttcacaaatgacacgcattgaactatagtacagtaattaactagccacaggacgaatctctatgtaatccacgatgcgtggcctggccaccttgtaggcttgtacctcctccccttgtgattgtgaggatcgaagcggccacaggagcacacgtccgtcgatgtacgatgcggtcacgcagactgtggaatcacggcgccggcatggctcctgttatggctcctgttgagccgagtttagcgcctgttcagtttgatgctattttcaatcttaccaaattttagtaaaattactaaaaaaaataactacatttagtttgctaccaaattttggtaactatataagaaatcctgccaaaactttggcaaatggcaactataccaaaattttgaaatgtgtaaggtttttttagcatcaaagtgaacaggcccttagtttcaaactatttcttcaaacatccaatttttccatcacatcaaaactttcctacacacacaaatttccaatttttccatcacatcgttccaattttaaccaaacttctaattttggcgtaaactaaggccgagtttagttctaaactttttcttcaaacttccaacttttccatcacatcaaaactttcctacacatataaacttccaacttttccgtcacatcgtttcaaaccaaacttctaattttggcgtgaactaaacacaccctaaacacacccttaggtgtcgtaaaacacgtgaatgttatggaaggatctaatatcaaataaatagaaggggtgaggtttcgaacccaggttgtctagcccaccaccttgtggagctagctggaatacctaggtgtttctccactttaggtgtcgtaatttgtcaccgagttcaaaattaattcctaaaccgtcgtatccaagggtggagctagaacgaaatggggagggggtggcactgcttgctttactctgctttaggtcgagtttaagctgatatgagtgtttgagtttgggttgaagagggcgcatatacggtgaaaatagatgaaatataactaaaaaatttcttgaccgggtttctgggcaccccctcttttcaatgtagctccgcccctggtcgcatccctcaacttccaaaactagaacacctcaaagcgttttcggctaacgtggcgtctaagtggtgtcgacaaagttagaaaaaacataggatgtcccgtcattttccctcttctttccacatcatcggcctcggcaagaactcctgcatcagcagcggacaagggtagtcctatcaacacatcctcctttcggcgaccacacgaacatcagcttcacgagcggcatatccggctgcagcgccgccgaccgggagatcacctgcaccacctctgtcatgctcggccagtccgacgggttaggattgctgcacaccagcccaagcaaacagtaacctagtggcatcatttgcatcaaattcttcggtactagtatagaagaagaagaaacgccattgtcgacggcgttaagcaacctccaccccagtcgacgagcaaatatcaattcagagcaacatatccgaagcatagctaaccaattcagagcatcatatattacatctaactgttcattgatttgatggttaactgtgcttcggatatactctctccgtctcataatataagggattttaagtttttcttgcactgtttgaccattcgtcttactaaaaaaagtgaaattgttatttatttttttgacttactttattatccaaagtattttaagcacaacttttcattttttatatttgcacaaattttttgaataagacgagtggtcaaacagtacgagtaaaaactcaaaatcccttatattatgggacggagggagtattgctctgatatatcaattcaatcgacggcagcttaaacatctcctggaacatgcagagagctcgttcgtcggtgacgatctcgagcaccagaactccaaagtactccggcacgatgaagcccaagcgggtttcatggttttctgtgactttgttaacgctacgtatacatcacatcagttaaaatcgtcatctaaacagattaggatcttatttgcactggttttgagagttgagggacacgtcatatctggtattgttgttcagggatgaattccagactcgacgacaaattgagggacctaaagtaaacttactacggaggaagaagaagcacttactgggccatggcccacaacatccggtccatctattttcatcgccactatacctccggcccacggacgcgacgcgcttacacacatggcccacatgccatggtgcgcaagcgcaaccctttcttcctcctctgtcgctctctctctctctctctctctctcctcttctccactttctccctcctcgctagtgcgctctccttggcgagctcgctccgacgaacgccaagcccattgctccgcgtgtggttgggagagtgagaagagaggagatattttcggtgcggtggggaggggggattgagagaggccgaatcaaccaaccaacacctgcctgattcatcttctcgatcgatcctggggggtctgagctaatgcgcgccgccccgatctcccgatccggtccgcgcgcgctcgatccccgcgcctgatttctcctccccgcccgtcgccgaggagagctccgtccaggtagcgcgcacgcatacgcaaaattttggcgtatttaatccatgatctgtgtttgcatcgaatggataggacgtgctcttttgacttcagtcggtgctggtaggatgaaacgatgcaaagatactgtgttgttgaagacataatccgatttaaaacatttcttgttaacttggaacaagttatcttaattttcggtagtgatagtttctgctgtacatttttttccttaccaaatctaattcaattgcagaatgtagtaatgtattgatgcctttggctggcaacatagagaggttcatggactcgtttctagttctgctagtttcggtacttacatattttctgcacatatctgcatgttttttttttggttgaacataattcagttgtataatggactgatggcttgattagtaagtttcattggaaatataaggagcggaaatcaagaattcattccattccttgcttaatgtatgccattgatgatgaacttcagagttattttttagagtaaattgcacagaaccccatgttttatggtcaacgttgcttaagagtaggtacaatagcaggctataagccagctataaacatattttaaagagataaaggaagagagagaacagcagcgggctacagatttgtagccagctgcagcacggactccaaaacgtaatgtgtgtatgacaggtaggaccagatattaatagtatagtaagcaactattgtatgaattggctattacattggctatagatgatttggagctaatagttggctatactattaaacttgctctaatctatacatgtggttttctgcaactttgaccatagattgaggggtgttctaaaatttactcttatttgtaacttgtcggtttgtccatacttgtgctatacacatttactgaatctaattgtatttatcttacagtgaggtatggcgcggagttcaactgagagcaggaccaggaccactgtatctgtagttgttttatttggcctttgttccttcttctatctcttgggtgtgtggcagagaagtggtttcggaagaggagacagcatagcagctgtggtgaacgaacagactaaatgcgtggttcttccaaacctgaattttgaaacccatcatagtgcttcagaccttcctaatgatactgggagtactgaggttaaaactttcgagccatgtgatgcacagtacacagattacactccctgtgaggagcaaaagcgtgcaatgaccttccctagggataatatgatatatcgggagaggcattgcccacctgaaaaggataagctctattgtctggttccagcaccaaagggttatgctgctccttttcattggccaaagagccgtgattatgttcattatgcaaatatccctcacaagagcctcacggttgagaaggctatccagaattgggttcactacgagggtaaagtgttcaggtttcctggtggtggaacacagtttcctcagggtgcagacaagtatatagaccatcttgcttctgttatcccaatagccaatgggaaagtgagaacagcactcgacactggttgtggggtacgtaaaggattcaactctaaagatgcaaacttagatgagcaatcaagcattagtttttgttgttcttatcatgttacggagtttaatcttttaatgctttttcctgccacaattttgttcaggttgctagtctaggtgcttacctgttgaagaaaaatgttttgaccatgtcatttgcaccaagggataatcatgaggctcaagtacagtttgcactggagagaggtgttcccgcatatataggtgttctcggatcaatgaaactgtcattcccatcacgtgtctttgacatggcccactgctcaaggtgtttaattccatggagtggaaatggtaaaatcacttttagaatccttactgtttaaaatgttctcatttaaagtttacacatctgaagcaagctggttgctctggttctgcagatggaatgtacatgatggaagttgatagggtactaaggcctggagggtattgggtactctcaggcccaccaattggctggaagattcactataagggatggcaacgaacaaaggatgatcttcaaagtgagcagagaagaatagaacaatttgcagaacttctttgttggaataagatttctgagaaggatggtattgctatatggagaaagagaataaacgacaaatcctgccccatgaaacaagaaaatccaaaagttgacaagtgtgagttggcatatgacaatgatgtatggtgagtgacattctttctgacatcctccacaaaaaaatatgccgttttaatctatatgatcttttttttttgccttcatttttctagcacttacattcttctgaattcaatttccttcactaaatacaggtataagaaaatggaggtctgtgtaactccccttcccgaggttaaaaccatgacagaggttgctggtggtcaattagagccatttccccagagactcaatgcagtacctcccaggattacccatggttttgtacctgggttctcagtccagtcatatcaagatgacaataaactttggcagaaacatattaacgcttacaaaaagatcaataacttgcttgatactggaagataccgtaacataatggacatgaatgctggccttggtagttttgctgctgcattggagtccacgaagctgtgggtcatgaatgttgttccaaccattgcagatacttctacattaggtgtaatctacgagcggggattaataggaatgtatcatgattggtatgtaatgcttctctgtattgctctcctggactcatgttttggtcattgcactctatttttctcacttattcagttattcttcgtgccattgtttctgcatactattttttgctttttagaggagacacattttactttaccaacatggaaaacctattttttttaatggttttcatttgcttcagaaacatgtcaaaaacggatcaatttatttacttctgtagagactgaaggataggattgaactttagctctgccaatatcagttcaagctcttcatggtgaagttgcataataataaaatcagtctgttagttattctgctattgtaaatatgtgtttgttttgactgtgctgactgttagctttgatcagttgaaatctgaaaagcattggttgcttcttgttacataggtatatgtgttgaccatagtttttttattctttgtacaggtgtgaaggattttctacatatccaaggacatatgatctcatacatgctaacgctgtgttcagcttatatgagaataagtaagaatgtcatacattgcaaaaacaagaatgtgctcctaagttggtacatcttcctaattgatattttctatttacaaaaaacaggtgtaaatttgaagatatactattggaaatggaccggatcttacgaccagagggcgcagttataatccgtgacaaggttgatgttcttgtaaaggtggagaaaatagctaacgccatgaggtggcagacaagattgactgatcatgagggtggccctcatgtgcctgagaagatactctttgcggttaaacaatactgggttgttgaaagcaagagcagctaattacatatgctgggttgtttttttccactgagctcccaacaagacctaagacatgacttaattacatatgaagggtatgcatcatctacctcctctgtaaacttatagccactgtagtcaggaatgaactcttggcagcttgagttttccgaaaagttagcacccttgcaatgtggccttgccagttcttttcaaggtaaattgcactgcaggtataaatctttttcaaaaccggctgcctcagtcttgacaatctcaaccacaggtttcatcttttgatgtaaatggcttggatttgaaagttcatgtatgcaaggcttgtcatgaccgtatttcttttagccagttttgtctagccttagctggtgcgacaatttgagaatgctcaaactggcctctaatcttgcttgtttggtgcatttgtgctctaaggaggtgtcgcactgtaatgaaactgagatccataagattctagtattctgatcgtctgaaccgaggtgaccaataatcaaatttagctacgtatgtaatagttttttttctgttggtaacagacgaacgatttatttttagtgctatttgaggctgtccttttgagattcagttatacaaatgttgttcgattttgatggagctgcaacttgcagttcgtctgttgcaggcatttctctactgaaaatctgaaatgggtattggtctgtcggagtgttttgttttaccgggaaaaacaatttttctattgccagtcacctgtttttttggagggttttgcttatgtgtccgtattaatagtaattaccaaaattcaaaatgattttattctaaatggttttaacttgggctaaccaaacggatggttagatgtattcactctcgtgcatgcaatgtacaaaacttgcgtgcaggaattatgtactatgccggatggttagatggttaacttgggctaaccaaacggatggttagatgtactatgccggtttagaagcctcatattattttttttttcatactttgatggaaattcgggttccatgacgcctcacacttttaaccctaaaaatagaagtgacggactgtagattatcagttaacaaatagttattttattattaaataatagtcccagcaacatattgcaaccaagaaatagaagcacctttactttgtaataactggaagtccctaagacaatctttagcctttacaccatcttgcgcatgcaatgtacaaaacttgcgtgcaggaattatgtagcaaggtttactcaacaagtcaatatatactgccagagaaaactaataatggatgcatgaataataatttaacaatttatattttacacttccatcattcataactcatcatcgagtctaaatgtatttttgtaaaagaggttttcctaaaaagatttgaataacaagagaaatgcgtgaatcataatttgttataacattgtgaaagctcgtgggccacatcttttgtcttacaacgtatcccctccatcccaaaaaacataattaaaccttaggtttgaatctggacacacacatgtgatgtgtttagattcaaactcatagtttaatttttttctgggacatagtagtatatgctcataccaaaatttaaatcttaaaacttaattttagaattaattttaaggtttttattatggcttctttttttaatatcggagtttaaatcattaaaaacacatatgtaaaagttttaaccatatattatttttttacgctaatatgtcttttggcgtattatcagcaattggccaactgatggcagcttgtatcgcattacaaatcatgtatttgtaaatacttgctttctcttttttatataatggaatgtacttccggcctttactcaatgagctatagccaattattacgtcaaatcgctcaaaagcgctcacaatctaataagaccacaaaacacaccaatttaacataaagcaacacaaattaataagcaccaacacaagatgaaagacccataattattgaatcatatttgtaaatacttactttctcttatttttcgcccatcgaatgcatcatcgcaaaaaatattttctctataccaaacaataaaaaataggtctttttaatgccctgtttatagtccagataatttatatgaattttgaagaaatcaacatatttagccaaatggtagtactaggcttgacagcaaggtgtgacatgcatagccattatccagtcaccaatatccccattgttttacttatgcttacccttctaagccaaaatttaaattttaaaatttaatttcagagttgattttaagggtttgtcatcgtaatttattttacactatttgcttttgaacgctaacgacaagtatacagaacatttatcataaataagattttcttacctataagcgatatggataagcataagtgaaacaatcgaactgcaaaactactttgcgtgagagatgatcacgagcacttcgatgccaaacttcacaacgctgccgactataaatcatcgtatatcactaactttgtgttcatatatcgaagaaatatctatttctaaaaaagtgcctattttcaaaactatacttaaaaaatttaaaatctaaatcttttcatgtatttggattaggggctaaaattttagtccatgtcacatcggatgtttgacactaattagaagtactaaatagagactaatgataaaacccattccataacctagactaattcacgagacgaatctattgagcctaattaatctagtgatactacagtaaacatgtgctaattataaattaattaggattaaaaaatttgcctcgtgaattagctcttatttatataattagttttattattagtctatatttaatatttttaatatattagtcccgatatccaaacaccacctttaaaaaaaaactacggaggaactgggatagttgatgcgcaccggggcacgcacgcgccgtgcgttgggcgtgtggcgcaaccccacgcaccggcacgcgccaggccggcgctcccgcctccagaggccgccaccggccacgcgcccctccacgtggctcctggcccaccaccagatctctccaccgacccccacagacaggtgggcccgttcactcccgtggcccccacgtgccagtgagaaaccacccgccgccgcaacgcgcgcgccacgcgccgcgtcgtgcccctcccgcgcttgactcgcctcgccgccctctcccccttgctgttattgctcccttcgcggctctccttcttcttcttcaatcttcgccctcctcctcctcctcgtacgcgcccacgcggttctctttctgccccctcgatcgatttgaggtttgcccttgtttgctgtgatgttttgcgctgttaattgggtgattaatttgggggggtcgggttgggttgggtggatcgatggctgatgggttctttcttggtcgattggttttcagcagggaacggaagggggaggtttttggaggaggccatggtgccgtcggagaggggggacgtcgccaccgccatcagacccgccgctgccgacaagctcgtccatgggtgagtgactgaagtttcttggttgtctcgtttggggacttgggggatagttcttgttcttggaggaagcaaagagatagatgctctggggatgctaaaatttttgtttcatgatttgtctcgaggcgcagtttgtttgttaggcatcataccatagtgaatctacagaattagtgatgatgctcactactcaagcagcaaccctgcaatagtaaatgtggaagcctgccaatcatactgcgttagacgccgttggtggcgtagagctatatagtggtattggcaaattatttgtcgtcaggtttattgacttagttgttatctctgcatgtcgatttaattcttatcccttttccatttgggaggaaatgaaagttgagaattgtgcattgttgctaatgttgtaagttcccattgaaaccttgtgcaggcctatctctgacaagaagtgccggaagaaggtcccgaggaaggttcacaaatctgagagggagaagcttaaacgcgggcatctcaatgatctgttcggcgagctgggtaatatgctaggtaagctgttttgatcacaaggcattgcgtcagttctatgtgtctgaattggaaatttattatagcttgttgcgcagaaatacaaaccacatatctctctcttgaatgtcattatataattcgtattactagcaactggattcatcattgcttaaatttgctgctatttagcatctgatcaaatacaacaaccttctgcagaagcggataggcagagtaatgggaaggcatgcatactaactgacaccacccggatcttaagagatctgctttctcaagtaaaatctctccggcaagaaaacagcaccctccagaatgaatctaattatgtaagtaatatttgctatggaaaaaaaaaactgttgatttgttgcagttgtagaaccatttccctttctttggcgtgcttgatgatttacattgctaacttgtcgtatgcataatgcaacactcattccaacattgttttttctcccacaaacaggttacgatggaaaggaatgagttgcaggatgaaaatggtgcgctacgcagcgaaatctctgacctccaaaacgagctgaggatgcgtgcgacagggagtccaggttggggccatggcgcgactggatcacctctccccgttcctccctctccaggcacggttttcccatcgcagcagccaatgcagccatctcccatgacaacaagcacagtgttccccttgcagcagccactgccacaaccaacagtcattgagccctctgcaagacagccactggaactgaagctcttcctagaagcaccccccgccgaagaccctgaaccatcagaagaccaggaggctccgaacaatgtggcacgaccgcagccgaggtacccaacagaggcatcttcttggcctattagcctgggacttccaagaatggaagatgagcaaatgtagtggtagcacgatagatgatagcacaggtagagattgagagggtctgtttttaatgcatgcaggaattccacacgaaaacacttctgtccttgcatgaaaactggaaaatttcctgcattccaagtaagacctgagtagatcagctccaaccaatcagaaactcactttgagcctagaggatatactactgaatgatgtgcatgtaaatatttcaatctcccttttgtttctgtaaactctagtgagaatagaacccgttttatccccttgcaaatattgatgtccaattaaaatgcatttatgcgataattgcaatcgaaggaaaagttatgaaagaacaaaaattgtaagactatacgcctgtaaccagcctccaagccaacattatcacaattctatcgagtctgacgaaccagcaacatctcaatacaactatgcagcacctggcaaccaaacaggctgatatatagtagtatagcattaacattgaacacttgaatattttccattgctgttattcagaagaacaatccgtacaaaattttatgaactactccactccgtagctggaaaaagtcaccatgtcctttcgcacataatgtatctactgatacatcttcaaacacaccaacggaaatacgcgagagattatggccggtttcctctgaatggcgaaccagatgcaattgcaggtggctcttccctgtacggctgagtagcaggatcagtcacactgggcagtctctgtacgctccccttcccttttctagcattagggccaatttcttcgatcatgtacttccatccgtcaataggacgcctccggctaaatatgtgtgttttgatgaagctagcaatctgcagtcgcatttcaacaccatgtcagaaataactagaataacacaaaaaaaattgtggagagagagtgattgtggacctgctgtttactgaaagcaatccgcctttcgaattcttggagaagaatgtcatcttcccgctgtgagatatcccatatgctaccatcctgtcctctagaggtggtttcccaaccatcaggcttggttttgatctcagcagtgcttggaatctttgaatcgccaaaatctgtatttccagaatcgaaaatcctgtatttcacaaaattataagccagctacgtgttatagattgctaagcattttgctcacatgaaaaatatgcattcctaacttagcaaaaccaagagcttacggaaactaaaacattgtacaagccataaagcctccccaatcatgcagcaaaaaattgttatggcaggaagatatgcaaaaatgacaaatagactgacagtagcattaggagttttggagtgctgccataataccgagactatgagagtttatgttttaatgcctgatatgctgattactaagcaattgtagcaaatgaaaagaaaactgcataactaatgtcattccaaatgctcctgcttctatcaactaaatggtgagcagcaaatgacgctaacatatgcttgttcctaagcaaaatcaagtaaacatcgaagcacagtacttcctattttttgagaaaaaaataaatttgagggtgaaagatgtgaactgtactagatccagaagaaattcacatagtacgcataatttgtgaaaccaagctgctacattggaagcttggagataaacaatatatgcaacacggttatattttgaatgaaccacaccagatcaacatttaatttgtacatcatgcaacaaaaaggttatcaatttgacatgcagcaggtgctatgcatcaaaaaaataatcggaggcataatatacactattcaagtcccaagttatcaaacatatcagagtttcaccaatgagcaactataccagatgaaaaggaaatcacagcttttccaggctctagctacaaatgaactagccataattcatagtattgcccgacagtctaacacaatacctatctaacttataaaatacagctgaaatttgatacagattcatggtctatcagctccagattccaccaccaagtgcggtgcacaacgaggaatcaaataatatgcaagcgacattttggcaggcaaatacagtttaaatcgcaaatttgtctaaggggggaaaaaattagagcagcaacttactcagagcacgagtcgaggagtcggtcgatgtcgtcggcgccgccgcctccgccgccgaggcgcgcctcctccatcttctcgatctccttcacccacagcgcggcgtgcacccgctgcttcctcgccctgtactcgtcggcctgcgccttcttggccgcggcgccgcccgcaccctccgcgcgaggagcggggcgcggccgcctcgacgcggcgcggcgctcggcccagcgctcgtccatgtcggccacgaaggccttggtgtcagggtccacctccgcggagatggccgggacggtggcggcccccgaggtgggggactcccacggcgcggcgggcgccggggaagaggtgggggagtcgcccgggagccatgaggtctcccaggcgtcgttccactcgtcgtcgccggtggtcgcggtggcggcgccggcggcggctcgcgacggcggaggcgcgcggcggttagaggagaggcgacgcaggccagaggcggaggtggggacgcggagggcgcgccggagcgagtgcatggtgtgtgttcggtgaaatgcgcgcagagaggctctcctgttccggagtataggtagcaatcaactaagaaatcctctgcaatttgatacccatcttatcataagccctcctaaatacatttagtttggtaaaaaaaattcttttcagaaagacaatacaaatattgatgctcacagaagcgcgcacaaccacctctatgaacgtacattcggaaaactcatccgacatacgttgacattaacgaagtcatcacaggcacatcgttgtcgggtgcatcatccaccgctggaaaaaagaattagtcataaatgcaagccctcgtatcaagtttaagacttaaacccgagtggactatttccaacctaactagtcaaactacgttacagtgcaaaattccattaaaaacaactattttgaaaacgttgttataacgtcattatacccatccacaaaactcaaaaatccaaatcattaagaaactaactggcagagatgggggagatcgctcctctctcccccctcggtgctcctctcgacaactgagtgatattttgccaccgcttcacattatatattttgtacgctttgatcaatgagaatccatccctctcgctcttgctcccacactctcagctgtcttttcaacacaaattatttcaataacttcaatcaaaaccttttatgtacttatggacagttcgactgaccatgctccttttataagatttgcatatttggactctactactgtacttcctaaaggattagattctgaaggtatttatcctacagcatatcttaagatttaaacctcaatttgccaacctggtatttcttttttcaaacattatgaaactacataacaagttgaataaactttacagtgttacaaagaacttcaagacattatcacaattcttaggtttaatggatcatcggatcagtaccgtttaattgttgcaagagcacggaaaattaagtgcttcttatcacagttgatagcatactaggattaattaattggaggtcatataaaaccaagattcaatgtattatactacaccagtgttagtaaaatatttgtaatgattcttttttatgcatatagcttcttctttagaagaatttggaattcctttaccacacgtaaagagtagaagagataaagaaaaaaaaaagatagaggagaaaacaaagcgagaggtgttcaaccataggcccataagacagcccactatatcatctaaaaggccacaaaagataggcccaccaaggcaaaagctctagggttagggtttagcgcctgctttataaaggactccgcccccaactctcgtccgcctccactgcctccctaaccccacaatccatctcgccgcggcggcggcggcggccgagaccggcggcgagcggcgggggcgggggcggcgtcagccatggtgcgcgttagcttctatcgcaactgtaagcaacatccttgccttgtctctctgtacccgtgatccattggatcacagaacgtgatagcagtagcatctgatcccgagctagcctcttcagcagttttgataagttttgatacttaattacttggttccgcatttgaatctggagtccgagatctcgtcatttgaatctgttttggtagtccacgggcagattaagggtcttgcctgatttcacaaaggtaactgatttggtacatttgagtcgttttggttaatcggcttgctcgagtttgccagttgtcaatagttcgtttatgtgaattaataatcacagtagtcgtgcttgacgtggaaatgaaaactgcactctgaaatgcaccttttgaatcctaaccgaaagagtaaagtgtttgactataggggcatatatcttggagacgttcgctcatgatatgaggatcagtagctcttgatataaattgactgttgtttcaaacgtggttttttatttgatgccttagattttcgtacatttacctgatactcatggtgtgttgggctatacatgtctaatttcgcaatattaatatttctcagatggcaagactttcaagaaaccaaggcgtccatacgagaaagagcgtcctgatgctgagctgaagctgtatggtgagtatggcctcaggtccaagtgtgagctgtggcgtgtgcagtaagccctaagccctatccgcaatgctgcaagggagctgctcacccttgatgagaagaacccccgacgtatctttgagggcgaggctctcctgcgccacatgaaccgctatggtctccttggtgagggccagaacaagcttgattacgtgcttgcgctcaccgttgagaacttccttcagtgccgcctccagaccattgtcttcaagaacggcacggtgaaatccattcatcatgatcatgtactcatcaggcaacaccacatcaggtatggatttcaaatttcttatatgactggtgatttaacttaggtacactgctgaaatgcatatgcataaataaacatgggcttgattgaacattgattttctgttttgataacctcatagctcagtattttcgaactgcacttctgtttttcattctgggtcatgtgatgagaaacaatatgcaactcacgacggtcgtctgagacacttagtgtgtaatggtgcagtcatattatctctgatgccctgccatttctctttaaacttcttacattgctagggtcatgtatgtttttagttttatgtgaaccacatactatttttgcagaattttataatatcttattgttggttcataattgtcattaagttggtttggcacttggcattatgtagtagttccattttgttgcccttttttgcacatttttcttggagtttgtatttggtggcacaatgaggaactaactttgctaatgtatctatgaggccattaggctaatgactcaaaatgtccttttcattctgagtgccacattgtacatgactttgtttttctcttaataatggatctcacttgtctttcattatttgcatgttaaggaattgcgtgatcccatcatgtccacggtgattgctaggatttaatttgtgtttagtctcatattgatgcataaagctatcacagctatagtacttgtgtaaataggtcctgcaaaatgtgcaaaatggatttagtttgtctttgcgtagttgaagcctagattacttgctaaatgttgggttgtgcagagtgggaaggcagcttgtcaacatccccttattcatggtgagacttgattagagaagcacatcgacttctcccttaccagcccactggcggtgagcctggaagggtcaaagagaaagaaccagaaggaggcctctggtggtgatggtgatggtgatggtgatgaagaggaagagtgaatatgtgatgtcagctcggttttgttataggacctaattttgcgggaacttgtcttattagggacctaatttttgttacatgagtagaaaacaaaaattagccaccgagggttgtcaaaaattgttgtttgcgctgttgaaattttgatttgaagtttatctcctcatgaacatgtgaattcagtgtacccaggaaatatatcccaggtctcacaagctaatactgttgggaatatttgaagtgttgggtaccttgtcttttgaaaactggctttgattatactaaagcggatactaaatctggcctcaaaattgttctaataaatctggaattcgaactcgcaaataatttgttgtcacgcaggcatgtatattctagggatcttttgagtttgttggtgcatatgcgaaaagtggaaaccgctactgctgttgtgaagcgcttcagaattacccgttactgctgttgcgaagcactccagcattacacgttatcgcacgacgaaacgtcctaatttcagcttgttgccttcgttcctctgccttgccgaaccctctctgtcttcttcacttttattttttctatgatggattaaaactgcctctacaccacaaccaactctcttacggtgccatgcgatgtgttatcgttcattcgtgttattctaccatctaccgcctcctaatcactttcccagggattcccctagcgcctaaccactatatcttagttgttcgatagcctccactatccaacacccttctctgcttgttctatacccccatggcttcaatggtaccatcttcatctcatcacgttgtgtttacaccttccatattgctggtcctccatcaccttgacctccccctctaaacctagagccagtagcgcttggcaatgaccctcaacccttaccccgtcttgtcgatagagaagataaggaactctccaaagataaggatgcaggagggcaatagtaacatgaaaattgactaacctgacattgttagccaaaggtgtatcttgcatttctggaactacaatggaagtcatagcatgtttagctatctaatctaagctctcaaatttttaagtggtcctgcacttggaaaagtttggagattgagataggatcattatgctagagccttttgtaattgctctctaagtttatttccaatgcggtaagttggtaagtaacttcaactcagtatgttggagacatattgctttggaggagagagtggaatatgttggcgacatactgcctaggagaagaaaggggatgggggcaagtggcttcatggggtccttgtgccttctgcaaggcacgttaacctcacctggcattctatgtgtggtccaagaaggagggagcattgacctaagcatgaggaagtggtgatggagatcttatagcgatagatttggcgagcctgtagccacatcaggcgtagtcattgagctccactcaccatccgcaaatgccatcgggatcctcatcgtcatatccactccaccaagcccctagtctgagaggacaaacaacggcggagatcatcactgcagcaccaaggagatctgagataggatagctagccaccacaaatcttgtcaccacagtgcttaagaagggagcaagcataggcgaagaggagagaggcggcgaccatggtggcagcaaagaagggagaggagagctgatggagtgaatgagtgggagagagtagttatattgtttagtttatggaatttaggaagtgtagtgtaaaattttgaacttccttgtcatttagaaatagaagaggactaaatataaaatgttagaggctttgaagctacctatataggtaatcaaatgagccccatgacatgattaggcatggctagtgctaaaatccataaaatccatgccaatccacgggctacaccaacggctcaggcatgacctaataagactcgggccgtgccgtgccgggccgaaggcacgacaagcccagcgggttcttccttggaatatatctattttgcatccgtcatctatttgggccttgtctgataaggctagaataagtctatttgcattcctcatttctttgggccatgctttatttggctaaaataagcctattttgactccctcatctattttgcctccctaattgttgggttgtgccgtgatgggccggcccaccatgccgaggcagaggcccagacacagcccaacagttgggctgagctggtacgggttagacactagtcgggccgtgcatgtctgggccgggtcgtcgcgccctgggctgtttagccatctataactccatgaggccattgattttgttttacatttgcacatgtagtctcagcatagatagtagccatattgtattcgaggcagggtttatattaccgtcggtaactatgcggttactgccgttaccggccttaccgcgggggtatggtaatagaaaaaccgcggtaacctacttaaatttaaataaatttaaaaaataatttgaatttttgataaattttgtacggtttcgtacggtttttcacggttaccacggttaatgcgcggtaaccgtgcttaccgccagggcacggtaaccccggtcccggcggtttgggaaaccctgattccgaggtaactcggtaaagccgcttgcacagttttgcattgtaaatgccctgatcgagttgcatatgcccgtgatgctacagctctttcccacaacttgggacaggaagactcagtgaaaaaaaaaaaacaaagaacagaatgcccagacaaccctttctaaaagacgtgaattagttgacaacccaacggcttattattccctttcatgattcctaacttcttttctggaaaaaaaagcatgaaagcaagcatataccttaattaagcacacatgacacaattaaacaaagaacaaccaagtcagagcgatatgggtacgcaaagtcagcagaggaggaatcaaaatctattcctccccgagcagcgactcaaacgtaacacagctgagcagctacctaataagctagctagctcacgtacaagcatgtcgtcccctctctctctctctatatacatatatatgtaacgaattaagtcaatgtataagcaaattaaagattgtctgcagaaaggaaaactcaaacaaatcaattagagagagagagagagagagtaaatcgatcgacaatggcggaggcgatcatcgggccgctggtgtggaggctgcaggagatggcggtggggcaggctcgggcgctggtgtcggtgaacgacgacatcgtgaggctccgggacaggctgatgtggctgcaggccttcctccgggaggccgacgccaagcgacgcgccgtctccgacgaggtcaacaaggtgtggctgctgcagacgcgcgacgccgtcttcgacgccgaggacgccctcgatcatttctatctccgcgtcgatatgtccaggtatatatagctgctactagatactccctctattttttaatagacgacgccgttgactttttcttccatatttgactattcgtcttattcaaaaaattttatgtaaatatataaaatataaatcacacttaaagtattatgagtaataaaacaactcataacaaaataaattacaattacgtaaatt

SEQ ID NO: 43924 - DNA, 2530 bp, Oryza sativa
agacatgcttaaagtgcttttgatggtaaatctagtaatactccttttgctttacttaaactaagtaattgtataaatattggttgttatatattaaacacttgatcaaacaccaccggtccaaacactcaggaattataacattccagtccttttgaaataaaccctgttaaagtatataagaatggacacctaggttaacacaaaccccgaagttggggtcaacaccataccttgtgggacctcttgggagttcaatagcaacaaaccattgcaccacctagaaggtgatgacatgatgtggtatattaagtactagcataatgcccctgcgttgcaacggattctaaataacatttattgacataaattaaaatcctaaaccatgcatatatcacaattagactgaagggaatatgatcacagaaataacagtattaaactacaactaactttggctggaacgatatttcaatatcagaaaaaattatataactaaatccttattttatttagctataaataattcaatacagaggaaattgcaagttacaataattttttagtggatcaaatagcactaaaactaatatcgcaaacgaaaaaacaaatgaaattaactagaaattaaaaaagaacctattttagcccattgatgaaaatttgatccataaaatctgaacgggtacccgtttcattgatataaattagaatttcatgttctgatcatattcctatgatctcaatattatgtaagtggtccaggagcatggttgggctagaccacgaaggattagagccttcgtccatagatggtggaggttgccaatgaaaaaaaaaatcaaaacaacatgaaacaagaaacagaaaaggagggaagatggacatcagtcctccggcgaccaaactgtggtgagtaaggtggccggacatgccccacgatgtgactagttcgtagatggtggtggttggcaatgaagaaaaccagaatagcaggaacaacaatgatgtggtcctgatagagagagaaacagtaacgacaagctctggtggtgaggacgaccagatgagtgcgtcaaaacgtgttcctggatgaggaggttccgttttccttgaatgtgtaggaagaacgaaagatggagaaaggcgactaacgttgttcattgtcttccctagcctaaacaaaaacagaacatgagtgaagatgggcgctcatgctctggcgaccaacggtggtgagtaaggtggctggacgtgtctcatgatgtgactcgtccatagatgatggagggtggcaacgaagaaaaaccagacataggaaacacgaccagcaacaacgttgtcctgatagagagagaaacaacaacgacgagctcttgtggtgaacacggtcggtgagtgtgtcaaaatgtgttcccagacgaggaggttccatttttgttgaacgcacaggagggagggagtgtaggggagaagaggagcgctgggaggagggggcgacggggaggaggagcgccagagaggagagaggccgtggggggaggagaggggccgggggaatggggagcatgtccaatggggttggatcggatgattttttgggattgtgagagagagatagaggtcgtcgggaggaagggggatcaggggaagggaggaggtggaggcgcacacgagagggagggagggagggaggcgtgcggcgcatgggagggagagggcagccaaaaatctcgtccagaagccttacgcatttttaattaggtatatattaattgtcgatatatgagttcagcgtagtgctgacccgatgccacttgtgcataaggttccgctaacgtggtagcggttactataccatgctcgctggcgttgagccattggaactcagtgcctttggccctggttctgtcctcgaagtccattttttatatagtttttgtgcagggttcatttataaaattagttttgtaaaaggtcaaagtgttaaaatttcagccaaacacttgaccatatgcccataataaaagtaaaatgttgttacacaaagtgcacatgcacggatcatgcttctttccctccctacttgaccctaagttcggacttcgcatgacgtatcaacaccgacaaggtgtgcaatggggtgctaaccctagcagtggacatgctttgtggcagttctgacacataatctccttcagaggttaaggaaaatggttacatttttatccccatttagtttaaaagggctaagtccatggtgctatggttggagcacaaatgattgtatgttggcttgaaattatctaaactcaggttagactaaactggaaaactagagcaaacacatggcaaaataaaaaaatattaatgggcaaactagaaagtaattcgagcaattttgttttttcccctactttgatgtctaatactgattttacccttactttttagggtttttgttttgcccccagttttttgaaccggacgatcatccggcccctattttggatggtgcaagttaaaggtg

SEQ ID NO: 43925 - DNA, 2846 bp, Oryza sativa
gtgttgcaagacaggaacttccgagcaattggtaaatcagagcaaagattcaaacttcgactcaagaaacttgacctattagagcaatataaaacataggataacaaaaaagtaaatggatcacagagacgagcacaaaatcatcatagagaggacaagagggattttttttcctgaagttcggatcgcacgtatcctactctctgttgaggaactctgaagagttgggtctcgattaacctcttgcctctcttgtgcaaagattccagaaaaggtccacagccttcaatccaacacccttaggttattctctagaatttgagtgaccgccaagatccaactcaactttcttctagagaggaccacaagtgagaattgctctactaggacgatctctgaaaccttagcacattttccttaatcacttacctcgtttccttgcggaggtgaggaataccttcacaaacttgcccgggacatccacaatctcgaaggaagctcatgggcgacacctaaccgtctaggaagagacctccaagagtaataagctccaaatgacagcccacgagataccccaagtgctcaattcatcctaaccttcaaaaccttttgcaaatctctctaacaccctcacaatcactctctcacacaagaatggctcaagattttgggtgggggaagcaaattcaccttgggagaggctagaaataactagggaacggaagagcaaaagtgaaatgtccaaagaatgagctgggtctgagtttgatatatataacaaatatgtgacgtcatctagccgtcactcacagatttgaactgaagggtggaccggaagttcctggtcctggggctaggaacttccgaccaacatttaggaaaatgtcgacttcacctcagctaggaacttccggcccaaagtgccaggaacttccgtccggcccttgctgtcttgagaagacccattctaaaaatggctcttaaaaatatttcttcgcttggacaggagtaagagcacttgtactatctcagaaccacacctagaatccctcttaatagtatgatttttcctaaactcgaatgcaaaaaagtaaactagtctaatacaactccgagttctttcgccattttaaatttgttgatttgggggttctccaagcatcctgggactaaaacacttgcattttactccataaacacattgatcccttaaccacttcatcattaatcaccaaaaaccactagggggataaatgcactttcaattctggaagagaaatatttgtgaacaaacaaaaagtaacaaagaataaagtatgaaactatagtgacagcattttggatgtaaatatataatccaatggcctagaatcctgttggacagtctaataagtagatagatcaaaaattaatgttcccaatgatgaaaaatggtggaaatggcattccaatccagacttggtggtgtggttctcttctattttccaatctgcagatggcatatgatttctttaactacatatagatacaactgtgttttcttaatcacaccgaacactcgtaagtctttgacttgctaaaaagtggagatgtatattaataatgtttatatcttaattagtgtccacatataattaaacatatatggaattactttaattgttactttgaaaatttaccgcacacaattctctcagggcatgtgttgtggtgtgcatatgttgcatgtaaatggagaaaaaatagtagctttagggctacttttgattgaaggaaattcaaataaattttaaaggattctaaacacaaggattttttttgctctatattattgtttggaacaaaagattttagcataccaaattcccatggattgctatgctctggacccattttatatatagaaaattttacactaagcttaaaccttattttacatttcctttgagaagtccaatatacatcttatctctcttagttccatcaaattcctatggttatattccaatgattcatccaaacacaaatatgtttcgattcctatgttttgaattaccataggatttgttcacatgtgacactctaatcttgtcttcttttctattcctgcatttttgaaatcttgcattccaaatgatccctaatacttttcatgtaaaaggggttaagccactggaaagttgtcatgtttgacattggtagttatagcacaaactggtaaaccaaataatattggtaatttctttaaaaaattacacttatcatatcattaatgaaaatataactcagcctctacaccaaccattaatgtatagaggcttttaattatgggacttaagtaccatatagtcataactccagtgtcagaccaaatatacttcgtgatcaagcaagagcacatcgacgaaacactttttatagctccatgcatttttacaagagaaatgctatataaattatagaaaaagaataaaaacaaataatgaacatcaaactgaacattattcaaacctcaactgtcatgcatagttttttacctcggtcttgtttaatagtgattttggatgacatggtgccaagatggtataccaagaaaaagtaggtttttgagtaaaatggatcttatgaaatctcacttatagaaaccaccaatattcttgactaattttgtacatacaaaataaagtaggttaattgagttataaaacattatttaaaaccgaacgaaaccattttttttggggaaacaatttatgtaggttctaaatactctaatgtgcatgcgtgttctaactttttcagtatttactactccctccgttttttaatagatgatgccgttgact

SEQ ID NO: 43926 - DNA, 6523 bp, Oryza sativa
  unsure (1)..(6523): unsure at all n locations
gaggtagtagatgtttaaaaatatttttacttgggccatgttactgccacgttatgcaaaacaactttgaaatttgcccaaggtatgttgaaatatacaccatatattatcaaattttaggtctgtatgatgaaccgtgtggatattaggtacaaagtagaaaagctctcaaactaatcagaaatagatagacttaaatttagccttttaaatttactagaaaaagtttgttttttgaaattactagcatgcacctactagctgcttcatgactagcattgcataaatgctaggtggttaagataaagagttatactgaaatacgaaaaaaatacatgtacataaaagtgcatgcctcatcagtaatctcttctccttcataaagttacataaacgggttttgggcttatatatgtacacaagattctgaattaccaatatttggggaaaaggcagctagatggttcaaacttgatactgattctcaatacactgcactttggcattatgcaaatttactctttaatgtactaactgtataatgttttaactacagggatgatttacaacaaggaaatttgacattatatgaagagcaccaagaggaacttgagaaagcccttactccaacagatcaagaactacagaaaaatgataatcgtccaattgtggtctctgtatctggaaagagtggggttggcaagacaactcttgtgagaaatgtgtacaatataatgaagaagaagaattgttttgatgttcatgctatggagagttttgcacctcatttaacagcccccaacatcctacatcaaattgttcagcagcttacagaagacaacaagaattgtcctagaagcatggtccatgaaatgttggctacagcgttgagagataagaaatacttactggtgatagatggtgaagttagcagaactgaatggaagaacattatcactatgctcactacccttgcagtcggttctactggtaatagaatagtgcatatcagatttgacagaccagaacagtcgtctctctattatcatcatcacattcggttagaacctcttgaaaataatgttgtcatgaaattgttccacaagcgattacgaaaccaagacaagcaaggtgatgccggaggtccaatggtattgaagttgaagaaactactccaatttgatgcacaatatcaaaaacttgaagaataccgtgaagacatatgcaaaatcacggaagggttgcctctggctgttgttcttttatcaggtcttgtccaaaccaaagagtttccccatgagtggacagaagtattcaagtatcttagttccaagaaatcaaagcggctcgacaatctactgtccctgtgttttgatgatcttccacacgaactgaaatgttgctatctatactttgctgcatttcctcccaatgtagtggtcgaggcacgcaacttggtgtgtatgtggatggcagagggatttctaacacctagagttggaaagacattggagaaggtgggctacatcttcctgaatgagctgatttccaggaatctagtcaatcttgttcttgtagatgataattctactaccgggactatgttcatctccatccaaaacaaagtacatgagtttttgcaatctgaagcgcatgaggcaagtttcttggaggtgcatagtggtgatgacatccctactttgacaagtgctcgtcgcctctctctacagaattacacagacaagtatgcggccctagctaatccattgccaaagctacgatccatcttctctcagtttgagcaagagccaaaggaacaagagcccaaaggagaccaaactagacaatgttgcacaccacctcaacagtggataaccaacaagaagcagaaagacatcagatctcacataaaaggattgctacaaggatcagagttcctccgtgtcattgacctacaagggattgagattggtgatgagttgccacatgcaataggtagtgttgtgcatctgcagtaccttggaattacatcttgttcattgacagtgatccctccgtccattggaagcctgagtggtctacagacattggatgtcagagaaactaatgttcggaagctcccactgaacttttggttgatgatcaagacactaaggcatgtatttggttttaccctcaaattgcctaaacaaattggcagcatgaagcatatgcagacacttgactcaatagagcttgacaactgtgagaaggatttgattgggacagttggaaagatggtccatctagaaaatttatttgtttggaacattacaactggtaatatggaggctttgtttgctgctctgagcaagctagagaatcttaggaatttggccttgcatggccacattattccatcaaccgtgttcatcacaatctcgcttcgccgcctcaagtccatgaagttacaagggaaactaaaatttttatatgagataactggtatggatgtatgccttcctaatctcagcatgctttcattggagaaaacaaaggtatctcagggattcatttcaaagcttgctgaactcccatctcttgaaacccttgccttatattctgagtcatacaaggacgagcatcttttattctcttcaattggatttgttagtctgaagaagatcaagcttgatgtaccaacaacgctgaaaactattgagatagagcaaggtgcgcttcatattctcaaggaatttgatattctctctcaacgtccccatgtcaaaatcattgcggaaagacgcatcaaaaagctcattgtctaatgattttctaaatactaaaaagattgatgcaattgaggatgaagacatctaatgaaaaggtaattatggtattactactactgtgtgtgcttactatagtttacaacttactagccgctctccatcgaatgactaactgtgggtgccgatgtgtgtatgtgtttcatggcactctaacttgtatgttgcctgaagtttgtgttactgtgtgtgtttgactaatacctttatagcgtgtgttttatgtccaaaaaaatgtgcagtgttcgctcacttgtggatgctttgtaaataaattaagtgttcttccggatgctatcagtattgtgatgtatatgaactcatgtaatagtgtggcaaaactatgttgatgattgtcctgccacagggccacaaatatccttgtaaatattattgtgttatggattttttacctttgctatctgcagtgcacctaaaatcctttaccaagaatttgctagcaaagatcacatatgctctatggaactatttgtcaagaaaagttttctctgttgtaaaaccaaggcaaaacattagtggaaaggaaaactccaagcaattaatggatggatttgtttgttttgttccatgaacaacttcacagccatatatggcccaaccctaaaataggggcggaaatgagctaagcgcggagcttggtttggcttgcattgtggaagcttgatgaaagagacgctcagctcggtttagttaggatcacgagctaaagtgttgcttgtctaggctagttcttgaggtcaagccatctctcgtaaaccgacgaacaaaaacacttccagagggagtacaagcagactacaaaatcacaaacagacgacagccgcggtttggcacaccacaatggtcgacaaggtgatggatgacaatggagcagtgatgtgggcaggagtgtcacactaatgggcaagcctgtcgaaggttgtgtgcgacattggcgatgatagagtgtcccccaatttttttggggcacccaagttaatcggagaggcgcacattaatgcatagccgagccacaatcctgcttctacctgtgaatcgattagagaggcccatctgccatcaggtgcattggaggctgagaggcgaacgagatcaagtcacactgttgtgtagtcatgtcgtgtgactggagtcaatctcgatttcaaattcgacgatgaaatgacgatgcctgcaaagtcccgaccccagcccaacacgaggcagcgagcgaccaacgggcaagcgccatcaatgccaagcggttggccggctacctttgtcagtgcctctcatccacttatcttcgtgtccctgactactacctttgtgcagcattggaaagttacttttagacttaagagttgagacattgagtctcgtatcaaatagtagatgtaatatgaatcaaactatcgattgaatcaaaacttaaatagtgatgtgactgtttgactcaaattacttttcttttgtttatgaaataggaagacacttatttcctcaatcctcattatgtcagctagaaataggaagtacgattctggtgctgaaaagcgaaagaagaggcaaagaccagaagaagcaattcaatctcaaaagggtgttctttgatattttaaagttttgaaggagcgccccttttatcctaatgctattattgcatacaaagttttattagccattcatgtgaggctgtgaccgttgcatctatggaaaggagcttttctaaacccaagtcgttgtactatgatataagaaagactcgatggattggcaacaatagaaattgaaaatgatgtctcggagtagattaattacgtacatataatttaatattttattttaaaaaataatagacaaatggtgcttttctgtagaacatgaggttagcactacattgacaattttagcgttaatatttgatatatttttgtatgaaaataacacatattgaagttatataattgagtgaaactatgccttgtttatattgtttatattagacatataaaattttgaaaatttagggtccaatttgcatttcatcccaaggtcccaaattcctggagatggccttggtaatgggtctcctgttggtaggccaccataggggtgcaagctaaatgataaaacgattggctctcgagccaagttgagtcgacaatgcaagtctgagttacatcaatcatatcaaattctcacgcaatattatctatactactataaaggattataaggataatagtggtggtggttctatcatcagtctaccactctaccaccactattttacatgttttacaaattagttcttgatattttctgatattatgtaatagtcaatatttgtttgaatcaagtaattaacataatattcaaataagcatgggcatttttctagtactaaatagaaatccttaaggaaaaattttaatatcaataacttaacttaaagatgacgatgtataacaacaaataggaagcaataaaaatgtttaccaaaacaaagaaacccactgataatagtggttttttctagcatgatgaagtaggtaatattaaaaatccggagaagatggtcagaatcggcataatacatcaatcgaactcaatatccacaatagcctacactaaaagaagaacacaaatatcacaattacaacttaagaactatgagataattgttgacggatattatagaccaatttcgactatcaatatattcggaaatcaaggagaactagcaatgcttgcatgcatatttgtctaacaataatatatttccacttgtacttggaactttatttgtatatagagatcttcatacaaatggagaagaataatggaaaatattatcaaagacacacctccgaccaatcaggcgcgagtataaggattgaagggcccacaagtcaggtgaaaccaccacaaaatgggtcataactatcataacgccataaggacccaccagtcagcctcctggccaaaggataggccaggaggtggggcctagggtttggctgaaccgccatcaggccctttcatcctggccgtacacgtggacatccctgatcactccccaatgatggttgcggggcatttctgacaattccaaccgccacaaccatcattggcagcctgtttaaggagttcaccttatccacttcaacacaaaccaagaagaagaaatcaagaattctctttagtttatttactttgttctagtactagtggagtagaattagaatagtttcttagttcttcaagtcttccgaagatttcgggtatggctctagtatcccttctacctcttgtaagactttattcaataatgaatattcttatttatatagctttggtactttactttacttatataattattcgagtaccgacttttgcttatacttgtctcgtaaatcgtaataattatgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43927 - DNA, 711 bp, Oryza sativa
taaaatagcttaatgaaaatttcgttaaatcaaacgggtttagggtgattaattaattaattatgttgttcgctttgtgattcttaattggagttagttggatttaatttgtatttcggaagtggagctcaatccctaattcaaattccatccaaatccaatattcctttcaaatcctaaatccttcccaaaaatttcaaatactttatatttggaattttccagagaagtccctgtctttttccctttttccttcctctctgtttctctattctgcccttattcttctttctttttctttttcccccaccttcttctacctccagctctctctctccttcttgagctgcaggcccggggaggccaagccccgagcccacgtgccgccgcggcccggcctcctcctcctctctatgtcgccggcccaagccgccgccgaccgagcccgcgccggccgcgccgcaagcccacacggccgacgccaaatcccgcaagccgcgccaccaaattcggagccgccgcttttccaaagcttgcaccgtgcgccctaaccctagctactccctcccctataaataccatcggccaccgcccctttttcccccttttttcaaagccgccgccatctccaccgtgagcagccgccgccaccgttgcttcgtgccgccgtcgggagccgcgccgtcgtcgtcaccatcttcttcccgtgcc

SEQ ID NO: 43928 - DNA, 12204 bp, Oryza sativa
  unsure (1)..(12204): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaatttcacagcaaacacacaaagctaccagcgcaagcactacaaaccatccctctcacttggccattctcgtgctaggggctcgacatactcggtccattctcacgaggacagggcggctacagattcctgttcgtggcgatcgacaaattcaccaaatggatcgaggcaacacccacaggagaaatcaaggccgacaacgccatcaagttcattaaggggatattttgccgatatggattgcctcaccgtatcataacggataacggctcccaattcatcagcgccgattttcaagattattgcatcggactaggagtcaagaaatgcttcgcctcggtttctcaccctcagagtaacggacaggtcgaatgggcaaacagcatagtactacaagggatcaagacccgtgtctatgacaggctcatgtcacatgataagaagtgggtcgaagaactcccctcggtactatgggtcgtgcgcaccacaccgacatcgtccaacaaggagacacccttcttcctcgtgtacggctcagaggccatgctccctaccgagttacgacatcagagtatatgattacagaagtactccgacgagaatcaggaggaacagcgaaacgacgacgtgaacctactcgaggaatatcgagaacgggtcaccgtcagagcagttagctaccaataggccctccgccgatatcacgagaagctcatccgagcacgcatactttcgatcggcgactacatcctccgacgagttcaaagctaggcagggcgaaacaaactctcgcccaaatgggaaggaccgtacacgatcacacaagtcttgcggccaggcgcattcaagattgcagatggcgatggtcgcgagttagcaaattcttggaacattgaccagttgcgtaaattctatgtataagtcaatagtttccgtacttgtaagaagtcttacaacttcaataaagtctgttttaaggaacagatttcaatcacagtgccccttcccgatgatcccttacccggacgacacatagcgttgaaacctatcctcatgtccctttacgccgtcttgacaaggcctccaaggaacctaagggaacttcggctggggacacccagagctgataaggccttgtcggatccttcagagacgaaagaccatgtaagatatggtcgtgtaagagttctcgccgtgcatattaaccaagccgtgtaatcggaaatggatttttccaacttcacgactaggggctaggattagtgcttattcaactaaggcaagtcgagagtccaagagccttatctcccgagaagaattctccgatgacaaggctgggggctagggagagtgtataactcaagtgactgatcgaagtcgcgaagtgagaagacactcgtgcacaccgcatccagcgtaagaaagcttagttagatagatttcctttctgtttcacaagcatttcttatagatcgtaaagaatcctaaaatatattacaattttcttaagatgtgtgtcacagatatacaagcaataccaggaaggccaacgccaatccattgactagaagattttctccgccagcggagccatcgactttgctaggttgtctatctccgcaggattcctccgagaacaggaaaaacccttgtgaaggaactcgagatgcaactgcggacgatgatctcgtacacacgccagcacgtgccctccggcgtatcggctcgattgacgacattcctacttcagggcctcgtcgatacgcccaccgatgccatcaagctgagcacaagccccgttcaaccatgagatgaagccagccgctgactcctcgggatccccgcgaggtactcagagctctctgcagacaacgaccatggttggcaacaactcctgaggtacgagttgaaccatacctcgcgacctcggagcgcctccacggcccggtccctcttctcttccaatatagtcctctcaagttcggcgacctcgaacttcgtcctccagtactagatgcgacggtcgcgatcagcaagcatgctctcaaggtctgctcagcatgcaaacacctaagtcaagctaatcaagacagacgaggtaaaggaaagggaaacgacaagaaccaacctaaaggagtcgacgccacatccatctcctcgggcagatcctggtccatgccgtcccgcggcacatacggctcgagctcaagtgccggaacgactacaggcaattcgggatacccgtgctgttggacatcctcgacatcggcatctctacaaacaacaggcaaagtacccggaatcaaaacgccaaagaaaactaaggtaacgattgcacacacaaaagaagttggaaccaacgaaaagtattacaaagcgcgattggttaaggggtacagacaagcggtggccctactcttcaaaaagcgggaggacggattcccccaaatcaccgacttcttccatcacatccttgcgcgcgtcgctagccgccccctgatccaagatcttctgaagatcgagttcagggtgcgccagcttcacacacgcaaggacatggcatgccccggtataaatcccgttagacgtctcctctccgatcctggccgcgtgcttggagaggatcgcctccatcactgtcgcaagttccgcaagtgaagtcgtcagccataactcatcgggattcgccgggatggtggtcttgacaccgtactccccggcaagctggtgcagactagtgtaggtgacccgcagcgagccacggatttccgacaagttgttctcgagctccgacatacggtgctcgagcccctgccgttgtcgctcgttgccggccaccagttccctcatcttctgtaggttctcgcgaacctccgccagatcatgcatcagccggtcggcgcgctcattcgccgatgacgccgccgccgccctcgcctccgtgatcttgcggctaatgccgcgagcaccaacctcaaggaggcgccccatctcgacctagagctcctcccatgtgaggacggcagccggcgcaccccgaccagccgcgagattgctggctgggccgctgggcctcacatcgcggctcctgggcacgaccacaacatctgtcgaggccacggtaggagacgcgctagaagtccctccagatccgtcttgcgccgctttcgcccgcgccgccctgtgaaaggctacaattgagacgtgctgcatgagttcgacgaagtgacaaaacctcaaattcatccacttctcgcccagcgtcacaagccgctgctgtcgcggaggcgggggagacgcatccgaggcctggagtataacgggcgtgatgtgaggtgcaagttttccgactacgtgatgatggaccaggagagcttaccgagggggtgggcgtcttccgacgatttccgatcatggaggagaatttcctcccccttttcagaacgttgccgccacttgttgtggcagcagcggcagcaacatcaaatgcctccttggcgacgccctccttcagctacgccaccgcctgatggtccacgagcggtccgatgatatcagtcagagggagagcctacacttcgtgaagtcacaatgcgatcccggaagaaaaatgcaaaagggtcgccgagtacactcacattgatggcagcttcgcgttcggctgcccccttctcgcaaagagcaacagggacgttgctcaccgtggtggggccgctgatcatcacttgaccgatgcgatgctctacggtttcactgttcaaacctgtagatcaagaaccaaaatcgataagtcaggaggaaaccccgaggagaaacccgggtcgcgtcctccgaccctgagtagtcaaaggctggatgggctcaagcctggagcggctggatccgtctaccgatgaagtcggcagcgacttaatactccgacaaccctcgcactcggaggtcatcgatgacatcgatgaaagactgaagggaggggtcaaggcgggcttggcaggccaagacgaaatcttgtctggttgctcctcgggaacaacaaagaccggatccgagttttctatctgaagatagaaccacctcgcccgccatttactacgagaagaggggcactggaaggggatatagcgcgacttcaggccatcccgaagtcggaaaccaacgcatcctgataccctattggattccatccaacgcaactcatagtagaagcgaaagaggtcacgaaatagttctaccccaatgtaggcctcacaaagatgagaaaagatactgaggaaggtgatagagttggggttcaaatggagcagagaaagaccgtagaaattcaagaccaaaagaagaaactcagagggaggaggaaggaaaccacagagaatatagtcctcaaccgcaaccatgcggcccaggacaggttcaggttcaatacctcctggttccctctccatggtcccgcgatcggggagagcgccttcctcctacagcttcttcagcgacgcgcttgtagaagtggacttgtcgaggtccattcccgtcgaagatcgtcggagaaggggctgagatgaacaagctagggtttgtgtggaagcggagaagacgaagagttcttgaaggcttgaaagtttctcgcaacagccggactccaaaatggactcccaaaactcccttaaataggtgcactaccgacgatgcgaattccaaggaaaggagagagatgaccgccagaaatttctgggaccgttgcgcaaggcggtttcttggacttcaatttaaattcactcataaccgttggacttcgcatggtattgtcgatcactctttgtctctacggtccccacactgagatcgaccagtcgagaacgacaacaactccgacatcagaagtcatgattggttacacgagttcatttaagtagaagtcgggggctactgtcagggttacggataaggtataccctctacccttggatgtatgctatacggaaatacggtatagcagtacataatcagacgttctttgaacacactaaggaaatcaatcacgaagtctgccaatggaaaagttcctacccgtataggaatggatcgttactatatcgtacagggtccgatgtctccgagtcctacttcgagaccacctgacctgcgatataaaagggacccctcggggggacctaaggcatcgaatctcagagcctatacaacggccacagcttacgaagtcagagactacaggagcaagtcgccaggtgatctagtcgaataaccttgactacgatctcgtcggtaccgccgagttctattgctccctttgtaatatgtggttcttttcatataatcccatatcaactgattagggctattacctgctaaggagcttgaaccagtataatcgtcgtctcttgtttcattgatatcgtattacgtagatcctcgtaccagcgtaccccaataccctctatatccggtctacgggtacccaccttcgacagaggggcgctagtgagaagagatgccgagggagagagggagtgtgtgcagcgagggagagatgggtgtggggtgccgggagggaaggagggaggcaggagaggacatacgccagggaaaagagaggctgcgggggagggggagaaatgggggtgctaggagggagggaggtagaagcagaggtacgcgggagggagaggggccggacggacgaaaggaaggcaaaagccttacgtatttttttaattattaggtatatagatatagacttgtgctataatctatctatctattatatattccatccgtttcacaatgtatgtcattctagtattttccacattcatattgatactaatgaatctagacatatatacctatctagattcattagcatcaatatgaatgtgggaaatgctagaatgacttacattgtgaaatggaggaagtactaaaagtccattaaacttcctacaaacgctcctatgtctccacgtggcactctacaaacgctccgaagctgccacgtgccaaagaaacatccaacccttgatttttatttaaattagtgggccgatccttttcgaccattagagtagatgtcaaaaaaaaataagtaatccacccatactaatctacctccaaattgagcaccactctattcgtgcaaatgcatgtatacgtacgtactctgtacgctcctattcccattcttctcttttcattctattatctatatttaactctcctattttccttctcctaatagaaagcataaatttatgtaaaaacatttaggcaactatagcatttaaatcataaaggtattctaatatgcttatgttgttagattatttataaagtaactaaatcatatatatatgttttgatcacactactaaaaaaaggcacatagagatcggtgttataggtgctagaagtgataaaaccgacacctatataccatttctcacctctacgggttgaaaatacaaaaaactagcaactttaataaactataggtgccggttttctgtaatataggttttctgtaatataggtgctggtttttttaataaaaactgacaccttcaatttataagtgtcagttaattaaaaaacgacacttggtttttaaaaaactgacactaaaaatatgagctgagccgaccggtggtctcgagcggacaaggctgagagggctcagtgccactctctcgcgcgcgtataagaccgagagtttctcgctcgttctctctcgcgctcctctctatctttctctatctctcgctctctctcgtgcacgctgttgacggtcgttagcgatcagcttcgaccgtcaattttaccaaaatagaggagaacgagttatgcttgcaatgcatattcatgttagaataataatattccactagtatttggttcactaaccttttgtaaagaataaccctaaagtggtggagaatcgacatcaactcagacgataaatcaatcggacgatgtcgagaatcagacttatgcatgactgggccaagaactcagaattggcatgatgaactgggccaaaattcacaagtctgcgtatgagagcaacggaggaggccaccggccgattttgggccaggacggcccgacccatggttcggccgaaccccccgcagcgccattcgatccaggtttctcctggacggctgagatggctccccaatgacggttggtgagtattaccgacctttccaaccgtcacaaccgtcattctcaagatataaaaggagctctcatcctcacttcactcacacacctcaagcaagagttctctcatattctctcaagttagtttagtgttctcaagctagtggaataggaatagagtataaatcggagtctggaagccttcggaagagttcgggtatggctctagtagctcttctcttattttttgtatttagaatactcttctatatacatttatggtattgaaatactttccgagtatatgaataccaactttactttatgttcatgttatactgattatgttgctagcttatctgggagatgctttggtacgggtataatgtttgcttatgcaattactctatgtcatgacgatgatattagagtagtatctggtagtttaggcgttgtgtcaagattactggatatcattatttgggtttatatgctgtggatgagaagtgggccgctgatggtgacagctcagtacgggtattcctccgcgcgtgtatattgtcctaagttaattccctggggagggtactgtcgcgtcccaaaacgaccctaaaatacatcctctaaattatgcctagaataattaaaatccgtgtgaaagcctccaacaattaaaatgtgcaaagttaaaagtcaaataaggcttgcaggatttttgtatatttcctaaaagcctaaaatgcgtaaataaattttagtggaattttcagagcacaaataataattaagaagaaataaacaaagttaaaaaggttttataaaaagaaaaaccctaaaaagtctttttccccccctccacctcttgggccggctcggcccacctccctccctctctctcctctcccccgcggcccatccggcctcctccccgcgcgcgtgctgctgacgggcgggctcgcccgccaccctcgctgacgggtggggcccacccgtcatcccctacctcccgccgctcccgccgcctcgcccgtgccctagcgccgccgccgccgcaaatcccgccgctcccgtccgccccgcgtgcaatcaagaggggggaaatattccccgtgattccctccctctttccccccacttttccctctctctctccatcggattcgttcgggatcttttcccctaaacctcgccggcgcatcaatggcggccggatcttccgcggccgtttccccctcatccggccgctctctccccctcccaaccctatataaacactccccgtgcctccctccgccgtttccgaccctcgccgctctctctctccgccggaatcgagctcgcgccgtcgctctctctctccgccattgccgccgagctccggtccgccgccgtcgtcgccccggaccttctcccgcttcggcgtcgccttcttcgggttcgccgcaacctcgccgacctcgtccacctctccgtttcgttcgccgaccgccggaaccccgccgtccccatcgacccgtgccgcgccgccgccttcctccgctccggtcgccgttcccgtcgtcgccgtcgacccggggtgagccgtggactgccgattcgcttcccccttccctcccctctttcgggcgccgctccgccgcgccggtggtcgccggcggcgaccataggggcgcgggtgcaccgcctcccgtcggctgtgccggcgtggccgccttcgggcgcgcccctcggctgccatgtggggcccggccgtcagccgcccgcgccctcgggtgcggctgacgcatgggacccacggcgccggccggtgtgagccgggtgcgcccggtccaccgtggaccgtgaggctgccgcgtgggccccactcccgtggacccggtccgcccgccctctcccctcggctgacggaataaatccattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgatttaaattattgcattatcgctttatttaaattcccgcgttatcattgttttatttagccatgcctatttacctttgttatgaccttaatattgttattgttattatttccttgttcaccctagaataaacaaaaccccaactagtggacactctactcatggtaccactagtatgattttaggtagatgcttcgctgtttaattcttaggtttggcaggatactaccggaggtttatcgagaacttctccaaaatcgctcgacccatgacacagttgttgaagaaagaagagaaatttgtgtggagcccgcaatgcaagaaggcgttccaaactctcaaagaaaagctggtttcctcgccagtgttaatcttgccggatactcgcaaggacttcatggtgtattgtgatgcttcgcgccaaggattggggtgcgtgctcatgcaggacggtcatgtggtggcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcactcagtcggacctgaatcttcggcagaggagatggttagaactcatcaaggattacgatgtgggaattcactatcatcctggtaaggccaacgtggtcgctgacgctctaagtcgaaagagccattgcaacactcttaacgtccgtggctttccacccgaacttaaccaacagatggaagccctgaatctgagcatagtgggtcgtggattcttggctgcgttggaagccaagcccaccttgctcgatcaaatccgcgaggctcagaagaatgacccggacatgcgtggactcctcaagaatatgaaacagggtaaagccgctggtttcacagaggatgaacacggaaccctatggaacggaaatcgggtatgcgttccagataacagagaacttaaacagctgatacttcaggaagctcacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtaccagattaaatttcagcaccgcgtatcacccgcagatagatggacagaccaagcgtctaaatcagatcctagaagatatgcttcgcgcatgtgtcctagatttcgggaagacctgggataagagtctcccctatgctgagttctcctacaataacagctaccaagccagtatacaaatggctccttatgaagcgttgtatgggcgcaaatgccggacaccgctattgtgggaccaagttggggaaagtcaagtgttcgggactgatatcctgagagaagctgaagcgaaggtcagaaccattcgggataatctaaaggtggcacagtcccggcagaaaagttatgcagataaccgtcgccgtaacctggaattcgcagtggacgattttgtgtaccttcgggtcacgccattgcgaggtgtgcacaggtttcagacaaaagggaagctcgcacctcggttcgtgggtcctttccgtatcattgctcgacgcggagaagtcgcttaccagttggagctgcccgcctccttgggcaacgtgcatgatgtgttccatgtgtcgcaactcaagaaatgtcttcgggtaccgtccgagcagactgacccagagcaaattgaagttcgcgaagacttgacctacgtggagaggccagtgaaaatcctggacaccatggagcgcaggaccaggaaccgggtaatccgtttttgcaaggtctaatggagcaaccatgccgaggaagaagctacttgggagcgtgaagacgagctgaaggcagcccatcccgatctcttcgccagttcttccgaatctcggggtcgagattccgtttaaggggggtaggtttgtcgcgtcccaaaacgaccctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataatt

SEQ ID NO: 43929 - DNA, 13429 bp, Oryza sativa
ttagccatgcctatttacctttgttatgaccttaatattgttattgttattatttccttgttcaccctagaataaacaaaacctcaactagtggacactctactcatggtaccactagtatgattttaggtagatgcttccctgtttaattaggtaacattaggtgattttacaactctagactttgggatgttcatatcacctggacactatggaatggtttggttattgtggaattggcttcacaccgctccttctattcaaaatccccaaaatggttttaggctgggctcggggtgcatggttttgatagtagcacctcggccatataaggaccggtcttcgggcctatgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacatggttacacgtgaggaagatgtgtcttgtgggtaaagatgtacacctctgatcagagtaaaatctattcgaatagccgtgccctcggttatgggcaagccgagcaatgtacccaagttagtgttttaattcttaaaacctgcttaacaactaaaaggtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttactaaatagttttgagcaactaaatatctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttccggtcgtgacaggtacacctccatatttagccccggttgtatggtcatgacgggctgtcgtaaggaactcgacagtcatgggtggcttctcgaagtaccaggagggcatcggatagaggtttttatctagtatatcagatacctaggatgtatgtatactatgtatactagaagtattggaatagattctatctcttttctttccttttaacttagatattttagtacacatgatttatcttaacccctgcttagactatggttattacaagtaacatataaataattagtcagttctctctactatgatctacccacgggattaaataaatacgatacccttggaatactctcgagtgaaatgctacaatgatatatccgtgtgcttacggattgattctgtaaccataatataccagagtaatgtcgttaagaaataccaacaagcatttcaggcgccgttgccggggaagatttataatagagattaccagaactaatactttttatttacctctgtataatcactttcctttgcaggctaaccttggttgttttcacttttgttttggaaacagggtagtgcatgactggtttcaacttaccggaaaactttaaggaaaatccagaagctttcttccggagcatcaaaccgcgagtcgttgctccgcagaaaactctcccgacaaagaaaccagccatactagcgccaccgaccttcaagactatggctgacaagactctccgtgaattcgctgctccctctgttggcaatgtagccattgggccgcagctcaacctgggagatgtggattttgatttgaagtccagcctcatcacgatggcgtaggctagcctgttctgcggcaagcctaacgaggatgccaacgcttacttacaacagttcctggagatctgtagcacgtacaccatgaagggtgtctatcacatcctgattttcgtttcaggatttataaattatttaataaattaataatataatttatattaaatgatctttaatttacaagtgaagttaaatgtgggaaataaaatttcctaaatataaagcatggatgggtttaatttttattaaattctccatggttaattacactctcttaaattttctcggatttttcggagctcaattcctaaatgatacaaagaacagttcagtaattatttgattattaatgatctaattataattgttaagagcttttcttgtttaaaaatccttaaattataaattgttgtttaaaaggaattattagaaatgattttaaaagcctagaagagaagatctaattttaatttgttaaatctcaatataaaattgggccagataagatttcattaaatactttgcttaattctataattcctagatttttctgggatttatttgagctaaggaagtatttttaataaatggaattgcatttcatgaataatttaaattgaaaaaggtttttaaaagtcttcttttggctttgggccgaaagccggcccaaaaccctctctctctctttccctcggcccagtccggcccaatccgccgagccgccgctctcctctctctcagccgctgacaggtagggcccgcttgtcggatccatcgtcttcgtcaagccgccgccgcccgaaaccctagcgcaagccgccgccgtctccttccaaattcggccgatcctttccttctccggccgaatcttttgaggggaaataatcttctcgatctcctcttccttttctcttttggaatcaacggctaactcggtttggaaatccgtggattcgagttcgattcggatcgatctctctcctccgaaccctagctttccttcgccgttccttcgccgtctccgtcgccgtgggccttcgccgccgcctccttgcccctttaaaagcacccccggtgtctccgctacccgtcgccaccttcgccttcgcctctcgtcgtccgtagcgccctagcgccgtgccgcttcgtgccgccgtcgccgccgtcgctccagtcgtccttcgccgttgctccagtcgtcgccgtcgctcgggaagaccgccgtcgtggtcgccaagtcgccgccgtcctcgtccaccgcttcgccgtcgccgaagaccgccggagcaccgttgtcaccgttgacccgatctccgccgccgcttcttcctcgtcgccggcgccgtccgttgcccttccgccgttgttttggtcaccggtgagttcgccgcgtcgccctctacccgttggtgccttccgttcgcgccgccgtgccgtcgttcgccggcgagcatgcaagcccgagccgccgagccgccgccgccggtggtgacgtcatcgccgacgtcatcggggccgttcgctgtgagccggtcgtggaccgttcgatctcggccgtccgttttggatcaagtcgatctcggccgtccgttcgcatgagccgtcgcccgtgcgcccggtccaccgcgaaaccctagccgctgacgcaataatcctccttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaaatagatttaatcctgtaaaattcataataaattcatttgaagtcagaatgaggccgttcaagtctcataattcatctaaaattatgatctacatgtttgtttactttttatgtattgtttatttggtttttattagtctttttttcgttttgcgtgttagcttgtcgtttccgtcgttgcgaaagttcgcgagtgcgccggaagtattcagaagattatttgaagaccgattattgcaaggcaagtcacacagatcctaaacacaatcctttgagcatgttgatcctatatttaaattctctatttatttcaactgtgcatttattttcgaatgtcactgggtgttgttaacctattctttgttatggcccttttgttcttgattactttattccttgataccttgggtgattataattggactagttgagctttaaatatattggttcaactagatattagatataattgcttagccatgcttagaaacattagcacactattgggataacttatgattcactattatttaataatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtataacatgattcattacggagcaccagactgagaagtggcggagataagcccacgggggtcgctggggagtccatgccttgttttataagggggtgattatgatccaggaatggtgcactgtggtgagttgtgttgtgcaaaggatattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaatatttatagatgttatacctggtaataatttgcttagctcctggtttggagattagatctgtacagccgggtatggttgcttcagaatggttgggcctgagcagcatgggcgtgttgttcagtgttgattaaaatttctgattaattactcctctgttttacttctcttaaatgttttgctaaatgctgcttacgcaaatgagcctatattatgccatcctttggtatccttgtgcacttgcatatttgctgtgtggcttgctgagtatgtcatatgctcaccttgcaataatcaatcaacctcacttgaagaaaaagaatccagaaggagaagacgtttggcttataccccagttgagctgcctgtgggagtggagccggagcttcgctagattttatttttccgctgcagttttcttcatggtgaggactaagtgcctcataagtaagtatttatcgttttagtcaatttgatgaatctgtatattaaattgtcagtttgtgtacctcggctgatttctggacgaggattttatgcacaaataagttcgaaaattactagtgaatttccgggcgtgacagtgtcagtccggacgttgtcaggctccggttgttcccgttttccctcctcgggaaagcaaagtagtggttttatgccaaccgtgctacaatcaatacctgggacaaatgctctatagcatttctctcgaagttctttccgatcggcaaaaccaatccccttcatgggagaatttcaagtttccagcagacaagggacaagtctattcctgagacgtgggaacgacttcagaaatatgtggctgccagtcctcatgatgggatggacgactggttgatcctgtagaacttctataatggactcactcccatgtcctgtgaccacctggacacgctagctggagtagccttcttctctaagacggttctattgacgcttttttagtcaacacaagatcacctaacgatttgcggtgtaaacaatagaatcgtcgaaatcgataggtcaaaatcggctagtgaaaccgatttcgagattgattcactttcgcggaaacacacgactaacttacaagcaaattagcaaagaggataaatatcgtacttacgtgacgacgaacgactagtttccgagcaaactagcaaaggataacctcctcgctttcgtggagaagcacgaccatttttcagcgcaaaacgacaaagattaaccaaattctaggttactaaaactcagccatgaaaacgaaatagaaaagaacagaaaagtaaataacaagaaaatagtagattgataatttgttcggggtttttccagcgaagatggaaagagtaatttataggaggcacggcctcatctagcgggagtttgtttcctttgtgggccttctcttccagcgttccgggtcgatcatggaaattccatgtacagcatatcaatgccttcggtgatctgcactactccctgaaaaatactccgtacctgacatgcatgcatcaaatcgatgatcttctataaaggcaaccattatgtgcatgaaaactaaccttaaggaataaagtagtaatttttgttgtacctttgtacattgggagatgagctagggagagaatatagggagagaatagtgctatgtgcaaccttaagcttaaggctagccataagaattaaaaatatatatcatggctttgcaacatgcatgcacactttcaatcttgagtaaatatgtgtctttttactcaatgggtcccaccttaaggtcaagaagctaccatatacattgtagcatgtactatagataaacaatataagaatgtgggtctcaccttatggctcaattgatctaaaacattgaggatgctcttaatccatgacaccttgtggcctcctgaagccttttccttcacaaaggatccggatgcctccctgcacatgtacgctgcacacactgaccctatatactacttgcgacacacatctgcaagcactaattataaatccctaatgattaaccaaacaatgggtaaaatgaccccataaacctaactaattaggagtaacagctaacatccgaacttaacccactcaactaattaaccacctgattacaagtcaacgaaccaggttaattgctgcagccacccaacagcttgcacacatgatctctcagtgtatcacaaattcctacacacaataaacttaatctatgtttcaagctaaccactcaacacttaggatctatatattctaaataatttggcctgctcaaatgaaactaattaactcttagccaaactatggtacaaacaggttcaaggagccgttgatttaatagagaagatggcttctaatatgagttggagcaaggaacgactccaaacccgtcagcgaggcattcacaccatcaaggagatagaaatgcttgctgccaagctggacctcctcatgaagcgattggacgatcacgacaaaaggccacaaggcaccatcaaagccttggactcacacgttacgtgtgagatatgcggcagcaccggtcattctaggaatgactgcccggaaacccgtgaagaggcgatgtacatgggcaacaacaacaatgggtatcgtccacaaggaggtcaggggtggaaccagccacgcctatattatcaaggaggcaacaacaacggtaatttctctaaccagcactccttgaaggatcttgtctttgcgcaagctaagaccactgatgctttaagcaaaaagctaactgccaatgacaagatcctagagaacattaatgtcaagctagatgtcctcgtttctgctttccaaaaccagttgagctttaataagatgatagaaacccagctagctcaattggctttattagtccctgcaaatgaatatgggaggattccgaggcagcccgactcctccattgaaaatgtcaaggcaatcacaacgaagggaggtaagtccactcatgaaccgccgtatcctaaccctgcaggaactaacgggatcgccaaggaagcaccatctagtgattcagttgacaaaaaggttcagccagagaaggttgtgccgcaggagtactgcgccacacaattgctgccgtttcctcaacgaagtaggaaaccgtcagtggacgagcagttcgctcgttttgttgaagtaatccagaacattcacatcaacgtgctattgttggatgctatgcaagtgccaacatatgcccgttatctcaaggatatcctcaacaacaagagatcgctcccaacaacggaggtggtcaagctgacgaagcaatgcagcaatgtcatactccacaagctcccggaaaagaagaaggatctggggtgtcccacgatcacttgctcgattgcggcacagcaattcgaccaagctctatgtgatcttggagcaagtgtcagcgtcatgcccaaagacatcttcgacaagctcaacttcacggtgctggcaccaataccgatgcacctacaattggctgactcttcaatccgttacccggcaggaatagtggaagatgtgctagtcaagatacgggatttcttcatcccggttgacttcgtggtgctggtggaagtggagccacccaagacagacagcctggtgaaattcatgcagaatttcctggaaaaggaaacaacgatgcccaggaaccgttattggaagacaccggtaaaatcaagcataccggccaagaagctagagcagccggctcagaggaagccgtcttccacaccgaaatcaaaaagggcgtggaaggaaaagccaaagacacctgctccatcacctccggagacgagtgagaaatctggaaactaaactggaaggaggtacggtcttgcacgtcgaacccaaaatgacgcgaccttcgccaaccgaaaaattggtatgtatccatatatttgttttcaacgatttaaatttttgcatcaatcgcttgtttgaatttcaaaattgcatttagaatttttgaatttcgaggaaattcttcaaatgaatttttcagagcaatccaaaataaaattttcaacaaaaatttattgtgccacgaccacactgaccgttgaaacccaaccggccaggcaacggttacctgccacttttggcagggttacggctagtgggtcccacatgtcatttctgaccgttgtgggtaccctataaaagccagccggccgagagagagaactccaccccatttcaacacattttttattctctctccaaagtttgctctcaagttcatccaagctttgatagtttccctcaaattcaaacacttagttgcatatatacaagttgctttggtgaaactcttgctattctaacccccgtcgagttagtccattcttactccattgtgtagaatgaggaggcgattgtctcgcctgttcaaggggtctggctcttcatcaagtcatcatgacgagtctagtgctcattcatcagctgatgtctcgatggaggatgccgacgctccgcgacatctcctgaacgacgccgacctcgaccttgtcgatgatcgggaaatgcaagcctactatctgctgagtgaccggaaatatgctcacacgcgagaatactctccggagctgctgaaaaagataggtatggatgttgacttccgtgctatttggaaagctgttggttggcaaagatttgctgtaatagattagcctggttctcatttgctcactttgcaatttctgtgcactttgaaagaaatagaagatggaatttcttttcgctttttccataaggaatacacacctacatggaaaggattaagtacacttcttggttttcacgattcctgtaaaatcgatctcctgaaaggaatatctgggttcgagaaaaataggttttgggaagatatttctggtgctccaatttgcaagaaacctaggacgaatgatatccataatcctacacttatgctcatgcacaaatggattgctatgactttgtttactagaggtgatcttagacccattagggggatgaattaattatcatgtttgccatggttaggaaaatcaaaattgctcctgtgaaatgtatgataaggcaatggttagagagtataagattttctgctcctgttgagtgcacttttttgattactcggatagcaaatgggctgggggtcgtgagtgaccaaattgttttcatctcagccgctcgtccctatattgatgagaattatctagtgtaagggcacattcttaaacagatggatctttgatatacttcttccccagttgtacaaatgaaatccctttgccaaatgcggggtatcatttgtacaactaccatgaactaaccattcccctatagaccatagtagaatctcgtgcaggtggagcatacagggaaacacacaacatgacaaggaatgaatgagaaggttcatcatcctcaacacccgtacagatgtatgaggcaggttgggaaccaactggggatgtacccggatggaccccaagctccatgccacagcatcggagtctcaagctgggtgtcatgtcctgataaattcatcccgaattaaaaatcattctctaaaaggaataatagaattaattaaaattcaaaaagaaattggcaaacactaaaatacgtacaagaaaaattcgaatgaggctcggagaatttttgttaaattctccatggcctaataggagccctcaaattttacttgaattttcagagcaccggaaatatttattaagcaacaacaacaattatcaaagtttattaaaaagaaaaactaaaaataatcctccttcctcctttgggcccagtctagcccaaagtcttccgctctctcttcctcggcccgcagccgaagtctctcctccgtccctctcttttccggggattgctatctggcgcgcgcgcgccagcaacggaagtttcgcgcgtgtgtcacgcccagaaattcccgaataggattccaagcagaatatgcattaaaacccccgtccaggaccgcccggggtacacaaacaataaagttgacatacagatccacgtcttacaaatatcataaagtcttacataaatgcagtggaaaattaaaacataactggagctaagccttgacttggaccacagcgggatcaccactccacaggcatcctcgacggcacggatgaagcctactcctcggagaagccaccatctgacgcatactcaaactctggggtttggggaaaaatagagcaagactaagtattacccactgtactcagcaagtcaaactggaataggggtatgatgcagggaattatcaagggatagctatagaggttcgtttgcataaagcgagcatttataaacagtagatggaagcagtaaaaaaattataataattaatcaatattaatcatccactgtccaacgctacaccacgttgcaacaggcccaaccatccacctagactactcaaattcaatagactagactagggtgaaactaatcatggtgaatctggttgaccgcccatatccgcgggtacggctattcgaatagttttactctgatcagagatgtacaactgtacccacaagacacagcccaacgacacgtttccgtgcgccgacatgccaccatgacataccggatagaggccgtgacaagactcttcgcataaccccctctaaccaaacacaccacacctcaggtttcacccccactcctcgcaaggcagcgggtagtcccctctcgtgcctaggttaatccggaagccgcataggccgtcgcagggcccatccaaactccatcacgcccacccttgcctggatgcgtcagctagaggaaggctacactacaagcccagccgttgcccacgctggcttgtggtaagtacgagaaattcttccaaggtttcccgcgaatcggtccttaagtgccatgggcgcgactagcaaaaccatgtacccacagcccaccatttaacatgttttaatgaagcgacaccaggacggtggctctaatccaacatcaacactagaacctgaagtctatacattaatatgatttcccccattgtgtgctagttgaactaagcatggctaagcaatccctagtccaatatctagtcatgttatatcccaagctaacaaaggaacatggtacaaaatagcatggctataacagtaggtaaacatcccatggtaacagtataaaacaatacagtatttgaaggaaaacaatggagcatttgtaatataggatcaacatgttcaagtgacaagcatgacttgccttgctctgctgctggaggaacctcggcgactatttcaaagtacaccggagcatcgggagagccagaatctaagcgacagacaaagcaaacaatacaaacaagctataagactactaaaacagagaacaaaacaatttttaatggattctatgtatttttcttgatttactgagacttgaatggcattaaacggagctcggatgaattagatatgaattttagaagattcactgtgtttttactgtaatagaaaaaatccttaattgatttattgcgtaataaataaatcccgggagaaagaggggcggcgtcgacatgcgggccccacatggcagtggctgcagccgctggtccatggtggatcgggtccatggaccggggaaaaagggcagcgcaccacgtggtgcaaacgtggcgccgacgtggcacgcacgtgacggcctcgtggcagccacgcgggcggcgggatcggatggccccgatctaccgcccggtagatcggacggcggatgcggctcgcggccggcgcgcacgggcacggctcaagccggcccagcggccatggcgcgcggcggcgcgaggcggcgatcggccggctaagcggctaggcggcggcgcgtcggctaagcagcgtgggagagagggagaaaggggaggaggggccgcaccgacgacgatcgacgacgatgagagacgaatggtgatggcgacggcgagacgagctccgggaccacctaagggatcgaaagggatgagttagagagggagagggaagccatggatggctagagcggcgaccgaaggcgctggccatggcgaagctcaccggcgcgtggcacgggcggggttccggcgcgcggcacgggcggtgttccggcggcggattactacggaggaggggtggacgggacggcccgcacgat

SEQ ID NO: 43930 - DNA, 3256 bp, Oryza sativa
aaaggaaggaaatgaattttcttgggattaaatattgcttgtgctcaattttaattggttaaaattatttctagagctctggaaattccactaaaaatcttgttagcgtatttcgacatgtagaactcaagaaaaaaaattccacatgccaattccgattattatttgtattgatttattagggtttactcttgcttttacaccggtattttcttgagaccatttataacttcaatttaggcttgggaaagaacttcagggtgtgacagcgcgccagctgtcatctgccaccgtttctttccctttttccgactttctctttttttttctagcatttatttcacgcgagttagctaatcgatctgtattttgttgccatctgtttcctattttagcgcacctctcacgctatttccttttttgtgttttcttttccttttttttagttgctagcacacgtgtttcttaaaatctttgaattgaaagttttcaaatcttgacttgaaagttttaaattttgagttgaaagttttcaattgagggttgaaagtttcaaattttcagttgaaagttttcaatttttgagttaaaagttttctattgtgagttaaaagtattcaaatatgggttgaaagttttcaatttttgggttgaaagttttcaatttttgggttaaaagtttttaaatttgagttgaaagttttcaaatatgggttgaaagtttcaaatttgagttaaaagtttttaaaatttgagatgaaaaattaaaagttttcaaaattcaacttcaaaaatacaaattttaagttaaaactttacaaatctgggttaaaagttttcaaaatttgacaccacatatagatttctttttaatctattatttttaaaaaaatcttatcttaattatcgttattagtatctaaaactaacagattagttatcatcattacgttaatacatgatttcgaaaaaatcaaaaaaaaggtcaaacctcctccacctacgcgccggaaaaaagaaataaaaaaaagtgaaacccttcgcgtgcgcgttaccagcacgtacgcgcgaggtagcttttccgctcttttcctcgggggcggctagctagcgcgcactccccttgagtccctcctctgttagttattactcccttaactcccccctctattagttattagttatagtattaggaaaaattctaaatatttttcttttggagattttttttactaacaaaatgaaaatttttaagctagatttaaaaactttcgatttaagatttaaattttaaagtcaaattttgaaaaaactttcaactcagattcgaaaactttcaactcttagattcgaaaacttacaagtccagattcaaaaatttgaaaactttcaactggagatttgaaaattttcaacttcagattcgaaaacttttaaatccagatttgaaaattttcaactcgagatttgaaaactttcaactcgagattttaaaaatttcaagtccaaaattgaaaatttttaagttaaaatttgaaaactaccagtaaaccaatcactagtaaaaacaggaaactaatcactagtaaactaattacggttgtttctcctattcgtgcgatagcaaactgcagaaaaagaaaaaaaaagagagaagaaaacaacggtagcaaaaaactgcgaaaaaaaagaaacagaagagaagaaacgcgcgcgcgtgccatgggccttgtggaccggaagtgagttccggcacagcgcgcgcgagctagcattcctgcttttcctcccggaataagttcatctgaggtcccttaacttatcaacgaatccgattttcgtccctcaaccgaaaaaccagacacaacgggtccctcaactatcaaaaccggtgcagattagatcccttagcggttttgagggtggttttggctgatgtggcgcctacgtggcaaatttgacttggtcttcatctgacgtggcattgacgtggcgcttacgtggtaattcgatccagaaaaataataaaaatccgtgggacccacatgtcagtcttacatagaaaataaaaaaatagtgggacccacgtgggccccacatgtcagtccaacttaccctcctcttcttcctcctctctccccatctcccctctcttcatctctctcccctgtcttctctctcatgtgcgacacgacagagaaggagcggaaacccgctagccatcatcgtcgccgccgccgacgtttccccgcaccgcctccaccaccgcatcccagtgatcaccgctgttgtccacgtgaacaccgccgacaacggcacccctcgtcgtcatcaatgcgggtgcttcgacggcagtgtccggtcgccaccgccacggtggtcgactccggtcagcctcgccgcgacggtcgactccggtcagccacgccgtgacagtcgactccggtcagcctcgctgaggcggtgtctggtcgccgccgccgccatcgacaacgacgacgacgtctgccggagcttcttgcccttgcgcagccgcacgttccagaagttcttgatctcgttatctgacctccccggcagcctcgccgcgatctgtgaccagctgcacacgcacgcacggatcatgaacactccattgatcaaatcgatcgtttcatcatctcatggttaattgagcaataatctagctacctgttgcatcgcggcatctagatagcagtacaaatggtatctacacgcataacaatttataaattgcaccgaccatcattgttccagcctcccagatcgctcgtcgatttctttcagtttttcgtctactccgatgtcgttcgacggggtctcccggctggagacgtcgccgccgccggcgttggaggaggagatggcgactgtgactcaggcgccggggctgtcgacgccgtccatgctcggcaatccagatggtggagctccggcggcaaccatgatccagagcgcgccgtgcgccaccggcggcgaggcgttggtgggcgagggccggctgcgaaaggggaagatggtcgccgaggaccagagcccgccgagcgtcagcggcggcgcaccggctgacctgcctcccggcggcgacaagctcactgagaacggcggtgacactgacaccctcctcctgggtgcccgttgttcgtggatagagaggatggtaggacccattgacatgtgggtcccactattttgtccttttgtatgactgacatgtgggccccatgtttttgtt

SEQ ID NO: 43931 - DNA, 5515 bp, Oryza sativa
cttccgtttcacgggaaaatcaccggaaccgcatcctagccggcaacagttgtgttgccgccattgcaccacctccagccgtctgtgccgcctcgcctgtgcaccggccgacatctccaccacctacctcagctctgcgacgccaccaccttccccgaccttaccgtcccctcgcccgaagctcgccggaacggtgtcctcgtcgacgtccagtggcgttgccgccactgtaccaccccagccgcctgtgccgcctcgccggtgcgtcggctctcgtcgtcgccgcctctcccggcacagcaacgccatcctccacctcgggcactcctcggttttgcccggaagccaccacccgtcattgccacgccggcttctccatcctcctcgccggagtccctccggcagccccttccaccgtgcccgtgcgccggccgtcgtcgccatcaccttcggcatcgcagcggcaagatcgccctcggcctcgcctcccttccacccgaaccccgcaggtgttgttcgtcgtcgtccctgtccgtcctcgccaacgactccttcagttggccgttcatcctcaccggctcgtcgtcccgtagcgccacctccgtcatcgtcattgcagcgccgtcctcgcatccgtgcagctgctgccggctgccctcgtcgcctcctcgccggccccggtcgtcgtcgtcctctcgtcgttcccgcttgtcgtcagccctcccttcatcaagccgtgctcgttcgtcgcccgcgtttcatcaagagtgcgtcgcagccccgtcgtcgtcttcgtcctcagctccgtgtcatcaagcgttgcgccggccgcgtctcgccttcgtccaaggatcgcagctgaagtcgtcctcgagccgccttcgccgtgcccgttcgtcatcgtcgttccgcgcctcgtcgcgtggtggtaaggaccctctcccttttctcgctgcctctgtcctcgtcctttcggtgttgcccgtgcccattgtgcggttgtcgaccccggtacccgtgtaccggtttcggtagttgttcgtgtgtgcatgtggtgaccatgtttgtgtgcccgctcggtagccgcgtggtttccatgtgtgcagcccgcgcggtgtttagtagggtccgtttgtcggccacttgcctcgattgaccaaagggtccggtttctgtcgacccgtggatcgtctctatgtacctggtctatcgtggtcccttaggttgacatgtggggtccgtatgtcaacagcgcacccttcctatcttttccaggctagcactttcacacgttttatagttgcaaaacctaattataataatccgtaaatctacatgtaacaacattaaacttcggatgaccatgccttggacatacgaactctgaatcgacccgttcaagtctcttaatgtttgttataacctaaagaatcctatcctttctttttatctattgttattgcttctttataggcttgtagcttcgcttgtatgcttcacgtagctttcgtcgttccgaaggttcccgaagcatggtttgcggtcgtcgccgaaggttcggaaagccattctctctgagcaaggcaagtcgcatcatccttgagcatattgaatcccagtttataaaattattttgatttaaattattgcattaccgctttttttaaattcccgcattatcactgttttatttagcacttcctattaatccttgttatagccttaccattgctattgtttattatcaccttgcttaccctaggaaaagaaaaccccaactagtgggtaatctactcatggttccactagtatgaatttaggtagatacttcgctgattaattaggcaacactaggtggttttataactttagactttgagagttctcatatcatttggacactgtggaatggttggcttgtgatggaattgaacacacatctccccccccccctctattcaaaactccaaaaatggttttaggctgggctcgaggtgcatggttttgctaggagcacctcggccaccataaggaccagtcttcgggactctgttgcaaagcactaccgtactaaccacatgtctaattggtaaggcttaactcggtgctcaatctagtcctggcaagaggacacggatagagatggacgaagtcagggctcgatggacatctctaggataaatgaaggctacacgggctgcggctcggtagtcgagatgtcatggcacaggaacggtgttctgctgctaggggctcaatcctggcctacctgtcccgggattacggccgtaggcgaggttgggtcggtgcttttgtcacggctgggatgggtaaaggggttatgtcacattctttatgacgggttccacggccgtggtatgcggcgtaaagatgtgttttgtaggtaaagatgtacacctctgatcagagtataatctattcgaatagccacgccctcggttatgggcaagcctagcaatgtacccaagttagtggtttaattcttaaaacttgcttatcaactaaaatgtggaatggttggcctgggttggcttgggacgagctgggacccaggtcaggttgccagttcggtctgaatcatcgtaggccttgggttaagtcaggttcatgtggattcacggccttgattaataatattgtgtagctcaaggatagtgcttgtaaaatagctttgagcaactaagtgacttttaaatgttgtttactgcaaaacctaaccctatattattaccccttgtacccccttgcattaatcctgcatctcccggtgtgacttgctgagtactgtggttgtactcattcttgctctatcttttccccccttcagtcagagaagctttggagaagaagtcctaggtggagtcctggcttataccccagttgagctcctgtgaagatggagccgtaggcccgctagtccgctactgtttatttttgattgtcaggcctgaagtgcctttgtaataatgtaaatattatcaatataataaagatgtaccttttgtatcatgtttgtgtggtgtaccccggcttttcctaggacggggattaatacactagcgttcgggaaaaggtatttttccaggtgtgacactgggcaagtgccattgaggactggtggcgtgcccctcatgacatacagtggggggacaaccaacccccacagatcaagtggtatgcctccatctccaagtgaatggcgttcaaattcctctcgttgggacttgggtgaaatcaccaggaaaatggacacccttgatgtgcatacgggagagatccaatataacctcatggaacacatagcccagacgcaagaatggcaacaaactgctgatactcagttcgccaacatcaacaatatgatgcagtcacagcacgatgaccttcaagcgtacttctgctttcaggggttcaatccttaccaaggaccctaagcgaaagctaagcttggggggagacatctctccccccactgaggtaacttctatcacattgcatatttcccttgccaattgcatatttgctttccaattgcatcttataaacttgaaaacaacataaaaatttgtaaaatagaaaataccaaaaagatagtttaggtttgagtcatgctaggtaagacgaactagttttatttgttgaaatgatgaatagttgctctgttttatatctcttatatatgggttcataggtaagtgctctctcaaaggttaaatataagtagccaataattatctgggaacctgaggtaaatgtgatgcacttgcttatctgagtctaagccattgcaagatatgagatagtaaataagagttgctatgatcctagtcctagtttgacttgaatttcggacttgaagttcctcatttgatataaattcctaccagagctaaaaatgtgccatcataattgaactatatacattttggttacttgccattccattgaactttgttatattcttgtgacttgtgtagttacttctcatgctttatgatcaacatcatacaccgacatatatgcacatgctaaactcctacattgcgagctaagcaattatccattccatttccatactaccaccaaaataaattctccatgctttcatgtgttttcttctcctaaaaaaagaggagggaaaggcatggttatgaaaaaaaaagagagaaaatataataaagttatgctctcaccagcatgagcatgatattgaaaatgtagccatgccctctcctaattaataaaagaaggatttttgggagaagaaagtaagcacaaaggagaagcatttcctttattttcctcatataccatttccaccatatatcacacacactttgcacgatcttgatcttgagtatgtttagtcatcagctttagtctaagtttttgacttagtaataaatgtgaatgcaagtatgccatgtttgatccctaccgagctccacacattaaaccttagagtaggaatcaaaaaggcaatttggcgaggatttcatattgatacacttggagagactgagtgaatcattcgaggaacttggatttcttttgcaaaatcatttgaaaaactttcggaatgaaagttgaataaaagattgggtgattagtgctctaattactgttatgtctttcaaccgcccaaggcaaggagaagcagtgtctcgtgggaatcaggggtaagggtaagccaccgtgccaaagattatttaatctgagagagagtacatataccttgcacttgtacctttgagatatacagcatagtagcaactcctgatcaacaaccaagtttttgtttcctttcatccttcactcgggacgagcaaaggttcaagcttgggaggttttgttgacggtcattagctatcagtttcgaccgtcaatattaccaaaatagaggagaactagttatgcttgcaatgcatatacatgttagaataataatattccactagtattaggttcactaaccttttgcagagaataatcattaaatggaggagaatcgacatcaaatcaaatgatcgatcaatcggactatgtcgagaatcagacttatgtatgaatgggccaagaactcaaaattgacacgatgaactgggccaaaattcacaagtctgcgcatgggagtaatagaggaggccacctgccgaatttaggccaggttgggccggcccctggttcggccgaacccacctggccgccgctggatccaggttttggctggacggctgagatgaagcccctatatggttggagggtaattccgaccattccaaccgtcataaccgtcatagttcagctataaaagggcttcacctcctcacttcctccacacacctcaagcaaagctctctcatattctctcaagtttagtttagtgttatctagctagtggaataggaatagagtagaaatcggagtctggaagccttcggaagagttcaggtatggctctagtagctcttctcttctcttttgtaagttttgt

SEQ ID NO: 43932 - DNA, 2960 bp, Oryza sativa
caatcaggggtagcttctcgaagtaccaggagagcatcggatagagggtattagctagtatatcaggtaactaggatgtttgtatactatgtatactagaagtataggaatatattctctttctcttttctttccacttagcttagatattttatatgaaaatgagtagctccctgcttgtgtgtcactctacccttggattatattaacccctgtttagactatgattattacaagtaatatataaattattagtcaggttctctctaccatgatcttcccacgggaataaataaatacgatatccttggaatactctcgagtgaaatgctacaatggtatatccgtgcgcttgcggatgaactctgtaaccataatataccaggagtatttctgcaccattgctgggaattatatgtctagtaatgtcgttaagaaataccaacaacggcggtggcggccgtcccacgcccgaccccgcccggatctagcgggtcggcagcaggtggcttggtagcggtcgacggcagtagcgcgcagctcagcggggctcctcccggccggatccgacggcagaggccatctctcgcccgaccccgagctatccggcgaaaggcgacagcggctcggcggtgggcggcgggcagctcggcagcggtcgacgacagcagcgggtagctcagcggggctcctctcgcccgaatctggcggcggcagctgtcccgaccttgcccagccctgcacgaatccagcgagtagcggcaggagtccggccctgcgcggactcggtaggactggtggtgggcggcggaggacggatccaccttccccgacggtgggagcggcgagggcagcgggagcggacaacgcgacgcaaatgagcggccggcgacagggatggcggcaatgttgatggttgttatagaccaatttcgaccgtcaatatgagaactagctacacttataatgcatatttgttttagaataatatagttctacttgtacttagagaataatgtgttgcaggaatttagcaaataaaataaagagaaagtgaagaaacctaactcctaaacaagctagaggataaggagggcccacatgtcaagtgaaatcgtcccggaaaccgccttaactgccataaccgtcatagggacccacctgtcagtgtcgtgcccgaagctagaggcctactgggccggcccagagttcagctgaaccctgatggcgctagctccggctggccctccacgtggacgctccagattactcctcaatggcggttaaggggcagaatggtcttcacttttctacaaccgtcataactaccctataaaaggaggagctcattcactctctcaacacactcaagcaatctcaagattcctttttatactttagtttagtattttagtgctaagtggagtagaatagaatagttctcggattcctcggagctctcgaaagaatttcagtatggctctagcaacttttctattttcttctataagactcctggaattaatgaaatattcttcttcatatatttttgatattttgcttagtatgagtactactcttgctttatatttgtatcattaaattgtatgggtagcctaccaaagaggtgactacgacgaaaccatacgctggattgtcataattagcgacctcaatctcatatccagttactattagtacatccaaaagtgcatgcattatttcccttcttatagaattttctcttaaattactctttcgatttacgatctgattataccattgggttcgtaataattaaatctttaaaaaagatctcacataattatattttataaaaaaatacaaattacttttataatatatctaaattacttttatattttattaaattacttcttagttataaaagtaaattcaataaagtctgaaagttagaagtaacttgaaacaaaagtaaagtaacttgttacagcattaaaagtaaatatattgtgggagtaaaaacataagtctatctagaaagatttagtcaacaatcatagttacccccacaactgatttacttctgatgtcgtgacaagttattttctttttgttttaagttacttctataatatatgcaaattacttttaggctttattgaatttacttttatatgtctaagatgtaatttaataaatctgaaagtaatttagatataatttaaaagtaatttgtattttttatcaaaatataatcatgtgagatcttgttataaagatttgattatagttcggatcgtagatcggatgactaagttaagagaaaaatttatttgaaccataggtggtaggaacatattttatacttacttgatagacaagtattatagattaacaatattcggacaacatctgatggcatcgctggttagtactaaaacgagatgcctctccatttagattttgcgctcacatatatagtacggaactttgagctaacgggagtcatagtaaggcttctctcgccttttgataatcccaccgtgcgtcaacaaagcccagaggtgcgtgatgagctcgccgccggtggccagcttcttgacgtggcccgtcacgttctccgacggcgcaaccgccagcagcagctccacccacatctcggccagtaagttccacagcgccgcctcgtcagccatggccgagagcagctggtaccccagctgtgcgccgtcggctaggacggcttctccggtaaagttggcctcgtcggccggcatgaactctcgcaagctggcgaacatggcgtctttggagcggcggcaacctatgtttcggaggtagttctggatcgcctcctgcacggcctccatcagcagccgctctcgtggacctcatccgtcaccagctccggcgcctggagcagcaggtaggcgcaatagttggagagcacggtggccacctcgcggctgtcggcg

SEQ ID NO: 43933 - DNA, 10343 bp, Oryza sativa
cagcgagtactgcccaaccgagttgctccagtagcttcgtgtcagcgtggcgcggcacgtcagccataggaacttctccaggatcgggtggccttgccaccatggccggtggcgcacgtagcggcacagcatcttcaccctgtgccagtccgacaagacgagggacaggtactgggagagctcgaggaccaggaagagggagatcaccagcctagccagccagatgtcgacgctggtcgtggtgtagtcgacggcgccgccgcccgggggcggagagtggtggtggtggtgatgcagcaacgccggggagaagagggtggagaggctcagcgcggcggccgccatgaacgtggccgtctccgggacgagagtctgcttcggcgaggggtacctcgcgtagtagaagtcgaagaggaaacccagctccacctcgatgacacggtacatcctgtcgtggtcttcgcaggagtcgccgccggcgagccccctccggacgaacacgagcgtcctgatgtccttgggctcgtggaacggcttcccgttgaggttgaggcgttgccggaggagcttgaacagcgagaaggagaggcacagatccttgagcttgtcgtcgtcgctcagtaggctcccgtcgtgctgctcccacgctttctcgacggtgacgagctcgtcgttcaccttgtactcggcggcgccatactggtactgcacgttcttcttgtcgtcgccggtgaccacgtacctgtagcccctcatggtggccgggtcgaaatcccagatgctgctgaccttctcgtgagccatgtacttggagatgagccagttgtcggcggtgaggacgcggtcacggccggcggcgaggaggccccgtaggcgcaacacgagcttggcgacgttgagcaaccagagcagcgacaggagcaccttcagctgcagctgcagagaaccgaggtaggagatgaggaggagcatgacgtagaacacctgcgtggcctggctgatcatggtgcgggcctgctggtcggcgccgtcgaggctgcaggcggcgatgccgtcggcgcagccgagcaggaagcatgcccacaccaccaccatgtcgttgcggaaggagcccgactgcatcagcccgatcgtgtaggacaccgccgggtagctcagcatcagcgccagccagaccacgaaacggaaggcggcgctgcggctggtgcggcggccagagccgaggaagacgagcgtggcgaggagcgcgcagctggccgtcaccagcgcctccacgcggaccaggagacccaccgggctggccgcccacgccgtggcggcgcgggtcacgttctgtgctacggacaggtgctgctgctccatctttcgctgatttcgagctagcttcttcctctctctccggttccaatccaaggttcgagtttggactttggacgaagagagcagcacatgtctcgtactttcatgtctagacaacaaggtttaatttctttattacttgaccaagaccatatgccaatatcacatgtctatgttcccggtagtggattctaaactgtcgatgggatatcccctcattatttgtacgtcatcctaatggttatgtaatttttttaaaaattcaacaagatagattaatatgtgataaatcatttaacaaacatactccctccgtactcaaaagaaagtcgtttaggacaatgtttaagtcaaaccttggaaatataaatcattaataactctcaagttgttgagtttgaaaatataaaaaatatataaatagatttgtcttgaaaattactttcataaaagtatacatatatcacttttcaataaatatttttatagaaaccagaagtcaaagttgtgttttggagaccgtgtcgctgtccagagcgacttcctttacgattacgagtacggagggagtacaagttaaaatgtagagcaattttacagtccttaagaatgtctcaaaaatttaatgcgaaatttgatatctcctaccaagaggtgctaaatttacaatagagaaagtggtacctcacggtacctcctaaagaactataaaattgttctagaatttaacttctagaagttgcaaaaaaaaacaaattaaactacgggtagttaacgtatattcgcactcaaatttgttttttcgttgcaacttataaaagttaaatttcaccttgcatgtttttgaagtgatttatcacatattaatatatctttttgattttttttatttttttcatgatcatttggatgacatgcaaacaatgagggatgtccccttgagagtttagaatacattccactttgttcccttcaaaatatgtcacatgttagtggaaacaatcaagagattataaagtccaaccaatgagactgtcatggttatggataccacatacctaatagtagttgactaaacactacagggcccaccacataccatgacttatacggaaacaaacctcgtatatagaaggagttccggataaggaaggataagaagagttctacatagaaacgatagggactactcagatcgtatccatatttatctccctagatttacttggacaagggggcacctatgggtataaatacgatcccccctaggaggagaggggagagacccaccacaatctacgaagccacaagacacaacatacacacaagccaatacgccactagatctcgacaacaaagattagcctaggtataccccatccggtgcttgtgaaggccggcaagagggatctagcgccatctctgatctcgacaagttcatatttgaggaggaagaatgccctgtcgttgactacgagttggttatatagccgctaagtcgacgacagctagataggttatcccaaatattgtatctgtatgatccagatgaataaagagcaacactggcttcggccaacaggatgtagggctattacctgtcagataaggggcccgaacctgtataaaaatccctgtctccatctcctttacctcaatctcgcatataccctggtaccaacgatccccataccatacaaataccctagtcgcgatctcaaacgtcgacagagacgatcacctaacttagccggtaataattaggggaggcatctgtcaaattttggaccgttagatttgctctaagattaatgccggcctctttttctcctctggctccggcgacacagcgatgaccctaaccagttagggtttggcgatggacggtcaacacaaacaagcggcaaggcggtgacaatagtgccaaaaccatggggatggaggacggtggtttggtgtcggaggcggggctaggcaagtgaggcgggggaggacgatggtcgggtggtcctagctgacgccattcgcgcctttaggcacttgcgaggtggggacaacgccggcgagctcgctcctcttgttctatcaagcgatgcgggagagaagatgaaaatgggagaggataggttactattcatgtacaaatgttgatgcaatcctagccatccaaaagtgactgaaatctaatggggtttctagtttcacatcaatgttccttatttttttgaaaagtaattcgcatgttacaatttggatcaatgacgacccacatgtcggcgatgctagggtataaaggggaaactacctcggtggggtggacacggatgacctcctcttctgccatgtcgatgagttctcctctctttatctcaagacaacatggtgaaggtcaaggtctagcctcaaggtagcacggcagggggagatggtgaagcgaacaatgacttcatcgaggcatggcaaggtcctagcagccaacaagaagcaaagcagcggtggtggcgcatggaacgaacgcgacgtgacgatgatagaagagcaaggcattaagtgcagggtgacatggtgaggggaggatgattgggtcttccgccataccgacggtaatggtcataagaggtttgtcgttcagcgttaatagcaccggtaggttaaagcttatgttcaaagtgaattagtgtgaaatcaagcaaggttttaaaggaaaaatgaagagggtttagtgcagtttatttgccctatcaattttgcattgagatggaagaatgaggcgatagaagaggagaaactactagggtttcgagcgacgcgggtggagctcgtgatgagaggcctaggccggttaggctatacggctatgtgcaggaaaaggagccgatcgtaagcctctatgccgatgtagacctagttctcgcgccattgctcccacttatgcttcaacaatgtgggaggaagtccatgacgtggcggccgtggaagtagacgcatcccgcgcgtgccacacggtgaagtaccagtagaatagttccattgatgacgagatgctgacgaacatgtcgtagaaatgcacaaagtcgaggtgcatcatctgtagctggtacacctctagaatctgcataaagaattccaaaaaggggggaccagtccatccgctgcatagtcggtgaagtgcaccacttccatcggctcattcggatggggtctaaaccctccgcacatcaccgagaccgccagccttcaccgatttgaggtcggcatataaggagatacgtcttctctatccacccgttgtcgtttaggcgggatggtggaagggcactcccatataggggcctcgcaagtcgattggtgcaaggcatcactgctggctaaggagaggcagaggcggcagggttgtcaaaggagggatcggaggtggtgcgctgcatgagaagaagcaataaggcggcgaactgaagaagagtggggcagcagcattacaaatgagatgaagtacgtgctgaagtttggcggggggttttatgccttgaaaaccctccgtgacgcttcgcccactccaccatggcgatacgattatcggagactgggagaaaaattagggtcgtgggtaattatgacctgaagcctcggaaactgaagacggccaataatgggaaaggttaaccagtgccccgtcacatcctcctgcaaccacatggggcccatgttatcctgtgcttcggtaacttcgagtagaagccccatccccaacctcaatggctctcagcccagcaatggggctactgtaggagaaacaggaataggaattccctttccccctaggagatcgaggcgttgtaggacccattgagccttccttcctgagggctcgggcactatgggccccgccaagctttcaaggtttcaagaaaagtccgggggtgacccgaggacacagagtgacccgaacatgatggccggccattgaaaagcacttattacaccctggggccccgagggtgccccgagcagtccttaagggggatttcactccattaaggaggggtactcaggactggtcatcacccttaaaacgaccactttgcattaattgtgatgtggttcaagcatggcgtacaactcatgccttacgtgggagacgtggtagtgcatgcaaccccttgcatgcttacgttgcccaaagagcacgagccacacggcgtggcgtgtcctcatcaaccatcactagggccaacctctattggcttcggccactaactgatgggcccggggacaattcgaacgaggacttttgactttccattccacttgttggtcggtaggtgtgcttgtcttatctagtcgattggctaggagggacagcgataatactaagcatatgaagtttagaggagttggccccactcttgcatgcatgcgatggcaatgtggactctccttcacatataaaaggaggatccataccaccgaaaaaagggttcgcactctcgttgaagctacgttagccaaacactaagtgagcaaggaacttctctcctccacacttagtctttcttcccacaaaaccttgtaatccttccacccatccaaagtccaccacacaggagtagggtattacgccgcatccatatgatctgaacctgtatacttgatcatgtttgttgtttcttcttgcacgtgaagcgggacccacacttaaaacttgcacccaggccaaactcacaaaaggggagtacttagcttccctgctagaggagtaccggactctgacataacatattcatgcaaattggaaagaaaaaaaaacatatattttgaaagaaaaaaaacctatgtctagctgcctaactggcgcacattatacaaggacattcagatcgagaaggtcaaattaaatatccatgacagataacgcctaagggcacccacaatggttatctataggctctctacaagagatccatgtcagcatattttcctacttggaagatattaaatgaagagagagagcaaagctatctactaacttagagatagtctatagagaaaaacgaggcaaggcatgagagagctatagatacccatgtagacatactattaatctagtctattgctgaaatgtacatgttttatagaaagcacattactttaccattgcgggtgctctaatagtcacacattatacgaggacgttcggagagagtcaagttaaatatccgtgataatgtttggtcagataggcatcccatgtaccaatgggagatcggagtactaacaacagtacagcgcaataaagaactcaagcaatcagggccatctgtattaattaattttgatccgatggtccagattcactgctccaagacatataaaccacagggtagcgcaaggcagcagcagagggactaaaaaccatggaagggggacagccaataaggatatactgcaagggagatacaaccttgaatgtggccgtccgtgggaacgagctgcgtctcgtccgggacgaccccaacgacgaatcccaggtaccaaaagctagcaatcccagctaggatcctatttaatttgcatattctaatttggtctttggttgcttgattttgcctcaaatcatcagtatttacgacctgtagtgtagaagaaagtatgtcgaagctgttaatttttgcaattacatgtataaaccgttgtgtgatattatactaccgtttttaatttgcgtggattcggcaatgtacgtacgtctggtctgcacacgatcgaacatagcactggttccaggtgtgcgacggcgtggggaaactgacggacgacgaggagcggccagcgttcgcgctggtgaacaggacgacggggcacgccctggtgaacggcggcgacctcgagctgggtctggctccctacagcggccatgtcgccgtggagctctcggtactgtggtcactggggcacccgcgcgccgacgggttcatggagatcaggacgctgagggacgtcaggtacaccctcgacggcgtccacgggttcgtcgacggggggtacaggctcaacggcatccacgggatccccgagcatgggacgctcgtcgccatctatcactcgcagcccacggctgattatgccgtctggaagattgctcccgtcggccaccaagagccgcacagccacagcgagtctgatgatgctctggagtcttaggttggacacggccatttccaatgcaataatggttactgttggagtcgtacgtacaaatgaattaaattattactagtactatattgcatatctagctagtgtgcgctacgcgattgggtatcagtacttggagatctcgagttgtagtccttgcttgcttaattaaataaaagtagcagctggtggccggagcattcttgtcaggagtctctctctagcatttatttgttttttagataatggattaaaccggcctctacacccaaaggatgtacacagcctaaaagtctcttacacgagcacttaggctcacacccttacaaaaggtttaacacaaattcgagtgaccacaaacggacacttagacaatgacagagattaaccaaaatagtacttaagacaacaaaaccccatggtgcaaagaagagagagcattaaacttctaatcttgttcttaagttccaccctttcattgcaaagaaactagaaactctcttctccaatatcatgcaaccatcttttactctttggccatcttcctccttaagcagcgaagactattgtcttgcccaaaaaagttcccctgaaaatcacctgcaacaagaaattagtgttggagccattaaagactacatcatttctgcacaaccataccgcccaacacaacgctgggaccctctccaaagactttagtttttagcttaggttgaacccccctttagccaattacccaataagctagcaacattcctagttttgagccttagaaaagtagaagaagatagaatttctaagagtttacccttgtcgaattgtttgtgtaatgaggttaacaataagggatttagttcagaaggagaagaagagttagataaccttgttcttggtcacttatgtggtgatttagtagaagaggttatggatgaggagaaagaccacctaagttgtggtgctcaaaaattctccaataattctaacaggaaaaatgctgagataaggaggggaaagaggaaggttagagtcgctattcgcaaaaagagggcatcatggggggaattttctggaatagcagaggtctgggagacttggctaaattcagatttctttcggatacctcaaaagagaaaaagctagactttattgcccttttagagacaggtaaaaatgatttctccaacgctagtcttaagagtttttgtggaggccaagatttcttttggcattggacaagaccaaggggaagatcaggaggtattttgttaggaattaatgaggcggtctttgacatttctagcgttgatgaaggcaagttttatattaagttccacattaaaaataaggatgatggctttcaatggatcctcgtggcaatctatggggcggcccaagaggaatacaaagaagctttccttgttgagttggttaatgcttgcagtaaggagtcactacctattttgcttggtggagatttcaacattattagaaatccttctgaaaagaacaatgataatttcaatgagaagtgtcctttcctctttaacgcagagagttggaactttctaggcgcaaattcacttgggctaactccttgtcaaaaccaatgtttgagaagctagatagaattttgatgagtaccaaatgggaacataagtatcctctagcttcgaatcgagctttgagtagggaactttctgaccatacaccactattgttggacacgggtgttaatactcctaaacaaccaatattcaggtttgagcttggatggttgttaagagatagcttctatgacatggtagcggatgtatggaaaaaggaagttaaggggggactaagttggaaagatggcaaaataggatacgtcgggtgcgtcaatttttgaggggatgggcgaaaaatacaagtggagcatacaagaaagagaaggctaacttgttagcaaaagcggatgagttagacaagaaggctaagatgcaatgtctatcagaacaagagttaaacctcaagaactatctaaaaaatagattagcacttttgctaagggaagaggagataaaatggtaccaacgggcgaaaacaaaaagaattgtggatggtgatagaaatacaaaatactatcatttgatagctaacggaaagcaccggaagactcgaatttttcagttggaacaagaggagggtgtaattaagggtgacgtacagctgagaaagtacattacaaaatattacaaaaacctctttggacccccagaggaaaataatttttctatgagggagtctagaatagaggacattcctcaagtctcaaatgaagaaaatgacatcctaacaaagtaattctcagaggaggaagtaaagcaggctatcttccaaatggaacacaacaaggctccaggtcccgatggatttcctgcagagttctttcaggtgttttgggaagtcattaaaaaggacctaatggccatgttcaatgactttcataaagaagaattgccactacacagcctgaattttggtatcataactcttccacccaaacataaggaggccaaacaaattcaacaataccggcctatctgcttattgaatgtaagcttcaaaattttcacgaaggtactagcaaatagagtagctctagtagctcaaaagatcattagaccttcacagacggcctttttacccgggagaaacataatggaaggtgttgttattttgcacgaaacaattcatgagatgcacaggaagaagaagaatggggtgggtattaagcttgatttgaaaaa

SEQ ID NO: 43934 - DNA, 1779 bp, Oryza sativa
taagtttaacaaatcagaacgatagcttcgtgtaggaggcacagaaaaatgggctcttttctattaactcgatgtataaatctatcatgtacagggacgtcattccaaaaaatgatatgatctggaaactcaaggtaccgctaaaaattaaaaaaaatttgtggtacttaagaagtggagtaatcctaacaaaagacaatttggtcaagagaaaatggaaaggtagtgttaaatgctgtttttgtgattctaatgaatcaatacaacatcttttctttgattgtcctcttgcacgatttatgtggaatgctgtcttcatttctctctctagcatataacgtaaaagttacagttttgtgataatttctcacgctatcattgtagcaaactgaaacatgtcgctaatgttatagcaaactgatagttttgtcattaaagttgcaattttctgaaatttactctatatatattgcttgtggaagactaaaattttgttatagacgttcgtgctgcgatgaaataatagagttcccttccccttgccaaccctttccctcccctcgcatccatagctagctctccgccgctcgagccagctgtcgggagtccatgcccgccgtcatcgttgccgctctgcccaaggcgcagatccagccggcacgcgcggggctggcggcgccgctcccagtcgcctcctcctcctcctcctcatcatcagtggcggccaccgcgccgcccgccgccggatccactcgggggagggcgggggagggccctgccggcatactactcaagcccgccgctggagctgcgcggggcagggcgagggagccgcggccttcgccattgcccgccgtcgactgcgctgcccaccgcccgttgaccaagccactcgctgccgccgaccgccgtccacgctcgccgcccgccgccgttggccgcaccgcccacactggattgcgagaggagacgagtgagagtgagggagaggtgaggataaggatgaaattttgaagtgatgaggagggaaaagaggagggaggatagacttgtaagcttagtctattagtttcttcttttcagttgtttgttatttatctcagttatgagattaggggtgtatatactcgtgtaacttttagctatatacttgaggccgggattctatccattatctaaaaatatatagagatgcactgcctgtcattttaatcatgagtttaatcgaacattttggtggtgttctttttgttgtaaaccaacgcgcctattagcggatcaccggatctgttccctgtccctcccacaatagtagaggcgtgagatgatgtagaacacccgcgcccatccctttgccctcaagaacattgcagaagtagacaatgaacacagatatagggtggagctctctcttcattatagatctcatctggagtacaagccagccattagccattagatgtcacaccctgcccctgtatatatacattgtgaaacggatggaatatataatagatagatagattatagcacaagtctatatctatatacctaataattaaaaaaatacgtaaggcttttgccttcctttcgtccgtccggcccctctccctcccgcgtacctctgcttctacctccctccctcctagcacccccatttctccccctcccccgcagcctctcttttccctggcgtatgtcctctcctgcctccctccttccctcccggcaccccacacccatctctccctcgctgcacacactccctctctccctcgg

SEQ ID NO: 43935 - DNA, 8679 bp, Oryza sativa
acctcacctcacctcaggagtctgtgaggtagcccacttgtatttggtgtcggtcaataaagacagatcttcctatgatatgacctagaaacaggtctaagtgatcatcatcgagtcaatgccccgagcatactctaagacatttcaatgtctcgcaaacgacaatcaacacatagcacatactccccctgatgacaacctttgtcacaaaccatgttcccatagcattaaacatctctcagatgtatgcgtaggcaagaatccttcagatcctcaaaccattagtcttaaaaaacttgtctcatttcaccgctaaaatgagaatagggaacatagagagtaatgcatttcatcactatcatataccatagtaccacactgttatgcaacgcaatctgtttcatccttcagaaggattatggggataaataagtcgcaacggcacacacctcctcggcgtgactccatcaagaactaggtcttgatcattacaactctctctgacagtaccaacaacaattggggatccataagatcaaccacaagcctttcaaagacatgttgtaacaatcaaagtaactagctagtctgaaaatttaagcactatgggggataacacacagccaacaacaccaagtatacctcaataggtattagaggacaccactattccaaccatcaggtggagtagatatcacgagtgtacacactccaaagtgataatcgcgagatgcacatgtgcctacagaccctgtctatttgatctcatcaggttcctcattgcaatcttatcaggtcacaattgggtcttcatccctccaagggattacacaattattggtgtgctcagacttactaattattttgtatctcagaggaaatttcatcaatgaggtctccccgttagagaaaattccatcaatgagattttctcccaacgggagatggtactctttccggaatacctattggtagaagatttgcatgatgctattccactatggagtctattcaagacatcctcatggatttcccagatcccttaactgcatatttaatttcatgccattttaccaatacctttatttagcggaacattcaactcacgtgggagaggtctcatgaaggacctacttgaaccatcgcacatcaccacctcattatatcaataatgacccataaaaatccaaacaatgttcgcgattttcaattggcgattcggttcagcctcaactgcatttccatttgacccgatttgagcactgtatgctcatgccatggacttgtttcggatctgggttctctcagagagaatcattagcaagaggcgacatagtgtcgacacatttattcccacttacacatttaaccagatattcgtcatttcccaaaacgatcgatccatggttgttccgtattcctagcaccataatatgcgcgcattgctaggaatgtcgtctccacgacgaaaaccattatgaggtatatcaccttccaaaggtgaattttccaccaggagaatcagaggagtatgctcacatccagtgagaactcttatgctctgactaaggcctacgaaccgtgttagcaggcgtccccgcacaacatgatctaatgccataagtcttacctggatacgatattattcccgagtctatccacatttaccacaattgggagcattactcttttttaacaactatctagttgttcctcatatgattttgttggcaaaaactcgtgcaccaagcaaccaggagtatgaattaaacatacaagttcagctcatttagtgcgttcactcaaagaaatctccaagcattccaaaatgggcatttctctccccctaatgccgagatgtcttgcaatagcatactaccaatccccatatcgtcgcataggattaaggaatttcacctcgatcacaaatgttctcccacgaatgtatgcttcggtggtgatatatttgggaaatattacgcactttaattggagagatttttcccttatatgcagtgagcctggacatataccgatacaatggcatgaatattgtatccttccttcctccgaagggttatcctcaacctcctagttaggatatacaattctgcaaaaaccaccattgctaccaaatgtatatgcaaccaacatgcaaatactttagccaaatgcactctccatgaattaatgctcacctagtgccattcaaactcacaatcgattccggatcgacgtgcattagacatcccatgtcatatgcttaagtaggcaacctatggtggcaaaacgcattccgatgcgctcaacaaggagtatgatagcaaagtgcgcggccactagcctgcgctgccaagcagatttttgtggtgcagagttatgttaaagtccagctcgtctaatgcccaagtttgacttcaattacttataccaaactctagaattgggtcatagttaagcagcatgtttttaggtacgatccacgagcgaattatcaaaccacatttgctaatgtcccctggacatagccatcagaagataatcaatacctccgacaatggtaatattcacaataaaaccattatattcagacatccacaaaaatagtggaatatgtcggtgcaaccgtcgttggcataacgagctcaacgcatacaacatgacgaacctttgcatggctggcacacgtccacacgcgaaaaatgccagtgtgcgacaaacatggtcatcaacccgtgggtgatcaaccaacacaacctgggagtagttattgactacgagagcgcgataacacacaacagtgcatagccaacatttgtctgaaatacagttacgtcaaactgtgtgagtggttgtaactcctcggattatacactaattgttcttctaaactaaagcattttatcaattctagcatgaagataagctttagaatagaacaggaaagaccaagaactttatttatctaagaaatatcgatctaatacaaagttccaaactaagcaaaagataaactgcttggcaacagtatagtcgaccaatgtcctcctaggacatgctctaaactagccatacaactcctgttgtcagaacaactttattagacaaacactaccaacaattggtcaacaaccagaggtgaccatttagcgctagatccacacgaggaccgagactgagtcaacacccaagtcaagctgttggcgctatagtgaaatgggaatcatgcctattcacagcatctacccttgggcttattcctctagatttgccacctcttttctggtgtcctcgcaagacatcaggttccaaataatattgagaagatatgtgcacaccaagggcaaccatacgaacagtgtcattccaccacatggaaaacactttacatctttcaccgggccaggtgaaaaatatctcaaattattgaacctcacaactccacgttgccagaaaattgaggtataatcatttatctccaaatcagaaaagcgtgctctcaacctttgggaaagcaaaaaaatgtcgaccatagtccgaccatactctgattgagatgttaagccactagggaaaaggcacaatgaatcccaaacacattgtctaatttcacacatttcaacgactcagaatcccattcttgagtgtgatcatagggatagagtgatctacattaatgcccaaagccatacaatagtcattgaaggcctttacgtgaaatcacccacactatcatccgaatcgtttcatgcggttctcagagaacgcaacacgcaaacggacgatatgcgcagtgaattcggcaaaagcatggatctcgtacaacaagtatacgtgactccatctcgtagacacatcgatatcaccatttatgtatggaggagtgtatcagtaaagagtggtcttatccatagtcatggatatttaatttcccagaatttccatgcattaggtgattttctgttatttatttggtcttatttggcattatattcccaatatttatgccacacagaaaaccatcacacataaatgcaggaaaataaacccatcataatgcttccaaggggggaattctacactatgtgtacacaatttatggaagcatcataacctagaaaaccatctctagattatttagttggaattgcatcaattttaaaagcaaagcaatgcttaaaaaacaccattacatggttatttacgagtctggagacccacatgcaaaaccaaactatacaagtcctaagcaacaagacatagccacagtaacaaaattaatataatctcttgttaattacaaggttcaaactgtaaaattgcattaaccagtgaactatagcataaaaacccaacactccgggggcttaaatgcaagttgtcaataaaccgaaattaatcgggccgaattaccgttcaggccacgatcttatttgggctagcaagcacagcgtagcccaaaatgcctaatgggccgaatttccgaaactgtaggcccatgaggatttccaggtttattatttttattaatttgtttgggctgtctcattactgttgggctttattcagtcgggcggaggcagaccggcccagccggttcgcctaagtgaccgagagagggaagggggggaattagggtttcccctttcccattcattgtccgcaacggcgtacaccgcccggcgcaccggcccctcaggcacggcggcggcgttggaggccgtcgactgtcgactttgaagggatttagggcggcgcacggcgaggaggtcatcgacgacccatccactaccgcgattggcaggacggcggcaacgacattactcccatgtggcaatttggtgcggtggcggctcggtggcacacgacggagctccgcgtcgacccgcgcatcctcatgacggcggcgaggtgaactcaacgacggcaactgagaccccaacaacggcaaccaaattgcatccggccatatcgtctcggcagaggttaatccagtagcagacagccgacgacccatcatcctcccaccacggctcgacggtagcgtcgatgggaggtcaacggcggcagcgcctcgcttcggcattaactccggcggcaacgacgatatgggtttagggcttgctccaagacggcggtttcctgcgacggcatcaacgcaaggccgacggtgtacccaacagcgacggcgaacgacagttgacatatctccaagtccgactgcacagactgagaatatgtcgtcgcgttcccggcgtggcgtcatcagagaaagagagagagagagagagaaacagagagatgcgagggagggtgggcgagacggccggttcggcccagccaaattaggcacgtctctagtccaaggtatcccatcaattttagtgatttctctcacactgttttctctagttttcatcagataaaatagatgcatatagatcaaaagcagaaaattaatctactgctggatcaagagcaggatcaaatctactgcaagcaaagcatccataatatgataaaaacgagaaaatatatataatcaatcaataaaaacatatatagaccgcatacctcaatagacacatgcccggatgtatctatatatgaattagtaaattagtttagaaactaatcttactaattaccgtgattagcgtggttgatgaagagcacgtatttatctcttggtagtagatgtcaggtgcaaccaagcctcgcatcgcatgtgcgtgtggctgacgtgcatgtaggctggccgaccggccgcctggtggaggcccgactgactcgggccatgcatgagattgatcatgcatgtggctgctccgtgcggcagggcaacacgcgcgcatgccgatcagcccatggcctgaagtctcgcgcgcagacgacggcgagaatcgatgcgcacgcggcggagccgtgagcggcatcgcacggcggctcacgtcttgcaggccggaacgccgtccgtccacggccggtcgcgaggtcctccgtggacggtcaagcagccacggacgacaattcctctcctggctgcatcgtcagatacgcgtgcgacgtgccactgccatcacggggaggcgatcggccggccatacttgaccaatcggcatcgcgcgtcacgtggaggagacgccgcgcaggtgccgctcaacggacggtggccaacacgagcacggcggcggctcgcccatcggctgcgctacatgcaatcatacaggaataacgacaattagattggaacgacaaatcggagatggtagagctactgataacgtgttgtaaaccaacacgtctattagcggatcatcggatccgttccatgtccctcacatagcagtagaggcgtgagatgatgtaaaatacccgcgcccatccctttgtcctcaagaacattgtagaagtagacaatgaacacagatatagggtggagctctctcttcattatagatcttatctggagtacaagctagccattaggcattagatgtcacaccctgcccctgtatatataggggtcttaggaggagatagatcttatctctactccggttcggattggtccacaagaaaggatctttatctccccaggagataatattccgtaacacttttctcctgaagatgaagattaagtttttttacgcaaaaccaggtggtattaacgtatgattgattgagttttaattattataaacttgaaaaatagattgatataatattttagagcaactttcatatagaaagctttcgcacaaaacataccgtttaacaatttgaaaagcgtgtcacgaaaatcttaatcttcatctaacttttgttggagaaaagaacgggacctttgtattgaattcactatttgtattcaactcactatatatatatatatatatatatatatatatatataagaatatcataggtaggaaattattaaatgcgtgatttctttcgtcaaagtgttagcaaccaaatttggtaacatcagcatcggagagaagattagatcgaagcaaagtcggaagcggagatcgagtttgaaaatagggtaggaatcggctaaagtccagatcagctacgacaagatcggctgagtctgagtcgagctaaataagccgatatagccgattccgacaataccacttgtgcgcgacaccggttcaagttaatgtacttcaagatgattgccacgtatggatagagtctttcacatcctgattttcgttttaggatttataaattatttaataaagtattattagaatttatattaaatgtttattaatttacaagtgaagttaaatgtgggaaataaaatttcctaaatataaagcatggatggatttattttttattaaattctccatggttaattatactctctggaattttctcggatttttcggagctcaattcctaattttaatcatacaaagaacatttcagtaattatccacatattaaattaataattaaatggtctgtttttaatattcctaaatactttgagtgtccaagtatgttcaagatttttcttggaattatttgagcattggaagtatttttaacaattcaaagatcatttcagtgattaatttaattggaaaagtaattaaaatccccttttccttttccggctgaaactggaaaagttcaccttcagtcctcggcccattctcccttcctttcagctggctttattcctcctctgaagtccatttcttgtccctccttcaatcgggctggagaaaaagaagcccagtcaaagtctaattcgcgttcctgccacagtgtcgtcttcaagcttggacatagcccgtgcagccgccgagccgtgtgtaccgctgccgattcctccgcccgattcgctcgattctctgaaccgtttcttgaattagttgagggtaaatattcttcctatcctcctctatcttttcccccaagaatcggactttatcccgaagaaatcaacgcggaatcgagctcgattcgagtttatctctccaccaaaccctaggttttcccggcgcgattccttgcgttccaagcccgatctctctctcccatgcctataaatagaaccccaaggctctcctctttcgtttccaacctctagctcgagctcccgtgccctagccgtctctccccacgctagccatctctctcctcctccggccgccgctccagccggctatagccgtcggctccgccatcaccggtcagcgccgtcgcctccatcggtaccgcatcgaagagaggaagagcggcctccacttccccgaagccgaagacaaccggaaggccattgccgacgtcaagccgatctgcttcgcctccatccgcgccgtgccgtcgcctcagtcgtccccgacttgtgccgccacctccctcggcatcgcagcaccaaggagaagcccgtccacccctccgttgccgctgctcgtcgccgaaaagccgctgccgtcgtcgaccagtaccttgccgccttcggagtttgtcgccggccgtcttccgtcgtcgttcgtcgtcgtgccgcccctcagtgagttccccgcgtcgtgctcgtcgcgttggtgccctccgtttcgccgccgtgacctagatcgccggtgaccgtgatgtcccgagaggccgttgatgacgtcatcgatgacgtcataaagccctttt

SEQ ID NO: 43936 - DNA, 2843 bp, Oryza sativa
agaagattaattgaagaccgattattgcaaggcaagtcacacagatactaaacacaaatcctttgagcatgttgatcctatatttaaattctctatttatttcaactgtgcatttattttcgaatgtcaccgggtggtgtgaacctattcctttgttatggccaatttgcattgattatttctttgttatggccaatttgcattgattactttattccttgataccttgggtaacaaattgattagcttgaaccttatatattggtttggttcagctaaaagctatatatatatatatataattgcttagccatgcttagaaacattagctcattaatgggatgaatcatactacattattatttatgattatatttaatggtagctcacgatggttaatcgtgttatgataattaattgataattaaaacttgtcaatggtgggttgtgagcacatggttttgaaggtcgtgctcatgacaattaaggaccggttcgcgagctactgttgtgagacattaaccgtaccaaccacaagccagcgtgggcaacggttttaccttttgtatagcatgattcattgcggggtgccagactgagaagcggcgagaagtccgtgggggtcgctggggagtccatgcctctggtttttgagggggtgattatgatccaggtatggtgcactgtggtgagttgtgttgtgctgagggtattgtcatagcctctattcgggtactttccagtatcgcgacgcatggtagacatgatgttgaggctgtgtcttgtgggtacagtggtacacctctggccagagtaaaactattcgaatagccgtgcctgtggttatgggcgagttgagcaatgtttttcgtgattagtctcacacctctcacaataattattgatgctataactggtaataatttgtgtagctcctggtttggaggtttgatctgtacgaccagggttggttgttcaggtttggttgggcctgtgcagtattggggtgctgttcagtgttgattaaaattgatgattaattactctactgttttactactcttaaatctttgctaaatgctgcttttgcaaatgagcctatattatgccatcctttggtatccatgtgcacttgcatatttgctgtgtggcttgttgagtatgtcatatgctcatccttgcaataatcaatcaacctcagttgaaaaaaaaggatccagaaggagaagacgtttggcttatacccctgaagccatcactagaccgttaattccgctgctgtttacttttcttttgtaagtatgtaacgttattattataatgaatttgtatattaaattgtcagtttgtgtacctcgactgattcctggacgaggattttatgcacaaataagttcggaaattactagtgaatttccgggcgtgacagagtcctgggaaggcaattgtatctattaactaggatattttatgtgaattccttatagataagtgtgggcaaaagtctgccacaaagacttgtggtatcttagagtttgttagagataatggttgtgtccggtatgggcatatcttgtaatcctcgggtataaatagaccccgagccctatgtaataaaacacacacgttcaatacaatctcggcacatcgccaccctttttactttcgttttatttcgacgagttcttgctttcgggttgagctgcatcagtttcgatcttcaataagaggtaaacttgttatggcagcttgcgttctcgggattagtgcttctatctttatgacactctaatcttgtttatgtaattcatcgagttatcatgtcttacataatctctaacaatatcatcatctaacctgccgtcggttaatatctgtcaatagagggtagccgattaggttaaatattgatattggtctagattatacgagagggtagccgattaggttaaatattgatattggtctagattatacgagacatctaccgttctatgagacttctagcggcttgattgtctagatattgttcttcttttcatacttaatgttgcatcagttatgtttgatctattaagtcgtgcttagaatatcaatccctagcctgccttctagttgccgattagaatagcatcggagtttcagccgattgtatctaatttaactactctttatcctatatgcttgattgacatgttaaatctgccctttgtattaagatcttgccgcatttaagtatattaggcttttatttagtatattctacttgctttaacatcttaacatagagtggtatcggagtattagccgatacatgctagatctatctgatcggctatgctatgaacgtatatagtctaattattaatatatatttcgatctaagtgatttatactgtctcggcatggcgaccgatctatcccaatcactttatttaagtatatatcgatataaggattatatattgttaatatctatagccgatcgagtagatttagttcttctttacctattcatgactgtccatcgatacatggatgacattagcccaaagataaatgatatgtcatcagcatctagccgatcggctatcatttatagatttaactacagtttctttgcttctatttcttgttaattacaggatcaaatcaactagcatgctaatacatccgaaggcgagctttggacctgcactagagttaagcagactcccaggccacgtgttttctgtcaacacaaagttaggtggcactactacagaacaggtctttccatacgggcgaaaaggattttcgcatgcgggcgctcaaaccgactgcacgaaatgagatgtaatgat

SEQ ID NO: 43937 - DNA, 7555 bp, Oryza sativa
gtgaaaaaaaataaaattcaaaaaaaaggaaaccctagccggccggccggttatgccgccgcccgcccccgcctccagatccgggtgacctgaggcccgccgccaccgaccacgtcgccacccgcatcgtcgtcggccgctcccgccgccgcccgccccggttccgccgccggccaccaccgtcgctgcccgccatccccacccccgccgcctccagatccgggcagcccagccgcctccaaatccgccgccgctcgccagccccgccgcctccagatccgccgccgcccgccgcctccagattcggacgggaggagtctgtcgccgccgaccacatcgccgatcgctcccgtcgccgtcgaccacatcgccgggcgggaggatgcccaccgcccgcgtcgccgcccgcatcgccaccgttgtggacgccgcccactcaccggatcgccgccgtcgcccgcatcgccacatcgtggacgccgtccgtatcaccacatcgccgccgtcgtggatgccgcccactcacccgcacccccgccgctgagctaggtcgccgacgccgcccactcgcctgatccgccgcccccgctgcgcgccggccgtcgccgtagccgcagccgctccctagggcggcggatccagccctcccgagggcggcgccgccggatccgccgcccgccaacgcatcgccgcccggcggcactctcggagagggagagggggaggagaaaagaaagagaggagaggagagaaagagagagagagagggggtgggtaaaaaatacagggagagatagaggagatgagttaaaaaaatttgaagtggtgagagggaaaagagagcgggaggagatgaaattggggtggtatttttgtatgcggaccacttaatgagccgtctgcgaaaatagatttttgcatgctgttccttaagtggaccgcatgcgaaaatagttattaaaaaattaatttcaaaatatgagaacttcgaatccaattttaggatattaaatgaactcaaatgaaatagttgtcaaaaacaaagttgtagaactcgttgagatctaacaattttcttttggtcatttctccatccgagtttcatttaactatataaaatttgaactttataatataagaaattcaaatacttttttcacatagtaaatgatttcaaatataaaagttgtcaacaacaaagttgtataacttatcaagatctacaacttttgtattggtcatttttctatatgactttgtttgtacagtttaaatttgaattttcaaaatatgagaacttcaaacaacattttcaaatacaaaatgatttcaactgaaaaagtcatcaataacaaagtggtataactcatcaagatctataacttctattttagtcatttctttatccgacaaagtgatttgtaacattattcgcaaaatgtatatctcttatatagttttatagaaactgcataagagatgtacattttgtgaacaatcttacaagtaactttattagatgaagaaatgaccaaaatagaagttatagatcttgatgagttatacaactttgttatcgatgatttttttagatgaaatcatttactcttcaaaatattatttgaagttttgaaattcaaatttttaattgataaaataaagtcataagaaaaaatagccaaaataataccaataagaacacaataacatgatagagcatgattttagaaacatttagaaaaaaaaatcatccaatttagagttcatatgagtgagatacactattttcaaattttattttcgcatacggcttcttaagtggctcgtatggaaaaatcgatttttccatgcgggcgcttaagtgagccgcatgcaaaaataagcttatttttgcatgcggccctcttaagaggcccgtataggaaaatcgatttttccatacgggccacttaagcaaccgtatgggaaaacgccagtagttatgatccgcatggaaaaatgatggggcctcgtacagaaaaattattttttaagtagtgtgggatgacttaattaatagcttgtctcatgtgctatatgtttagggccaaaatagttacaaccttcgtctcattgatcatcatctgatcattaaatgataaccgatgctctctcatctcatcatcttactcgtcatttgacttgttccattaactttttataatttgtgcgtgtttccaaatgctgcacgcatatgagcagcactggatccaggactactccgtggggagagtgacggatgaccagggccgtagggcattcgccctggtgaataacctaggcggtacgagaagagccgtgctgatcagcacaaagaataataggcagctggagatggctccctacggcgattgcgtgaagctgtcgatgctgtggtcgcagggcgtgcagctccccggtgggtacagcgaagtaagggtgctcagtgacctctccatgactctcaacggcatcaacggatttgtcaaggaaggcacggtcgtgggcatctacaatgcggagccacactctattcatgccatctggaagtttgatccaattaacaagtgagatgatgtactactatagtagtagtaaacacgaaatattatatttgcatgcacttattggtcatcttaatttgtaataaacgtgcacgatttttcttccgccagaaaatttgtgtgccattttcggatcaggtttgtttggcaggaaagacctgccaccagaagccgaattgtgtgtatcgggtttccaacaaaatcgagagatatcagcaactattagaagattgggacctagctccttataatgttgcgttctccacaacatctgcgagtgcgacggagatgccgacagtgccttagagctcttcgacaatgacatggtcatcgataacgccttccgcgcgcctcgctaccgtgcagacccacaccaccatctatgccccttcactattgtcgacgccttgcccacacttctgcgtggaggaggaccaagccgctcccgttgtcccccgctctgtcccccatagcctccatcctcggcgcgcagaggaaatgtggcggccagccacgcgtggctgccttggatggtactgggaagagaggagaagatagtgctagccactgaaatgtgagggtgtatgggtcccacgctgacttgtttgccacgtcagctaaaagcgtaaaaccaggcataatactgcctatgaccttggtgatacgaatttcaaactcgacgacaattgatggaccaaaagcaaattaactcgttcataaatatagttaaatggaataagttcacttgaggtcccttaacttatcaatgaatccgattttcatccttcaaccgaaaaaccagatacaacgggtccctaaactatcaaaaccagtgcaaagcaggtctctcagcagttttgatggtggttttggctgatgtggcgcttacgtggccagtttgacttgatccccttcctacgtggcggtgacgtggcattggaagcaaaatataaaaataaaaaataaaaacaaaaatgtgaggcccacatgtcagtcagacaaaaggaaaaaagagtgggacccacctcctctctatccacggacgagtggacgacggttgagggagcgaccgacacctcctctctctccctccctacatccttcctcaccagccggcgagcgcacacggagagggaaaaaggcgtcagccagcgaggggggcggagctgctggccgcccgcctgctgcgtgcggatcagcccgccctggatgattctctgccgtagcgtcttgccgccgtgcggccagtcgaaggagttgacggtgttcagcgtcgccgcgtcgacgcggctgtccatgttgaagctgatcggcacctcgtcgccgacgtagtacgtgttccgcagcgacgccagcagccgccgcagcgacttggcacggttctgcgtgatgatgttccccgagatccgcatcctgttccagtctgcgtgaaatccatagatcggttagagctttgatgtagtttttggttgcaacaatggcgaatgagaactttgaggtagaagaagattactgggcagagaggtggggtggagggtggccatccagagaaccttggagatggagttgcgggggaggaggacgaaggcgatgtggttgatggcggagtcggcggccatgcggaaggcgtccttgatcttggcgtcgacgttggcaacggtgatgatgacgctcgggttgtgcatccggatgataccacgcatgctagagtagacggcctggaggacgggcacctcggagtgggatgggccggagagcgcgccgacggcaaggtcgaagatcttgaaccgcctctccttgcacaccaccttgggccacttgagcaccgtcgccgcctcctctgcaggggtagtgcccaccgccggacacgacgaggtaagccttacagccgggggtggtgcagaaccgctctagcagcaacgccagcgcgtggacctcgctgagcgagtgcgcatagaagagtgcgtccaccttctgcgggtgcatggcctcccactgtgtgacgtagccggaggtgagtgcgcgccaccactgctcgtcccgcatctgcacgatgtccttgaagatcaccgtcgtctcggcgaggtacgcaagacggtgcttgctgtccccccacgtctccttggccgcaactccacctccatcgctgacctcccgtactacttcgtccacaccctcctcaccgtcatccacgccatcctcccgccgccctccaactcccgcaaccctggtagcctagctccgcgtcgcagcccgccgaagagtacggcgcagtgggcggcggccaacgggcatctccgcccccctcgccggccggcgaggaaggatgccgggagcaaagaggaggcgccggtcgctccctccctcgtcgtccactcatacgtggatagagaggatggtgggtcccattcttttttccttttgtctgactgacatgtgggccctatatttttttttatttttcatttttatattttgcttctagtgtcacgtcaccgccacataagataaagaccaagtcaaaccggtcacgtaggcaccacgtcagctaaaaccaccatcaaaaccgctgagggacttactttgcctggttttgatagttgagggtatctggtttttaggttgaaggacgaaaatgggattcgttgacgagttaagggacctcaagtgtacttattccaagttaaattaaaggaataagatcactttgactcctgaactgaccactgaatctaaatcgtatccctaaatcacaataccagaaatcttaacccccaaacttgcaaaaccggtgtaatttgactccctttgtggttttgaaaggcggtttcgctgacatggtgcacacgtggcagtgttgacccagtctttgtcctacgtggcattaacgtgacgcttatgtggcattaaaataaaaaatatatatgcggggcccatttgtcattcacccaaatatatttgtggtagatcccacgtgccatcctcccttatcccttcgtcctcctccctctcctccctctctatctctccctctttctcttcgcgcgtggggagtggcgtccggatcggcggcggcgatggggggcgatggacgaagcggcagtggcgggtgggagggcaggcgtgcagccattggagttgcggatccggaggctagatatgcccctcgcttcattcctcctcccgatagactacaccatggccgctgccgctgtgctgccgaccgtcgccggggagctagccactgacgagaccaaacattcacaaatctcaacagggctagccgcctaggcccaaggcagagctggctggctactaggaggacgcgggagctcgggtccctcggcagcggcgcgggcgctccagctctatctgtttggccgcgtcggggaaggggaaccatggcggagagggtgccttgcttcgaagggggatagggaagaggacaaatattgcccgctgggcagtagccaaaagcaaaggagtgctgggacacatctatacacagctaaacaatggcgatagatcctacaatgctcaaaactaaaaccactacatcagttcaacatctcgaaacaagaaatttaaaattgaaaaaacaaaacaaaataagccacgacaaattgtccaaatttcacacgccgaccagcacggacttgaggaaactcctttctcagcggcatggctccggcgtcctcaaaggacaccgcttctgacgtcgacaaggacggtcactgctccatacacggctccggcaacggtgggagggtgtcgttaatggcgctgctggagtaggcggagcggcggtgggcgacggtggccggggacgccagcctgagatgcatcgagggaggtgatgatgaacgccatttggtgacgcccacgccgatcgtcgtcgcgagcaccgagttgcggctagctatgccggccgccttgaagatgcttgggtcgtacagcaccacggcctttaagccgatgaggtgctggaagaagtagatccccaggacggcgatgacgatgcgccgcaccggcggcgtcgggtgcaggaacgccgagggagccgacgccgacgccagcgacgcagcggccggcaaggagtgtggcgaagttgggggtgaggcccgtgaggacggagcccgcgaggaagatgcaggcggcgagatagaggaggggggagagggaggaggaagaaggaagggataagagatgatgacatgtgggacctacatgtcagtgggtcccacacattttttttgtgaatgacaaatgggcccgcatatatattttttatattaatgccacataagcgtcacgtcaatgccgcgtgggacaaacatcaggtcaacactaccacgtgtgcgccaccaagggagtcaaattgcaccggttttgcaagttcgggggtcaagatttctggtattgcgattgagggatacgatttagatgtggacagttgagggagtcaaagtgatcttattcctaaattaaatgtcccccattaacaacacgaaggcccacgagatgcaagacccacacctgtgcaagatccaaaggaaaaagtacaccgaaggtccctcaacttgacatcgagttacaaaaatatcctcaaaccgcaaaaccagatatccggcaccctttaactaatcaaaaccggttactttaggtcctccggtggttttgactccagttttgtccaacgtggcagctgagtcagcgtaggacctacgcgggccccacatgtcaggtgtccacgtcagcacctctctttttcccctcttctctttctctgtttctcctctcgtgccagatctcaccgagaacatggtctgcaccctgggcgcggcgcgttctcgccactggtgagggcactggtgccgctgctctacacgtgcgccgcgtgttcgtcatcgcggactgggtgtacatttgatggcacgaacatcactgagaggatcataaacagcaccaaggaa

SEQ ID NO: 43938 - DNA, 18331 bp, Oryza sativa
cgtatccttggcaaggacaatggcggcttcctcgacaccctcgcctccgtcctccttctgaaggcgatgacatcggcgatgccgccggagcggataggctgccgcccccgacgtcgcagcatccggagccgaacccccttacgctgatatggcgagcgttcctgaagaagcaggtgagccgacgacgaggcatccgcggccgcagccgccgccggcgaggagcaggaggatgacgccgttgcgtccatctcgcggcagcgactggcacgtgagatttgggggagaagaccccgtgatctggcatgctagctgcggccacgccattcgggcggtccggcatcctgccgatgcaggcgctcagccaccggcacaccgtcctccaccgtcatcgtcgccgccgaacccgcggatgctccgggaagccagctacttctcgggctccgtctcgacggctcgccgagacagctcgtctcgtcccttgagcgaaccggtagcagtagcagctacatagccacgacgccaagaaccaccaaatcccctgccgctacgatggagacgaccaccacgacgccgcgtccagcgtctgctccgtggacgctggcccatggccgccgcctcctcgtccaactctttttgctcgaggcggcgcgagctcaagacataggtctccgaccgcctcgcagccaatgacttggtcgagctcgtcggccacctgggggaagctcgcgagaacgaggaaggagagaaacagagaaagagaaagagagagagagggggaggaagagagaggtgctaagtggacacctgacatgtggggcctttgtggggctcaccctgactcagctgccacgtaggacaaaatcggtgtcaaaaccaccagaggatctaaagtgaccggttttgattagttaagggacgccggatatctggttttgcggtttgaggatgtttctgtaactcggtgtcaagttgagggaccttcggtgtactttttccagatccgaatgcgctgcttcagcccgcgagatggacgggccatccacaaactcgaagacctatttcaggcccagtaactcaaacggcccaatacaacttttaacccatcgatcgagtgggctctctccatctcctcctccggcggaggccgcagcctatacacaccgacaccggcgggcagcggcacccacccatacacatgcatggctgcggcgcgcgtgggcctcgtctccgtctccgtctcgcacgcgctccacgcctccagctcttccccctcggggcgcccacctcgcctccgcctccccccttattttccccgccaccaccaccgtctcctccccacctttccccccaactacacgggcccctcctccgccgctgccgcgagactccgcgccagcgccaccatgtcgcaggccgccgggaacccctacgccgctgagctcgccgccgccaagaaggccgtcaccctcgccgcccgcctctgccaggtgccctcttctctttttttttccctctctgcttccccactactttgcgctgtaaggaccagaccatatctcgtcgtcggtctgaataattgctcggcttcagcggggaacaaggccgaatgcgcggactgtaatgtagaccaagactgtgagaacgtgtcgagtactacgattcggcttcagagctggaatggaaatggtggcatagactgtgtgggtagtcaaattagtcatagctgtcataaccaagattaatgttccactagggggaaaaagaaaacaagcttggatgcttgggtgcaggattaatgttccttttgcagtgaatgtttggatgcttggttctgaaggtggaattcatttatgttaatccttgtttttttccactacaggcggtgcaaaaggacattctgcagtctggtgttcagtctaaggcggatcaaagtccggtgacagttgccgattatggtacgatctgttcatctcttcagttgttgccaaggtttcttcctttgatgtttgcaactgaattattgacatgtgtactcatcagaatttggaattcatagagcatctttttcgtactgcatctttgtttgctagggaatgtaaaggactgataggacaattttgctgttcattgttacatggtgcttctgctttatcgcggctcaccattcacctctagttttcttttggttcatgtagggtctcaaatattggtaagccttgtcttgaaaatggaagcaccagcttcttcttccttctctatggtggctgaggaggtaattatcatctgtttctgtttctgcctactggtttcgatggacagcgcacaagtctttcacaattgattgggatatgtactcatgtaggactcggaagaattgaggaaagaaggcgcagaagaaattttagaaaatatcaccgagctcgtaaacgaaactatcgtagatgatggtacatacagcatttacttctctaaggaaggtatcctctctgcaattgacgatggcaagtctgagggaggtccatctgggcgacactgggtgctagatccaattgatgggactaaagggtgagtttgctgacctaaatctctgggttgcagaatatgctgctgcagtcaaaacataaaacatcagttcatccccaccattcactgcacaatcagaactcatgctgcttctttattacagttgtttgtaatgagcatagtgcagtaaatggcactacttttttccccactttgaaagaacagaagcctatcatagtcttctcttattagatgcttctaacttctaagctgcactgaagtggactaattaatatagcatgaccctgaacacacactaggttagttgatactgcatgtttcattttcttttcatctgctaggttgcatgcaacatatataagaggtcataaaattaaaagccatgtaaaaggcatcctgtcaaattagtactcttgtgatgtgcatatctcaaacttctgacccaaattcacattttttttacaacgttactcagtttcttaaggggagaccaatatgctattgccctggctctgcttgatgagggtaaagttgttttgggtgtattggcttgtcccaacctttctttgggatcaataggcaaccttaatggtggctcctcgggagatcaagttggtgctctcttttctgctactattggttgtggagctgaagtagagtctttacagggctctccagcacaaaaggttacatctccttttatttcatattataactttgacttacttttacctatttgagaatggaactaattttttaatctgcttttggttattttcacttccagattagtgtctgttccatcgacaatccagtcgaagcttcattctttgagtcctacgaaggggcacactccttgcgtgatttaacaggctccattgcggaggtttgtcctgaattattctttgcctagtacaggtccacgagagttacttgggtaatctggtgtttgaatgctggcagaaacttggtgtccaagctcctccagttagaattgatagccaagcaaaatacggtgccctagcccgaggtgacggtgccatttacttgcgttttccacacaaaggttacagagagaagatctgggatcatgcagctgggtcaatcgtcgtgacaggtatgaaggttctctttttgaacattgaaaacatagaacccaacaacctgaaaaaaaacatagaacccaactgaaacattttagattgatattctgcttgtgctaaaacgtagaaaccaactgaaacattttagattgatattctgcttgtgctgttttcagaagctggaggtctggtgacagatgcatcaggaaacgatttggatttctccaaagggagatttcttgatctcgacacagggatcatcgcgacgaacaagcagctgatgccttcactcctgaaggctgtgcaagatgccatcaaggagcaaaaccaggctgcttccccgttgtagtagctgtctcaatccacaatccacaaatatcataatgtttccatataataataattgcagtgctgcttccccatcaacattactttaaatgtgtgtacagcaccactttgttgttgttgctgctgcaaattcagtatcttattgttgcacatttctgcatctaattggtgggtgagctggcaccacatgaatgttctttcatctggattcagaagaaataattaaattggcctgattctccctaactcggggcaatattgctatgtgagttccaactactgtggtaggacaaatattttaatagtagcaatgatctcaggttgtgcaaccgatgtcatatactatgtactcatacctaatccactgacgtgattagtttgatatacctaaatcactggacattatcagtttgactccactctcactctgactaaaagcatcacctgctctccaccacgcctcagcttctgccatgtcggagctgccatcgccgccgccgccggccgccggcaaccagtacggagcggagcacgccgccgccaagaaggccgtcgccctcgccgcccgcctctgcaaggttatttctcgtttcttccccttgttatttctttctatgatcagctttgggattgagatggatgaggttttgcattgacttctggtcgtgttagctgtggccattgatctggggttttgtttacctgatcttgagatgaaaatttctgactgaaattgctgcagctgcttggatgtacttacctcttgttttgtgtcttcttgtttcttcagaaagtgcagcaggacctcttgaaattggacgttcaaactaaggctgacagaacaccggtgacagtcgccgattatggtatttgttgatacgattttacgatattcttcatctgttctattataatatatgaatgatttttcaaaataagtaatttttatttcctaaaaaaatggatatattattatgttttgtaacttgtgctagatatgaacttctgaaatagtttacattccattaccaggatcacaggtattggtaagtgtggtcctgaagattgaattaccttctaactccttttccatggtggctgaagaggtaatttacaaatagtatacatttcgccttatttgttcagttatcacacagagaagcatctttttccattacttgttgacttataaaggattctgaagacttgaggaaagatggagctcaagaaatgttgggacatatcaccaaacttgtgaacgaaaccatcataaatgatggttcgtacagcatcacattatctaaggaagatgtgctggtagcaatcgatggtggaaaatctgagggtggaccttctgggcgatattggatattggatccgatagatggaactaaggggtaagtttttatgtatcatgttcgactgctagaaaattaaatgcaagtattttgctgtgattatagatcatcccaaggtacattagccatacctgaattgttagttttagtccaagctgctctagcacaaacacaagtcacagaatccctactttagatgtggatgaacatggtgatatttcagtttttttggtggaaattggtgatttattttactagtacaattaatttggttcccttgacttgacatgtgttctatctcaatcctgtggtccaatccaacttgcttagcattaaaggtggtggttgttattgttggtgttgtataaatgtggacaatgtgtaacaaactaacaacggtacatactaataatttttttcgccgggccggcgaagcacgctggccgagcttgtaccaaggaggggaagaaaaaaaaattacaaactttacaagtgttcagctgaaatgttgaggatgaagcatcctggccattagatcgagatgcgaagcaaccaagccctgtcgtaacaccgaggcagagtgccaggttacctggctcgtcggcacgaccactataccaagaagcttgccacttttagatttggcatttaactatttgccaccgatatgtcaatgacacgtgggtccacatgtgtcgataacatgtgggtccagtggcaaatagttaattgtcacgtgtaaaagtggcaaatggttaaatatctcgaacctggccctgccattttcaagtttcaacgtcgtccactcatcgattgtgcaatgtgcccatcatgcttccttataatactttgtttatttttctcttcaatgcataatagcatcataaagttatacttcatcaaatgtggaaatgaaacaaataatattcatgcattttgaattagtataataaaaggccatgataccacatgtctttaataaattagttgaaatggaagaacactatactcaaacatgttacagccatggtgtataagtgttggtggttctgggagatataatcacaatgcaatacaaacaaactagtaaagtgttaatcgacctagggtctatttttcttgtaagtttgcatatttggcagtaattttcttatttcacctctttaacaaatgattctgaaaacatcaaagatgtgtaaattatactaatttttagaggtatattatgatttcagatactccatattccaattattgataaaaagtagtgtcctgtgcaaaaccttttgttactattggcatgattcactaaggaatttcctttataatcccaacatttgtgttaatgcagtttcataaggggagaccaatatgcaattggacttgcattactggacgaaggcaaagtagttttgggagcaatggcatgcccaaatcttcctttcaaatcaatagatcacaatggtggatcttcgggagatcaagttggtgccctcttttctgctacaattggctgtggatctacagttgagtccttagaaggctctcagccacaaaaggtaatttatcactttctcctgaactatctgtggattagattattcccttctctgaataatattatctttttatttaccatcttgttttctaacttccaattttagatcagtgtctgttctatcagcaatccagtggatgcctcattctttgaatcttatgaaagaaaacactgcatgcgtgattgcacttcctccattgcagaggttggtccccaaaagttgcatacctaatttgtttctgatatgaataatcacacaagtaaatctgattatattatgcttggcagaaacttggtattcaagctcctccagttagaattgatagccaagcaaaatatggtgctgtagcccaaggtgatggcgccatttattggcgatttccacacaaacgttccaaagaagcagtatgggatcatgcagctgggtctattattgtcacaggtatataataactatattcacaaaaaaatgaattcaactaaagtatcgttctgttctcaaataaaataaacattgttcggtaagtttttttttctcatgtttgcagaagctggaggtttggtaaaagatgcttcaggaaacgatttggatttctccaaaggtagatatcttgatcgtgatgctggcattattgcaacaaataaatatttgatgccattagttgtaaaagctgcccaagaggctatgaaggaggaaggaatactaggctgattcactcgtgcatcagatgaaaaaaaatgataattgtgatgctgttttcaatttgtgtgcaatataagtgtttgccctgtgttcttgctgtaccattatctcatatactccttttatatttatgattcatagcaacaatattttttttgtatttgatttataactgttggatcagcattttattgcctgaattattgttgttattatttatcaatgctatgaacctaaattatcaatagttactacaatatggaaacctctggtcacccaatacaactaaatatgcacatcagctgggtagtctgcagggtgcttcttgattgtatccctcagcaatcgctcttgctctcttaggttggaaggaacttcatcataaacatcggtgaatagttcagcgagcggcggtttcggcattctttctgccacctgaatggctttcagaagctgtgaagaattaaaccggcaatttcagatatcatgcatgatgttgaactagacagatatactaccattctgctaaagaaacgttacctcttgcctcacattgttcctgagttcagattcatcttcatcacaccaccagccattcccctgaacccattttctgtacctggaaatcggatctcgcgctgttcgccagtgctcgatctcatcgaccggcctgtatttggttgaatcatcggatgtcgagtgatggccgacccggtaagtcagtgcctgaaagtttaatgttcagtattcacatcaaacctattttatgttgctgtgacttgaaaaattgttcacctcaactaaaattggccttccttccttgatagccatttccctggctgtgtgaactgcactgtacacagcaagagcatcatttccatctactctgatactgcgcattccataagcttgaccacggataacagctccatcacctgcaatagcagtagaattcaagttgttgtacagatcacctgtaaattgtaattgtgatgcatgatcaagaaaaatgtcatacttctgaactgttcactagttggggtgctgattgcccagccattgttgcggcagaagaagatcaccggcgcttccataactgctgcaaagttgagtgcagcatggaagtctccctgaacatttttcatctgtcagaaatgctgggtaacaatgtagtggctgatgcatgatcagtggttgttcatcaatctacctcacttgtgccgccatcgccaaaatacgtgatggcacatgcatctttcttgtccatcttcaaggagtacgcagctccaacagcatgagggagctgtgtactgatgaatcatcaaagaatgatgaacctgcccttggcttgcatgaatttggtgtggacatggaagagatatttcagacttacgcaataggcgatgacaccgtgaaataattcagacggttcgatccatagtgtattggcatctgcctccctttaccataatccagcttattcccaaagcactgatttgcaaattcttgcagtgtgaagccgcgccatagaagaacaccaggttccctgtactgcattcagctccatagtttccagccaagagaatgacagtaagttacttgtcagcaacattgctagcttaatcatccaagttttggagtaactgatatatacctgaggcagtacaatgtcatcaatagtaagtgcagcagcagaggctatattgattgcttcctcaccatgtgaagtgagatagaatgagattcttccctgcctctgagcttcaaagaagattgtatccatgacctggagggtggccatttcattgtacattttcagagccagctccttactgacctgacaagagtgagccacacacacttcagaacggaacacacttcagaacggaaccatcttttacaacatgtttcagaaataactcatggagccttggatgttactaccatacctcttggaatctgcttccagatattgttctgccgtcatcgtcaagaacacggtaacagttgatcctatccctctgagattctggaaggaagttcatttcagcaacaaaggagacctttcctccagggaaatctattgcctgctgtggaaatagttaaaaaaaactgaatttcccatgggaaaaataaatttatctcaacattggccaccaaaaccaaaagtgaattccacttgaagtgaattactattttttagactagaacttgaattgaattattggaaaggctaatcaatatcagtctgacattggtcttgaaggtaatggactaatttatctattaattaatctatcatgataaagtcagcatccttacacgtagaagaccagatgagactcctaatcattgacctcatccattgacaccgaaagcacagcaagtattaaaactaaataatttttgggcaggtgtattaaaactaaataatagtaggattatcacacgtttcctcaatccttgtgagcttaccaaacagaagccaatcacacccaattcattgacgcaaccacacgtcactccatccttatctgattggttcatcacttgttatcaattcaattcacaattgttctgtgcttacttttctttcaaccaaatttctcttcctttcatgaaaactcaggggaggaattgacggcttggccgttactttgcagcccagggagtaagcacagagatgctgtgaaagaaaatgacaaatggtgtcctaccaaaccgaaaaagtaagaaagaaaccattttctcttgttatgtaataaacccatttttattaagataaatggattagttcattccaacctttgcttttagagacggcatgaattgattactactctctccgtcccaaaatatatctccgtgtagctatgaacatagataaacttttgtccagattcatagttgaaagtgaccttgtgccatatacatagctaaaggtgattgtattttaggatgagagagtccctaataaacttttgaaggagcatagttctatagaatatgccctgtttagatcccaccccaaaactttacacccggttacatggaacgtttggacacttatatgaagtattaaatatagtcttaataaaataactaattgcacagattgcgactaatttgcgagacgaatcttttaagcctaatttctccatgatttgacaatgtggtgctacagtaaacatgtgctaatgacggattaattaggcttaataaatttatctcgcgatttactaacagattctgtaattagtttttttattagtgcccgaacacccaatgcgacacccatataatatccggtgtgacacgccaaaactttgtactcctgaatctaaacaccccctatgttattttcatctagagttcaggatatgatccttgcagaatccagatcccaaaaggacatcaatttggcttaaaactatcgaagaataattgtatatgattcagagtttcagacacaagattattctgaacattcgtacgagcagtggcatactaagaatgggtgaaggacagtaaggcacgtgtgctgtctacatacctgatcaccaccggccaccaacccgttctccgcctcctcgacggcggcggcggcgttgctctccccggtgaaacgccggacggagcagaatccccgacgatctcccgccgccgccgcagccaccggagacggcgcaagaaccggcggcgccgagcccaggagccagggacaggcgggcgcggcgcagtgacggcgatgctgagacgaaagcagcctcctcgccgcgcggcgcgcgagctgggacgacgccatcgccgccgcacgccatggcgccatcagacgacgacgaagctgcgcctccaacctcacctatagaacccaagaaatcctctggaaatggcgctcgctgccaagaacaagaagtgacaatgcccagctacgagttaccaacctcttataggtgtccgtgttggaattggatagagatgagatgagatgagatgacatctgcattcatcagccggaagatgggggaggaagaagacgaggagagcaagaaaaggccggagacgacgcgaacgcgagagtgagttggaaagataagggcttgtttacatccagcgtcaaaattttacacatgtcacatcgaacgtttgaacactaatataaaatattaaatataggctaaaacataactaattatatatatatatattgcatctaatttatgagacgaatcttttaaacctaattactccataatttaataatgtggtgctagagtgaacattttctaatgatggattaattagttttaataaattcacctcgtggttaactgacggattctataattaataatttttattagtaaccgaacaccaaacattctataatattcgatgtgacacggtaaaattttacattatggatctaaaacatccccaagtgcgcgagctagctttagtccagctagtagctaaaggcagctgagctgagacggcatgggagagattggaggaggagcagacgggcacggctcactggagaagagaggataacagtggagaggagtggggcccacacgtcggtgacagtggacgggagaggctgacgtgtgggcccggataatgggcgcgaggaccacgtgggggtaggaaagagataggtgacaaatgtcgcctgcttggtagtacgacgatgatgcaagtgacaatggacggacggagaaaggcttggaactttggaaggagacattggttcacttcgcacacaggtagtttctgggtggatgacaaaattccgaagaaattcggatttcgtggaattcaaaactatttcaaataaaaggtctattcacttgaaataggtgctcgtatttatgctaattattatttcagtgatagacaacatacatattaacagcgagacattcgtgatgacttcatcaatcacaaggaatgccggcttagttttccggaggtgtttatagaggtaggatgtgtgtgtgcgcgttcacagggtgaatacgcgggcgttatgagctcttgtgattgtactgcgtttctcagaaaggtctcttcaccattttattatttttcttttgagacgaatccacccagggccatcttaagatttattttgggaaccaggagagattatagtatattatgaaaggtctttgaatcttaagaaataattcaaaggcatccaataagttgacaatttccagaaaaaaaatccaaaactacatgcagttaatgaaaaatcatcgtattctcatagaaatggctatatactctcgggattcgacagaacacctataatcaataaaaagacgcataactccatagcaaattctatactaatataaaaagaaattgtcaccttctaattctacaggccaaatcacttggatgaatccctactgtccatccacgcgatttcattcaccaccgcacgatttcgttcccaccgcaggatgcgaagacttcgctcctccacgcgcgcagacttcgctcgcttctcctcctcctccccatgtgtactgaagccacatcctcgcaggagctctgtcgccgctccgccgcatcctcgccggagacgccgccgccggatcctgcttcttctccaccgccgccgccgccacctcctccttcttccccaccgccgcggccggcctcttccccatcggccgcggccggagccgacgtcctccccatctgccgctgccgcagtccctgtcgccatcgtcgacgttgtctccgctgcctcgctccgctgcccatctcctgtcatgctgctgtacttgaccaatgtgcctataccctaggtgctgaacaataggagggaatctcaacatcgttgagacgtacaggtaatcagactctatcttgcagcttcgattcatcattcaattatacaatttgatggtctttctttgttgactgccaaacaattccccttcagctcactgccatcctcctctccctctgctgtgtggtttgtgtaaagcatcaccattctatacatcactgtgttcattatgagcttggctatgcaatatatggattggccattcaaatatcaatgtttttgttcttggatttgcaatgcttacgaaattactctctgaaattgtgcttgcaatgggccttgtattattttccccacgatgtgggtagtatggatttttttttctgtttgtcctccatatatgtcagctctaaaaatggacagtatgaacttaatttagtagttcaggcaatagaatatgagatcttttacggtgtttgcgaggtatttagaggtggaataatgtgcaccgttgatcaagagaggggcaaggtacggaacaaaattattgtaacatgatggcatttgagtaattaactagtaaaacataggcaatacatttgaattgaatacctccttccattggtcggtgtatcgtagtagctattggtatcgttgtagagaaaaaagtaaatcaaggatactccgttgatttagggattgattcgattatatcaaaaagtaaatcgtgtctcctttcttctctccctttggtttgttcgtgctctagggtttgaaccagttcatctccgacgttgtggccagcagcggagccacctctgctgccacctaaagttcctcccatcacccacaccggtgccggtgcggcagtgcaacctgcgtctctcccatcactagtgccagtgaaggcccgtacgttgccatcttcctcttccccaggttggacatggcgctaacgaccagattaatggcactcaccggcttgccgctagacatggacatggagaccaaatctgcgagtgcaattcacgcatgtgctatagatctacggaaaggtcctctctttgcaactccatctgcttcgttggtcttgcgagaactagttcatgagcaagcaaatgacctaaatgatgatgacatggatactactgaagctgggattggtgatgaaaatgaggctttcatagatgacaaaaatgaaaattatatggatttcgagtacatttgtcaccaattgctagcccaaggccaaaaacatgttataagaacacaatgtaaatctaaagaaaatcacgtaaaagagaacatcaaacaatacaaagtaaatctagagaaaatgaattaagaacctgttacgctagtgccgtgtaaatgacctaactcgaacacagcgtaaatctacaggaaaaccacgcaaaagtgacacaaataagaacatgtaacgctggtaccaggtagatgttaactcgtacagtcgtacctacttagtacctattataatttgggggaggggacaattttaccctttttgctctattaacaaaattatatttttatccttagtacctaagtatatatactaatacttaaataccttttacatagtatctgtgattgagaactgttggatctttaccctttttggaatgcaaacaccgtaaaagttctcatagaatatactaacagactgcctatgttttgatttccatttgtcttaacgtttttagtttcagcagtgcaaggttataattgcttcatggttctcctctctttgtttttagcaaaattaatatgaactgcacatacatcactgtgctcatattccatacagattcaggcgtgatgatatactgttgtgcaggaagaagcttcacaatttcacacaagggatttagttggtagcagctcacacactccctttgagcaaatattgttttcaggtacttatctcatttaacttaataagttgcttgattattgggacttgggagcaactcacacactcccttcgagcaaatattgttttcaggtataatactatcgatgattcttttattctacaagaaatgtgaattatggaccattatactaccttggtaaatatttttgttccagtttgaagctgaaaaacttgtttccggttgttctgattaacgtggttcaaattgattcttagaaaatgaaaagtcttcaataggtcctgttattctgtaacatgtaggttctaattgatgcttagaaaatgaaaagtcttcaataggtcctgttattctgtaacatgtaggttctaattgatgcttagaaaatgtggatttgggattttgttatagcgagcggactgtcatcaatattaacgaaaacctgttgcatattaaaactgcttttatatgctcatggtgtgttcttcaaggttgtacatccttgcgatggacggccttcctaaactaactgcaaaggaattaaaaagtcagcgagcccgagagcggtacacggcactcagcgttgaggagaaggctgcgctggttcaaaggaaccgtgaaaacagggagaggaagaattctgcatctacatcgggcacaggtgatgatattttcattcgatgcttattatggtcaagcttattttatggcaaacaatgctaaaacctgggcacattcaattggattgtagttttgaatcagagtttgcatgaaggaagccaaactgtaaattgtcagccatcatttcagcctgtgccatcctccacacctatgtcttcctccacacctggtaatatcccgtggaatcaatttgtaatatcaaattactctttgcgttttttgggggttcaatctaattgtgtatttcaagaagtgttcatcagtggaaggtttgttatcaacactgtaaaacaggaaagctgtttactcccaatccgtcccccctattaagctagccccaatcccactacttcagcacagtacatcgccactgcatttcttctcatctttcctcttccatagatcattagtaaggtctctcttctgagaatcagctatgacttttgctgaagttttcagtctgcctaatggcgcaattgttggtatggtatatcgaaccacaagtgtattttgtgtttgttcttttcttgctgaaactaactctgaaacatgtttacatttgtacaaatgttgctgccgttgtgtgtgatgtcgatcctgtagaccattatgcaaattttccaaacagtgttagaaaggtcgctttgatggattccaagtaagtcaattccaatttatttttgagtgcaattctaaaactaatattgattaggacactgttatttctgttgttctagcatattttgtttgtaatctttgttctaatggatgcagaggtgagaaactccctgttcaaagaaccagtcctgcatgacgccattaagattggtgtgaactttaggaaccaagagctactgcaaccggcagaacaaaataatgctccaggagaaccagaagtggtgatagttgaagatgatgaagtggtgattgagccattgccaaaaaagaagcgcactggcgacaagggataaactatccctccaggagttgaagtcattggtataccctccaccccttaggcataataataataggacaaaatgtgcacaactcaataattttaagatattgcccctaaataatgtgcaccgatatcatagtatggattttggtttatgctatgtagtgtttgctgttatgaaatataattagtgtcagtggccacttcaatttcaataatttattgtgctatgtatcttcttcctttgagatatcaatctaatgttcttccgttgttttctcagacattacctctgcacattggcttatgcatacctctgcacattggctgaagatcatatttatttttgagcaaattcttgtatctaatatgaaaatcagaatgcatatatgcatgcactttatgaaaattgtgcagtttgtgcataagtcagcagggaatagttagagcttcaagtgtgattgaagcagatcctctttctcatgatctatttcctttttacctattcttctttcagaatattgggttataatatattgggtttaatttatatattgaacataacgtgtcttgcacgtgcatgattactaatagtaaaataaggatgaagcctcctccggcttaagaggaagctagcgaatccagtaacacgaagaagcaagtgcctccagccaaagtcacatgagcggataagccacactagtaatttgtttagagtttatcttgctagtatgttggatttaggattgtgacataaccatccctcggagtttatcttatgaatgctatatcttgtggatatgtagtgttattaagcatcccttgcttgatccttcatccatctaattcactattgacactcacgggttttgcgcgcgagtgcatgatgtgtcaatagcgaattggactttccttattcatttccgataataagaaagatgtggatgtgatgtgacaatcaggattagcaacatgaaaagggaagatagcaattatgaaagttgtgcagacagtcgtttctatagtcgacagtgacaggatcatagcaaagtaggtggaagttccacccgttttgcccagaattgaagagcttgcaaatggattgtatcgatgactttgtattcctgttacatgcatgtactcgctgaatggtacttacactaacataaatctttggagcttcagtttggtccaacttgtacctgacaatccacagtacaagtacgtgtgaatcacatcccagacaacctctaacaacctctcaagagataagatcagaagagaagtcttggagcaaatgccttaatgtaggattcaatgagtttttaggtactgaagaatgatctg

SEQ ID NO: 43939 - DNA, 20630 bp, Oryza sativa
  unsure (1)..(20630): unsure at all n locations
cagcagcctgaaaccatgatgatcctatgagattgatagcttcagtcaagagtacattgtaacataataaagatgagcggattcatacctcgagcatgggactgtcttttggaatgttgcatgctagaactatgttcaaacctgtcttcagcactgacaaatgacatgtatataagctttctgtttttcaatatacaactaagaacgtaggccaattgttaacagaaatagtacctaagcgacgggccatgcctgaaccagtgttatcagatgttcctcctagtacagaggtgacactcactccattaccctgcaatgaccatgaagaggtaacatgggagaaatattagtttctgcaatagttatacctcaaatcataagaacacaattactctctaatttttaccggacgagtacttgcagcagcgtatagatggccaaactttgctgtgttgcatccaacccaagcatagatctaaaattaaaaagaaaattcccatatctcaaaatatatatgttgcaaatgttaggaacacagtacacaacaatggcagcagagagagcataacgtgttgcaacaagcatgaggagattcaaacaaaatgatcatcaaaattatacctaaattagatagcactaggccatggttactatcaaaaacattgtacggtgtttccttatataactagcaacggagagcacaagctatgttgaagtgttatttagagatattgaattagtagcataagcatttctttatcatattcatggtgtaaaaaccatctagagcaagcttaaatcgcctgggaaacatgcttaaaagagcatgcttcatgtcctgagttctgccatacaaataaggtaatataaacatactcaaatgtatgctatttccatataatgccattaactacatcagttaaagagtcagctatgcattgatgagtaacattttgatgattaataccaaagccaggaattgagggagctaaccatcagttaaagaaaattcatgttctcaaaacagatatgttgcagatattaggaacatggtacacaataaaggcagcacaaagagcataatatattgcaagcaagtacaacgagaatcaaacaacatgaacattgaaagcttaaatcacatggaaaacaagcttaaaagagcatgcttcatgttctgacatacatgtacaactaagataatgtaaacatattcaatatttacggtattttcatataacgcacatcaacttgtgcaattaagacttaagagtcagatatgcatcacttgactaacattttgctgcaatgccaaagccaggaattggaggagcaaaccaaaaaaaaaaaaaaaagaacatctttattgatcaattatcagcatctctttaatcaattatcacaagcacaactcagatgaactgatcttttttatggagaacttgatccaaacaacatctgaaaactctagaaaaagttgttacctagaacaatttatattttggaattacataacttggaaccaggaaaccatgtttacctgcttagagaaccttattatctgaaaatggaggataacatcatgcaggtcctcagtgaagcaagtaacctgcacacctccctcagatgatggatcacctgaagattcaacttggctgtctgtccgagatgaagaacccaccactaaatctgaaaagcttgttctcagttcctctgaagccataatgtgactctagccctgagataagatcagcacatttgcttagagaagcagacaacatggtctccacaacaaaaattggaaaatgttgtagcagcagtttgcagtgagatggcaactacaagatccatccatgggtgagagataatgaaaatgaagaggtaaagtcatcagattggggtagaatttacaaagcagagcatgatatttacagaaaccttcatagacatgcggctgcttgaattataaacttaaaatttcacactataataaatcataaaaggactaaacatagcaggcccaccagagctcagcccacacatcattgccaccaagaattcagcttccggtgatgtggctgttcattcggtagatatgtttttattgataaatacagtattacttagaaaacaattgagtatgagtagacaccaaatcatttcagtagttaaagagaactatggaaaaaatatggtgactgaacatagacaaacaagttaaggattaattatggagtgtagatgaacagtaagatttgtggccactaataatcagcctagctgatgactaccgagactgcagctacagcctacagcagggaacatgccaacaaggatcatatttaatagttcaaattttattcggacacagtactacaaattacagtaccaatcagaattatccatctaatctattgcacattttgaaactgagttgctccaagattccagttcacacagcaaacccaagttgtaaagatctgttcaacctattcagatgcatcaatgaccaatacatggcgcatgtgtgacataccaaacaccatgaactcatcgtaaacaactgcagctcccatgaacaaggatcaactaaaaaaaaatacactaaatgctactaccacatgatgagtaagggttacttcccaaggatcaactgaagaacactaaatgctccatgcgggttacctcccgaacccacctcggaagttggcaaggatggaaggatggaggatcgccggatcgacagcgacgggggaaaccgccggaccggggtggccggcgcctgcctcctcccgcttagaggctggagcagcggggagacagcgcggggcagagtgactgcaggggaggcggcggcgctgcgcggcggccggcggcgaggcgcgtcacgggaggggaagggggcggcggcggcgagagcgtgtggactccccggagaaggaaaatcgagaggggactgcttcgctcaggcaggaatgggctgggccaacagtgggccgtcgccttcttatgggccaaaatctctttttcttttcccactactgatcacattttccaaaaaaaaaaaacgagaccaaaaatctagtttcttctctctatttatcaaacacttttcgactaaatcaacagtcaaaatcacatgtttatggggttggaacatttttttttgcaatgaaaacaaagcaatatccttataattgaaaaaaaaaaagtacttttagcacaaatactctataatatgaaacaagagaattatactaaggttaaggatacaaacacatgtagtcagaaaaaaaaaagatcaaactaaaaattgtgtggtgggtttatactaaaggtgtagcctttttgtattatgcaattttagactaaacgttatacaaattaaggtgactaataaatatggggaaaaaaatgtcagcttttgtattataaaacaaaatgctgatagctcgacaggttccactggacactaactggagtagaaagatgcaagtaatcgcagtagtactggtattaatctacacaactggtattgaactattgacaagcttgcgatcgaatgtatctgattcacagcaactaagatgtaaatgactatgccgtgcttttccgatgtacaatgctacactggaaagtgcaaaagctaacaagacatgaatatgatcttgagttgttgaccagcatcagcaagcagtttcagcagccaagtatagatactgttgcaatcttctgggcgccgcgcttagagcgagtggaggtgcttggccttgtcgatggcctccctgatcttccgcgtgggctcctcgtagagcatcgccgggtcgtcgaaccgcgcggcgaggctgggctcgccgaggaacgcacggaaggtgtcggccactgagctggacagcgactccaggttgtagccgccctccaggaagaagacgcaccgcccgccgcacagctccgccgccacctcccggatcctcgccgccagcatgtagaacgtccccgtcgtgaactgcagccccgccagcgggtccagcgcgtgcgcgtcgtacctgcaaaaacaacatgatggatgttagtaatcacttcttttctgcttctatagcttggtgaattgtttggcagcatcaagattcaggtgatgtgtttctatgcacaaacaatgcaggatcatgtcaacttatttcagcatgtttagcgtggttctgttaggattggtgatttggaggcgtcaagattcagaagctatgcacagaaattcattcgggatcatgtcgatatcttttcggtatggttttttgattcaggatctttggttcttttcggcttggtgaaataattggcagcattaagattcagaagctatgtacaaaaattcattcaggatcatgtgaacctgtttcagcatggttctattctgaaagatgaaatgtgggaggaatgaacctacccggctgaaacgaggatgatgtcaggtttgaaccgctgggcagctggggcaataacctcatcaaacgcgcacctcatcgcgtaatcgcctgagccaccgggtagtggcaggttgagcgtcgtgccctcgccgttgccctggccaacttggtggatcttaccggtgccaggatagcttccaagctacatacaccaattcattgtaatgttgttgcaagcccagattatttttcctgcactagatttgtaaggtgacaagttttaaagatgaggtaacaaacctgatgagttgagaggaagaatatgtccggatcctcataaaaggcgtcacatgtgccgttaccgtggtgaacatcaaaatctattatcatgacccgctttaaaccatgttgattctgagcataccgagctgccactgcaatgttcccaaagacacagaagcccatgggaccttcaggaacagcatgatgtcctggtggccttactaaggcaaagccgagcggtggcttcgggcccaactttgatgctgcaacctaggaaaacatagaacatttctcgggaaatgggcactgcaaaggaaaatatactgaaccataaaatacaagcaagaaaagtaaagaagataaaacatcaactgagaaaaaactcgttaccactgaatcaaccaatgtaattccagcaccagcagaaaggagacattcttggaaagtctgtgaagaaaaataaattatttaaagagaggcgatatgtaaactctcataattcgagttctagtattttccatcgacaaaagaagtaaagatggaagcattcttgagtagtaatccaaatacacatatggtggaagtattttgttataaagagatctggttatctggtacacaatatgaactatggtttgccctaatgtgagttttagcctgcagtagaaggtattagaataactgagttgccaagtgtagaagccctgcagctgttcctataaaattggatgaaccacttgaactaattgtttttgccattcatctcatgagtccctgaataatttgaggaatgaattttattccattttataaagggctttctggggttttacttgatttgatacaaatgaaattagtgcagtaactagtcagtccaggcccattgatcaacatatgaatggtagaaaactagaaatagaagatttaatgatatagctgctgacagactggcaagtgcatcgatgaaataataatgcgcagaagactgtactcaataaccttccaacgagaaaagcattgggggaataaaaacaagagggaatgtgcatagatcattacagtctgggtagcatatgtaggtccagttccttcaatgaatatcaaaccttcatctgaagccctactcatagcctgcaaaaatgaccactctaaacaaaccgttcaaccaaatattatgtaaagaacagctgcataatccaaaaatctgagtggtgcatttttcgaagaaaaatatttcaatccttttatcagtagagaaaaggtaacgtagataagaagcagctgctccattctgttctatccaaaacatgtcaataccaaaaataataccactgtgatgaaaataccttttcaagtccagttatgtatgatcttgaatgaactagtgcaatatcatcaagtgaagcaggttggaaatcttgaatttcaagaacctgtgaaccacgatgctggacacaaaacaaataagatgttatctaagcacggagtaaaacacttatttttcatatgtgaacattttgaatgtccaattcaagagaaacagaaagcatttcttttgtccttttttttaatatgtttatctattggtagttctgtacgcttcagcctagaatgaaagaacatgttttcttaactgatgtgcagtcattttagaaggtacagacagtaaggcctcagttatatagaacattttaaaacttacgaaagggcagtgttattttacttatatataccttcgaagtaagctccagtttttcgagagcatcaactattgcaggaactcttttgttagtttctggatgcgcttcctgcataccagtggataatagcacaatagtgatattgattagatgaggcatcttagcatatcatgactttgcggagcactttctctttcaagcctagtattttgcacacaaaagcatataattatacagtaagatggtaacggaatgtagtctacactaaaaataaagaatgcagagaaattacagttgtaagacagtaacaattatataggatgcactttctaatcagtactaagttatcagttataaacatttaagtgaagtttggatgcttaagttgctgaatgcagagaagctcatcacacttgaaaaccatatctgaaagctgctctaaattaaagcattgaaatgagcttaccttgttatgacccatggcaggagatgtacaatagagaatatgagcatcacgaagcaaattgtcaggcaaagctaagtcttttcgaacaccatttgtgtctgaaatagaagttccattatggcttggtaagcagtatgcaatccaacacccattatgcttctgttttcttccagtaatttgtaagcttctccaggttaagggatgatgacttccaaagccacagtagtgcctgagcataggcaatatccttcctaaaataaaaagagtcagtgcccaaaatatgttaaacacaaattatacctactgcatttattgagtaaaagcagattagataaatcagtaacacatgagcatagagcagtaaaatacctaaactaagtggaacaaaaatattataccctgaaacaagaaaaaaggactttctgcaacaattatgttatgtcaaaaatagtagattgagaaggaaaccaattcagaaatactgacaaaatggcatttgttctattattaaaatggtccgtgctcattaaggaaaattaaatgaaactaaaaggacagaatcattatagtggtagccaaggacatactcaaatcacttttgcaagtaaaatgtcaataagcaacttatgcaatcagagcaataaagcatgagaactcttttaggctgcaatagcgacgacataagattgtgaatccaccacctaagtttgagtgtaatttcaacctcaaatttcacgtttgtgggaaataagccatatcttgtcttatctaaaaaaacaagatattgttcaaaccatttgtttactgtaatatgtttggcccaaaagactaatcaaacaacataacccactggaatctagtttatatgagtgtgggactaatcataagcaagtggaatgctgactgcaaacaaagtgacgaattacgatgccacaaaacgaaaccaaggcatctctcaagtagatacacacataccaccttggcagttggcgatttctttcgttcgagcaattcagtaaatgtgcatgtacgtccctgacctatatccatgcataccgtactgattaacttggattagtcgattgttcaaataaagaaggaaaaaagaagtcattcagtgcacctaggcatttccacaaacagatggtggacacggctgaaatctaataaagacaccattggcagctcaagaaatatgaatcggcaagtgatgtacccaagaacgaggtagtttcacctacctccaagaatcggaagcgatggcacccacagctgttccatcccctcctgcaaacctccagggatctatctctctctcccttcctcactgaatcccctctcctctaccacctctttgcttggttctttcctcttaatcggaaaaagaaaatacaaaacaagggaaattatctcttcaacgagtagcttggtccatgaaacaccacaggatttcacccccaagctttcgctatcttctcgtgttcttttctagcgaaaacaacggcattttttcccttttttttttgagaggcgcaaaattctccaaatgagcagccactacattgggccggatcggtcatcccaagcccactgcggcccatatggaccgattggagaaatgggccgaatcatccggcccgtttgcgacgaatccctcctcttctagaaggaaagaagccgacgccgccatgggcgtcctcttcttgttggctcgccgcgtgcgtgtcaactccgagacgcaactttgatccgagcggcggcggcggcggcggcgggaggaggaggagatggcgcagcagagcaaggagccgtgcaagaaggaggcgtgcgacatccaggcctgcctctccaagaacatgttcgattccaagaagtacgtacgcggcagtgtcctccatctccaagcttttcttctttttagttcttttagtccattctgatgattgcaatgcgatattgttggatacctctcgatttcttggatgcggctgtaaggaatttgatgaggtcttgggatatttaggtgggttgccgacgcattgactaggttttgtgggggactggaagaggcatggggaatcatcggattagggcttagtggctatctcgatctaatgttaggtttatggattcctagtatttaccagctgccaggacagtgtcagggcgcaggagttgggctttgttgttggggaagttgtgggtgatgcttatgggtggtggtcgtggcagcaagatgatgcttgcttccaggtgtttggtgaagcaagctgatttagttggtccgcttgttcaatcatgcgataagtttctgttattctgaatatatccagcaagatgatacagtattatttctgaatatatccagcatgtggccctgtgtgccttcaggaaatgagttactgttactctgttagtcagtttcataggtgcccggatgggctagcctttcaatcttaaactgctaatctgtcgcaatttgagcatgaatcggggcttttctcctgtttactgttcacggatgtgaattccataatattgtttattggattgaaatacattagaattgtctgtgaaattcaccgttagttattcatgactagcaatcttggatgctaatagcatctatctgtcataaagaaatttctagtctaggatggatgttaaaatcttgtgtttcctctattggaccttgctgttatattttaatacacatattacacatgctgttgattgatatgtacaaagagtacattagcatcaatttatcataatttcccctgctttaatttttattgtggtgtgattcctttcattatcgtgttcactacatatatggataaagcattgggtttttgtcattgtttatgaccatacaactggaacctttggctttttaccattttgctatactataccaaacattaatccgttgctaggaacctagaacaatagcaatgaactatttactgtttttattgtctaaagttgattggagttagtatgattgaacatttaaacggtgctgcaaggtaatattgtgtgtatgattttagaatcaccttactgtgtaagttaatgggatatatatgactcagcttgttatttatgcttgtttctttcccagatgtgtgagagttatccaattacttcaatcctgctgtgagcagtgcgagtacaaatcaacacactgcggttctttgactggattattgaaaaacatttccaagtgatgaaacaatacagacatgtttctctgcagctgtcaaataaaagtatgctttatttctgttcttaccatattgtttttataaactgtagttggttccacttggtcagattgggaaggcagatcaacctcatactagcattgacttttcttttgatactggacaagcattatctcaaccatgccatacactccactaactgctctatacaaaacgctgtgctaattttcgttacccatatagttatttttgccatttatatattgagtgcaattgtattttagttgacagataattttcttttacaggttcttttaggtttgcttaggattgagagtgataaccgagtttcttatgcatcatggtacagtacagactatacttccatttagcttttttattgtgtcctttttacctgaacctatctattgagttccatttgattctattatgatgagagtcacatgctcctctgtttgattagctgaattattatttttttccaacataccagatgactcagggggaagtaacaaacccgtcctcagcctgaagaagatgaatggtgttcttatggctgagttgttttgtgcttaatcggtcaacagatagacgctactttaagatagataccagtacccctaattccttgtatatgtggtgcccttcatactacatgctcttgtagacatgtgatctcatgttcccttcaaagtataataagtgttcacctggaatttcattaatgcacattatgatggtgtaagttttttcagtgcgctgttttttatccttacaatatcttctacagtaataaagttaagtttaggcgaacatcatacataaagaaggtttaaaataaaacagttagtttttttctcgacctgcctttcaatcatctcaaaaaattatcctgttaagattgtttttgttagataactgttaagattgttaggtatgctgtcaagaagataatctgtgaaattatatgaacttgtgaagtcacaatcccattgcttagcatttatggctagtttcaggtcatttgtaagtactctagttgagggattgaagtattctgccatgttatctactgtgtattgcataaccaacaaccatatcttctgaaagtgtgctcttttatcttttgtgatgctacctaccaagtgagtgcagattggtatgcaatgacatcaagctgacatgtacactacattctgtacaacaactaattcttgctgtctacttgggaccaaccagtttgttggtatgtcttcacatggccgttccttaatttgctgctaatcttggatagatgccacagtgataatgtagtcaagcattatatatgcacaagagggccatgtatgcatattcagactatcacctgtaacaataaagatcttattcgttaaagctgcttcttttttcttttacaacaaattagcgacatctaaacggctgaaagctaaagttatcccctcttttgttcacttttacttgaccaaatcgattgcattaaacacattttgacgactattgttttatcatagtttgaaatgatactgttgatgtttaccgttgttaagtctgacgagcaatgtgaggttttaaagtttgcacggtgcattcaacggggtcaagtaaatttactgaaggagggaaagtgtgttttatacttttatttctttaaagttgtctgaacttcttttactcgaggaaagctagaactaaagtaagcaccaagatttttttaccttgcctttccaaaatcaaaagcctcctttagtaatagatgtagttttcaagtgaagtcatgaatgcatttcaactatgtgattatgataacccatttaaacatgccaattttctttaatatggattggccactttgatcatcaattttgccatgatttctgtaacttgtagtgtgcaatcatgcatttatgtgtgaactttaagctttaggaccagtattcgccggagtggtggtcgatgaagtaagtgtcttgcttaccattgacagaataacttgtggttccaacgctgcatctttgaagttgacatggcagttttacccgaaagaatcaacaaaagaggcacaatgaactagatcatcatgcgtagtcctgagaatcaacaaaagattcagacaagaaacccaatgggttccttcatttcagtatgttcttcggcagctaaaatcaagtagtatcaaacagacgccaaatccaatggcattacaaaaaagacgagcgggatcagagagtatcagaccctgaacattcatcagacaaacaaaagagacaaaaccctgaaggcctgaacattcatcagaaaatcaaaagtagagaagaagaagaagaaaaaagaaaagaatcatagccattaactatgagtcaaactctggattctggtaggatgaaaaatgtatagatcgatcgatatatacacctggtatatcatgcatgcaatcatctactgcttcttctgactgtcaatcagaattttcagattggtggtgcctttcttgatgcagcattggatttgtgagccaagaagagctttttgagcagcttcagcatcatcagcaagctcagccgcctccgccggaccacgctgccggaggccaccgccgccgccgcggcggcatggcggcgcatttcgggggtgccgtcgccggcgagccacgcctccttggtccactccttgctcagcgggcacggcgccgccgccgccgcccgggagagctcctcgttgaagtcctcccacagcatgtccatcgtcttggtctcctcgccgccggcgaacctcgccgagacattgccgcagccgccgtcgtcgtagcaatagtaccagccgcctctcaccgtgccttcttcctcccccttctcgacggccgagaagctcctccggtgatcgtacaccaccgcgtcgacgacaacgccgccgccaaaccacggcggcggggtggcgaagtgaggggagaaaggcggcttcttgccggcgttgcatcgctccggtgcgacgctggggaacgtgaactcctccatggccgcaaagctgaaaccttgcattgctctctctctctctctactctgaactctaaagtctgaactatcaaatggaagcctctatctgtcttcttttttctacctcaagaaatggctagagagagaaagggagaggaggaagagagagaaggtgatatggttttcttaagctcccaagctcaagtgatggttggcaaatggaagtattattatacaacaatatttgtggtggttggtaagatgctttgggtgattagattggtccatcagagagatgccaagcaggaaagcactaagaggcaggacctaataacattattaatgtttaattaaaaggtcattatatacagctaaagtccaagggctaaagcttactcccatatcaaatggaatgacctcctaaacagtgtccagttcagacataacagagcccaatagtttaatgttctagaaagagatagccttaatagtttaaggtgtaacttctggtgttaaggaatataaagatgcaattctgaaccaatcaatcagtagtagcattcagcaaggcaaatgtaaacaattgattagctgttgtaatgttttgtatggtgattatattcaaaagcaaagtcaagctgtgagttgttttgaatggttttggagggaggatggaagagcatagaagcatcaagcagcagacaggcagtgcttttgcagcctgtgcctttctgctaaagaacagtttctgaaaaatgttgcttgcaaattcaagaactcatctctccctttcttcctctactttttttttgcaaaagaaagagtaaagacggctgcagtggccttgtcagcatatgaggtggcagtagctttcagtgctgggggttgccacctgttagccgttggtccagactattcaaaaatgtcaatgtgaaactaccatatactcaaatttagttaaggggtgaaaagtttttacgtctcacatcggatatacggacacacatttaaagtattaaacgtagactaataacaaaacaaattacagatttcgtctgtaaactgcgagacaaatttattaagcctaactaatctgtcattagtaaatgtttactgtagcacaatattgtcaaatcataaagcaattaaacttaaaagattcattttgcaatttacaccaaatctatgtaattaattttttctatatttaatatttcatgtatgtgtccaaacattcgatgtgacagaatgaaatcgacagacaaaaaaaaggaaagtgttttaaataagcaatatgaaacttaatctagtccttgtcaactactggagtactatagtaacacatgtagtggacttgctgttggctggtttggctcaacgtactccgttgaaagcgagatttcagtaccgttgtgcttcgtctggctgtttgttaggtgcagtgtttttttctctttcggagcttagtgtttagaagttcaaaatgtgttggctcttgagttgagcgagcaactgagcatatatcgtttcttgcatttgtctgaagctagagagctgtctcgatctgatctttctgtaaatcaactttgcgcagaggttgtctgatcaatctatagagcttcctctgcagattacagtactagtacgtactagtgtcagatactctttctgttttataattcttgacacggttattaataatattaaaaatatttagtgtaaaggcaacatctatagatttatttcatgtcctacttcctctgtttcatattataagactttctagcattatccacatttatataaatgttaatgaatctaggtgtatatatatatatatatatatatatatataacctgaaacggagataatataatatatatttattatataatagaaaaaatatggtcaaaatatattttggatattgtatcattgtttaaagtataacaaattatgaaacaggagagagtaagagataacaccaaccaaatcagacagacaaatccatccaactggtaatcaaccaaccaaatcgttggcgaagaactgtgacagagaaaaactggctgggccttttcggcccagaatgcacgttcgacgtagcccaattccggccccaacatttatgggccgaacgttacgacccgatccgggccaacatttatgggccgcacgtactctgcactaccttttccggcccaatatacagtgtggccgctcgtaagccgctgtatagttttggcccactatgtatggcctgggccgcacttacgccactacatatgggccgcaacctttccgggcccaaaattcatggcccatttcactcctgcctcgtcttcccctcttcctctttgtactggcggactcgagggcggccgggagctcgccgtcgccgtcgccgcggcggcggtggcggttagcacgcggcagattcgaggctgaggcgacgaactccggcggcccccagccccccacggcggatgcagtgtaggagcacgtatcaagtttggaggagttgcaggcttgcagtttcttcgaggaggttagtcaattcgatatttcgatcccttgccaccattgttggttcctaggtttctttattacccttgtttgattctgaaatctgaattcaagaagggctggacggaatttcatagttactataaaaatagtcttagtctgaatcacatgggaatgcaaatcggctgtaattcgcgttttcatattgcattggctgagtctaaaactgaaattattttgatcggttagtagtaagtgtccgatcagttcatctgtacactgtaactagaaaaggcaaataaagatcaatcaactgcagaaaatgaccaatttaagacaattcagttactgagttagttgcctggatattcgtttttataaggatcatgactcagataaactgacacccatcaatataattatataatcttttcaaattgttgtgtttactctgacaaatttctcagtattttttactcatgtgcatccactgttcaatactgacaatatgaaattcgtatatcgtgggcattcatctaaccattcgtcactgcaatttaaaaacacttacacttagctccaaaccagtggattagctaatcacactagcaaattaagaaatcttaattcggcaagcttccgtgatgatgccatctagctaaagtcctgcaagagagacagaaaacgttcttgtttcagtactactacatgtacttataaatagaagcatgtaatcagcactgctctgcttgctttgagaaaagttattatattaatactctttcacagagctcgaacagggtgagctcatcgagattatagctaaattattcacaaggtccttttctgctaggcttttgccacagtgcattgcacctggacaacaagcttggttgttgtcactgttttagcattcagatcatacctggagtggagccatagccacttaggagtgaaagattaatcaacaaacttaaataatactaatgttgtgcttgaactataatccaaaggtgattgcttgagggtttgagtttgacaaatgcttatcgagacccaaaacaccaatctagctagctggagtgcggaagttaggataatattgtagcctgatgagacttgagagagagagagagagtctacatggagtacaaaagatgactttttctccgtctcctctccttcaaacacggcctgtctctgacgcaaaaacaaagacaaattggtacctttgccttcttttttttccctttagctttattccttgcctacttgggtggtgtttggatccagggacttaactttagtccctgtctttagacactaatttagagtattaaatatagactacttacaaaactaattacataaatgaaagctaattcgcgagacaaattttttaagcctaattaatctataattagataatgtttactgtagcatcacataggctaatcatggattaattaggctcaatagattcatctcgcaaattagtccaagattatggatgggtttttattaatagtctatatttaatatttataactaatatccaaacattcgatgtgatagggacttaaaagttttagtcctatctaaacagggtcttggtacgatcatcttccttgttttctaccagtatatgatgatgttggaccaatcctttgcattcagtaacattcacattcagctgcaaactactttatggtctattgcacactggagaccatgttagctttgatgcagtaacctctaaaatttaatccatctaagaaaaggtcaaaatttcagaagaattaattctgcagcaaataggtgtaaaagtattggactgaactcttggtgcaagcaaacacaatggaccagtccaagtctgaaactgatgcagatgcaacccagagagggctccaggacctgaatgagaagctgcaggtaaacttcagaacacaggtatggacagaagaaatagatcttggaacgagtgagaggcaaatggaggtgagctgaagtccattcaaagtctcctcgtcaagtgtgtggggtaggccagatgagatgaaaggaacagcataggatgagatgtgatcattcactcccaattccaaccttccactttcctaacctccaaattccacactaagcacagcttttatttgttttacattcttttgattcaggggtgttggtaatggacggctaaagcgtccacatgaaacatttgaaaattttccattcatggtttatttggaacacatgattttttttcttattttttctttagaaaatgaaaatgtaaaatttgatggaaattatgtaaaattcgcacttctcttcaattgtatataataatgtgaaatttgaaggaaattatataaagtttgcacatctcttcaattgtatatatattaaatcaaataagaaaacaatgcttgattattcaaatacatatatcctcagttgtatggagtcaaatagaataccaaggcgttcgtgatgacttacagcaattcgaatgtacaatttaattgtggaatagtatgaaatatcaatctttgttaatctagtgaatcaagaattattattctgaaacacaccacaccaaaaacttctatccgcatatctggtgaaaagcccacttggatgaaatttctgaacctgtgaattcctttaatcttctgtttgatcaaccagtacacttgaagacaatttcattctacatgggcttgtatgctcctaactatttctctccctgcctgtatgtgtttgaggtaaagctagataagccaaagccttcgtttggtcaagctcctctgtcatttccaacacgtcgtccttttcccgggcaaaggccccacgattgttacgtagactaactttaatcactttggcacatttcaacaatctcgattacctttcctacttgaatctggtgatcataattttggctagcactagctagtccttttcagaatttgtagaagcttttcttcttcagggaaaaggtaagaatttacagatggttttggtgtagctggtgagctccagcttctttgacccggcatctacaaatggtaattaatacatttatttttcaagtctcagtttgatggtctgggagggatcctctatttcgtctgcattaatttcagagaatgacatgtctgcattagtaatagagaatggcatgtgttacttcagaataattagctgaaattgaaagtgacagtttttagattgtagtattagtgtattactagtatactattctgcaagatgcaatgtgtttctggatactaactaatctactagtagttttagtgaaacagctttgcagatgttgaatggtgccctcacattgctcaacggcataggattctcttggtacactaataaagcgaaggctagttgcctcttaataaaaatgctaagcttttcttttgaaaaggtactcagaagcaagaacttgttccagaggcagttcaaatactcaaaaagactatttataatttcatgtaccattatcttttttcctgaccattactgtgtttttttaagttgattttaaatactcttaaatcaccaaaaccaaattggacagcaagtatattccagtcagtttgcatatataaaaaattggcatccatggatataactgagaaattaccaacagaaaagatcattttttttctttggaatagtaacataaagaccattcttttgttgtttgaatggtaacagaaagaccattcttcaaagctgccaaagtttccttaaaactcagcctaaatgcaggttctcatcatcactgttctcaacctgctttcttcagtgttttcagctcccctctctcacaggttttggtcactcacacaagatatacgtttcagtcagtcaaccctggaccccaagaggtgtatgtgtgcgagagaaaaaaaaaatcctcctttccttctctctaaaagactggactcccaacgccgaagcactgggagtctgggaggagcaagaagaggagagaagagagccatggccaagaacaccgagagccccaaaacctagggaaagagaggaaaaaatcgattttcttgggtggtggttgagcctgcagtgaagttcatcagggaggaaagggaggggattaagggaaggagatacaggaatcaatgggaggccaagaacaggtggccatggcggagaggaggccttgttactgtcgcaacaatggcttcttgctgctgctggtacaagttctcctcttcttgttcttgtttcttgattcgtccatggtcgccactgccgcgtcggcgccggcaccgctaaatacgactcaggtatcgatcatgaaggagctttctggcttggttactgccagtgccaagtggaacacgagcgattcgaatccatgccgatgggatggagtgagttgctcttctagctccaattccatatcagttgtgaccaaccttactttgtctgggtatggtttgtccaactccaccatatttgcaaccatatgctctcttgacaccttgcaaatccttgatctctctaagaattccttcaccaattcgatagagcaattcttcacctcttcttgctccatgaaggctggattgcggtcacttaatctcagcagcagccagctatccatgcctcttagtaatttctctggttttccccttcttgaggttcttgacttgtccttcaattctttcagtggtgatgtcagaacccagttgagttctttgctcaagctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43940 - DNA, 841 bp, Oryza sativa
cactctcagtcacggttaaagcaaatccttcatgcaagatttggtttgtttgcaaggagcatctgatatacactaggtattaagaatatgatcatgagcagtatgcatgccatacctctggaccgaccagtcatctgtatattcatttcataccgacttcatatattgtttcctagatactagccattctgttagtgttctcccttttccaaaatcattttgagtaattctctctttaaactgtgttcagagattttgttgctcctatttctccaaattcacaatcacctgacactatcagaggctcaatatccaatctagctgcacggggaggaactacaaaccaatatgcaaacaatgcagttaacggttacgtacagaggtccatgtctgaaatggttgtccctgcatctagcagggtatcattgcaactgcattctcgatcatcgttacaggagtcccttagcaggctaaacatggagggcacctctgttgattcctgggatagcttccgcagaggaagctttccaagttcataccgagcttcttctactgtgactgaagaagtgttgagcgattctagttcatctggaatacctagagatggcatctcaacacttgcaggttgtgactttccaaactcagcactgcaccatgaacaggtaagctctaataccaaatttaagctttggatgattagctaggaatcttattccattacatggcgctgtatccagggtgacgcacgttcaaatgctaacctatttgataaacttgaagaagccttcgcagaggctgagaagtataggaagcaagcatatgatgagtcactgagaagaca

SEQ ID NO: 43941 - DNA, 6695 bp, Oryza sativa
  unsure (1)..(6695): unsure at all n locations
nnnnnnnnnnnnnnnnnnnnnnnnnnnnnnnnnnttgtgaacaagcagctcagggttctggttagtggaggcgctatgagcgggaggggagatgtggcttacggagggcggcttgaagcaacattgaaagacaaagattacccaattggccgcatgctttctaccatagcgctctctgttgttgattggcatggggatcttgctgttggctgcaacatccagtctcagattcctgctggaagagctagcaatttgattggtcatgcgaatctaagcaacaagggaactggtcaagttggcattcgcctcaacagctcggagcatcttgagatcgcccttattgccctcgtgccaatataccaaaacatcaagaagttattgcagagttaatccgtatcaaccagtatttatgtaagcgagaaaaggcagcaagataaatccattagagttaatgcaagcataaattagaactagagttaatgcaagcataaattagaactatctatttattttcttcttcccttacctacacgtaatagtgttttcttccaagtttttttttttttgatgaagttggatttgcagaacacatccttttcaggatttttgttgttatccttgtactctcaatagctgataagaaaaaaaaatgcactgctgttttgaaggctgcaaccgccgagtatcagatcgttttgctatatttgttaagatcgttttgctatatttgttactcatattaaattgtataaccatatattcttgtcccaatcgacttggaaaatactaatactccacattctattgtgtatagatattgtttggtcttatgattcttgtgttgtcattattgcctctagtggaatggttttcaagagtgatgtgataagttacaagaataatttgtcttcagtcagcttgactgcttcaagtgtgaaagcaatgaattagccccatcatttagcagtttggttgtttgaaggcaaaggcaaaacaacatatttacaataaaaaataatttataaataaaacttttatatacgtgttctcgacgatctagaaataaagattaaaaaacaaacaacaatgaaaaaaactctaaaattaactctaaattaatattaaaaatttaaattttagctgataaatataaacgaaaagagatggtgccaaatatgtatattttcacaagtcttcccatacaaaaccaattaacgtctcaattgggtcccactgccttaggcagttgactacttgactttgattcccgccaagtcttcgagggccccacctgtcagccgtggacccgcgcttctcccccgaacaaaatgaaaacgactaatctttataacgagcagagtagcatcatatctccagtttgttagacaagttaggatccttaaataacgtcctaaactaacccaatctgcgacataatctcgtttagttcgtggacttaatccgcgtctccgttggttaatatagttacagctctagctctggatcatcgcgagggagttagtttagttagttaatcagttgggaacacacacgtcggccgtctcgtctcgcgccattttttttgatgggctcgaggggcggcgacgccgacgcgtgggagacggcgagcgcgcggagcggcgtctcctcctcctcctccggccgcgcgacggccgcggcggcggcgccggcgccggagaacaaggtgttcgtggctctcccggcgcagcacaagagcggcaggtccacgctcgcgtgggcgctccggcacgtcgccgaactggctccggcggcgatcggcggcggcggcgaggtggtggtggtggcggcgcacgtccactcgccggcgcagatgattccgatgagcagtacgtgtgtcctcccgcttcttcgccttctctcgtcgtcgctctgcaaacccccacgccacaagctgcagggcttatatcagccgttcgattagctatgtacggtcaggattcagacggccctgattggctgatgcattttttgtgaggaagcccctgtagtttttacgtattccattctgatgcatttttgtgaggaagcccctgtatttttttcgtattctattctgaactcctttttagttcactactgagtcccagtcctgaatcccccaatgcggcgccccctgcctcgccggggacggcggcgaggggtgtcgcgacgggagctcactccggcgacggcgagcatcttcgcgcgcacaattatcccgaggatgtggctgggctaggatcgtgcagagattcccgcttccttttggtccaaatgcgactgggttttagccttttagggcaaaggggaagtattatttcctactgagttgttcatcgattcgcttgtctgaattgccaaaattgtttagtgtctaggtgattgtattcggttttttttttcaaactcttaatgcgaactgataatttctagtattggtgcccatggatgcacgctgagtcagttcagaatagaactgaagtagtggtcagtctcagtccacagttcacagtaaatattcattttagaagaacaaatcgcgtgaaggttgattagatgttgacctcatgtgttaaatttcagctaaatctgctattgcaacttcaaatgacatactttgttcgcgtggtgtactaattactaaacaactcatctaattacatggtagtgggaggcaagttccatgcaagtaaattgagaccggaacaggtcagtacttacagaaaatatgaaagggagcaggtggagaagaatttggatgaatacctcgagcaatgcacaaaaatgaaggttcaggcaatcttctcattcattcttagtaatgaagtctgaattgctatggggaacaagttaagtgtattatatttttcaggtcaaatgtgagaaaattgttattgagaatgaagacattgctaatgggattacagagcttattttgctgcatggggtaagtaaactcgtcatgggagcagctgctgacaagcaatactccaggtgtgtcttcatttctgctaccgatttgtacttttgttgcatcatatatctagctaagtgatgcctcaaaactctaatttcaggaaaatgaaattgcccaagtccaaaacagcactctcagtcacggttaaagcaaatccttcatgcaagatttggtttgtttgcaaggagcatctgatatacactaggtattaagaatatgatcatgagcagtatgcatgccatacctctggaccgaccagtcatctgtatattcatttcataccgacttcatatattgtttcctagatactagccattctgttagtgttctcccttttccaaaatcattttgagtaattctctctttaaactgtgttcagagattttgttgctcctatttctccaaattcacaatcacctgacactatcagaggctcaatatccaatctagctgcacggggaggaactacaaaccaatatgcaaacaatgcagttaacggttacgtacagaggtccatgtctgaaatggttgtccctgcatctagcagggtatcattgcaactgcattctcgatcatcgttacaggagtcccttagcaggctaaacatggagggcacctctgttgattcctgggatagcttccgcagaggaagctttccaagttcataccgagcttcttctactgtgactgaagaagtgttgagcgattctagttcatctggaatacctagagatggcatctcaacacttgcaggttgtgactttccaaactcagcactgcaccatgaacaggtaagctctaataccaaatttaagctttggatgattagctaggaatcttattccattacatggtgctgtatccagggtgacgcaggttcaaatgctaacctatttgataaacttgaagaagccttcgcagaggctgagaagtataggaagcaagcatatgatgagtcactgagaagacaaaagacagaagaagaattgatttcatatcaccaaaaggtaaacccttcactaagttagcataaaaaattgcaggtttttttacacaaagatctaatggacctggttacaggccaggaaatctgaggatttgttcttaaatgaggccaagcaaaggaaagaggttgaggaaaccctagcaaaggcaaatgtggagatacaattattgaaggaagaaatggatgcactgaaacacaaccgagatgacctcagcagtaagctttccgacgtgagtgaacagaaagtgacactagagcaacaggccgtggaatatggaagcattatcattgatctcaaggatacagttgcagcaagccaagccctcattgattcaatgcaaatggagtttgaacaattgaagcatgaaagagacaatgcactcaaacatgcagaagagctgcacagagagaaacaaaacatggtatcgagctcagacttggaatggagcactgaattctctttgttggagctgcagcaggcaacacaaaatttcagtgatgcaatgaaaattggagaaggtgggtttgggtgtgtctacaggggtcagcttcgtaacaccactgttgcaattaagatgcttcgctctcagaacttgcaagggcagtcacagtttcagcaagaggtaatagattaatagcaactctgaaaccataattgcaaattgattttgtattgctttagttgtactaaactaatgttactgggcaggttgctgttcttagtagagtaaggcatccaaaccttgtaactcttgtaggttattgctcagaagcttcaggtcttgtgtatgaattcttaccaaatggaagccttgaagaccatctagcctgtgaaagcaacacgtctccgcttacatggcagatccgtacacggatcatcggtgagatatgttcggcgctcatcttccttcactctgacaagcctcacgcagtcatccatggtgatctcaagccagcaaacattcttcttgatgcaaatttggtcagtaagcttggtgactttggaatctctcgcctcctaaataggtctagcacagtgtccacgagcttctaccaaacaacaaatccaaggggaacttttgcttacatggaccctgaatttcttacaactggggaactaacagcacggtctgacatatactcatttggcattatcatactgcgactggtgactgggaagccagctttaggcattgcaagggaggtggaggttgcacttgataagggtgagttggagttgcttgttgaccgatctgctggagactggccgtttgtgcaggctgagaagctgatgcttcttggcctgcagtgtgcagagcttagcagaaggaagcgccctgatcgtatgaatcatgtgtggagcgtggtcgaaccccttgtaaagtctgcttcgctgccagtagaaccagaatccattggacattgggtgaataagaaccgcacgccattctacttcatatgcccaatttctcaggtatgcatgtccaacctctccgcggtgcagtaaataacatgtcatagactcatagttgcattcacgataactgggattacaaatgtggtaagcaaaagctgtggatgttttgcttctttattgcaatcgagtatgatggaagcacaacaccatccatgtttctcagtacttggctgtgaacatccgtttggatgtagaggccggtttaatccattatctaaaagcaaatgtttctcagaactatccaaaagttattgtgttggcggttctgtgtatagtacgactgaatttaactttgatatttttagacttatggcatgttagtttagaaatacagcatctcgtgcttaaaaatcacccatgttcaaggcttaaagatactaggagctatctctgttctaaaacaagttctggttttaccgagagttgcttccttgagaactgttgccacacttaatgagggacagagatcggaacttctttctgagggaaaatatgaatgttaacaagtgtgcatgctttgatctctcagattttattgttgttctggaactattttttttttctgatataactttctgaataattatattatgcttgctgaagtagaatattaaagttccttgcagcattttttggtggggaataataatatgctactaacagtctaacagctgctgagcttggttgaaacaatattgtaggaggtcatgagggatcctcacattgcagcagatgggttcagttacgaagaggaggccatcaaaggatggctcggcagcgggcacaacacctccccgatgacaaaatcaactctggaacatcttcagctgatcccgaatctcgctcttcgttctgccattgaggaatttatgcagcagaagcagcagcagattccatcatagtaattagttcagtgaacttgattattcttagcttcataagttgtaaagttgatagctcattctttgttcagaagtctgctcgtgtagtgtagctgttttgttttgtgagcagcaacttacaataaatcgtgcatgctcatatgagcaggtgatgatcagctagcaaatgtttgatgtcagattgtgcttgaacataattgtttcaggccacttagaatcatgggacttatcagtttactgttgttggaaattggtaaaaatgaatatggagatgattttttccccctcgaggtgatgtctcctagtgggaag

SEQ ID NO: 43942 - DNA, 36683 bp, Oryza sativa
gacgtggacgaatctcggacgcccatttctcaatccaacggtgtaggacgagagatgcatagttgcaccgaattgggtgattgcaccggatacttccccgtctcctagtgagaatatttttagcaagtgcatctagggtatgcatgtggtataaatagttaaataaaaatataaaataaaattagcaagatatattgtgataatataatttggtacacaaacatgcaactacaaattcgatcttcaagtaaataaaaataacaagttgtgtttgtatttttttgttcaaattttgttatttttgtttctcaaaggagatcatatttaactatacatgtatatatacttctagcatcacatcaatctaaacctttttttaaaaaaaaatgcacgactatttagatgacatgcaaacgtttgcataggtgcgattccacctagctaggagtagaaaatccatgtccgtcttctcttagcgtacgtgtaatattataggaacaaatattaccgtataatatttttttcaacttgtatgtattgaatttgagttttcgcaaagtgacacatatttatcaaaacttttcataagtattaggatagcatacaataaacaaggggacacacatagtaaatcaaactgttgtttatcatagtaaatcttcccggagaatcagatgctcagaattcatagtgttcttcagcatcttacaacttacaagatggcgcagatatacaagcgcaactatcttaaagtaagctgtaggaggaaatggaaccatttctaacaacgggaaaaatataggttatagaaggaaaccatttgaacaaattaatagggaaataaattaggaggatcgtttccgtccgatctcaatagaactggacgtttgatacgtagatggcgtctggcatccagttgaccgggatgacgtctttggcgatgaggctcttgccggactcggtggtgacgcgaatggagaagggtgccttgagtggcgtggcggtgtccatcctccagatggcgccccacgacagcttcatgggcctccacgctggcaatccggcctcctggaggtccatctggatgacgtcaccgtcgtcggcgacgaacttgacgagcacggcgaggtagttggggttggagcccttctcgacgtggaaggtgaccttctggccgccggggtacttgcagcgcaccctcctgaactgcatgtcgatgatgccggccttgcggagctcggtctccttccccgggcaagccatggcgccgaacgccttgccggagaagtcgaagtggtacgccgagatgggctcgtagttcatgtccgtgatgaacaccgtcaccggctgcttcgagcacgccgccggctgctcacacttcacctgtactcaaaatgtactcggccaaattaatgcccaaatcaaaatgtacctaacgtaaatcgatgtccattaatttagcaaaattccatatatatattgcattgaatgtttgtgaaatataaactgccaaaaatgtttgtgaaatagcaatgtattaaacattgacttgttgataagatcaggccgccttaatttgaaacacaagagttttactggatatattttcattatataatcactatagttctaaattaacccttatgaaattctaaaatgaaattcctttgtttcgaaggagatgtacgaatgcatgtcctcgggacaatgattgggagagtacgagacgatgaggttgtgttaattaattggtgaggttacctcgtagcatgagccgcatcccctgccgtccttgaagattgggacgttgccgcaggagatcatgccgttgtagggaggcaggttgacgttcttgatcccgcacgcgccacctggaaaaaaacaaaactcaaccaattaatcgatcgatcgccatagatcatggatgagcttcacagttactccatcgccatggatttagacactgttcagattcgttattctatcgtactatcttgagacaaagatagtaacactacatgatgagccagtaaactaatattttgaagaggagatagtaacattacacgataagatagtaactttaccgttgtcggcggaactaatattttgaggcggagagaataacattacacgataagatagtaacattaccattgtcggtggagccggagccgtagggctggccgtaccaggtggccctggcggggagccacggggcgttgtagttggtcgtgatgttcgggccgggtggcaccttgggcgggccgcacgacccgccgccgaccagcgctgccaccacggcgacggcgaggacgatgttggtggtgagcgatcccattgtcgcttttatttggcttggtgtgttttgtttttttttccttttttttttggtggtgagatggatgacaagatcaagcagatgcctacgtatttatagtcggcgaggtgagggcgcgggtggacggccggtgtcgccggcgtcgcgcgcgatcgtgtcgtggggttgggcgtgcgtgcgtgcgttcgtacgtgcgcgccgccgccgcgcgcgggagcgattcttctccggtggttttgatttggtcatgcgttttgtacgtaatttgtgcctgtgcgcgcgccgagttgacatgtacgatgggtggctgagaaagctagcctgagatggaaggccagtgtgcgacggtgagacgacagttaagctggctgctgcgtttatgcgtacactgtcagtgtgtacagtgatcaagatggagagatatatattctgctggagaaggcgaaatatttggtgattaatgttgagtcttttccagtcccgtatttcttattgctttccagttttgtagatttgctcatgaaatcaatactatatagtatgtagtactggtataagtaatgacaaggttacttcctaatggatgaacacgcttacacgcccgcatgcaggctgtcatgcatatatgcagcgcaattagtaagattttgcatgcggcagatacgatcttgcattaattctttcatgatcctgcatccatccatcgtaggtacttcgtccatttcacaattcacaatgtaagtcattctagcatttcctacattcatattgatgttaatgaatctaaatagatatatatgtctatattcattaacatcaatatgaatgtggaaaatagtagaatgatttacattgtgaaacggagagagtagtagctatctatcccgatgtatcgcgtgcaaggcggtgcaaacgcagagccgggtcggcggcggcggcgtgctcgcttccggcggaagctacggcggcacggccaccggccgccgccttgcgggaagccgaatcaaaccgcgggtgctacgcgaacgcggccgatcctgctgagtgatctggagatctggaccgtccaaacacatgcgacatgggccttatgtcctcccttcccaatcatgctccggaataagttcatctgaggtcccttaactttacaccgaatccgattttcgtccctcgatcggaaaaccagacacaacgggtccctcaactatcaaaaccggtgcagatcaggtccctcggtggttttgagggcggttttggctgacgtggcgcctaggtggctaatttgactcggtcttcgtccaacgtggcattgacgtggcgctttacgtgtcaattcgacccggaaaaataataaaaacctagggacccacatgtcagtctcacatagaagataataaaaaattgtgggacccacgtgggccccacatgtcagtcaaactcacccttcctcttcttcctcctctctccccatctccctctcttcatctttctcccctctcctctcctcttccagcgagagtggcgagctggagggggcggcgagaccggcgtccgccggcgagagtagcgagctggaggaggaagctggggcgataaaaggggatcagcgacggcgatgggcagaacagatcgacacgggcggcggcaggtccccccggagcagcgccggcaattgagatccagtagtggcgggcaggagaagggcggtggccggcagggagaaagggcggcgtgcagcgatggccgccggaggaggaggaggagatgcagccatgcggggaggcgtggcggtggcagctggaggaggaggacgtccgccgtgcgctgctcccctcggtagtggcggcggcacaggggccctaggagtcgccgaggatgccgaggtcgacgtcgacgtcgtccgcggccacggccatggcttccccgtccgcatccggcgtgcaccacagaagcggtggcatggggagcggcgccgcagctacggtggcggcggcgtcaatggggggaaggggaagcggaagctcctcgctccggtgggctgccgctgacgagctcggtggtggtgaaacgcgacggatcgagcaccatcatggtggctgggggccctcctccgacctctgctccagaccaccgccttcgtcctcttcacccatcgccggctgtcgtcctcctcgctccggtgggcggtcgctgacgagctcggtggtggagtcaaattagtcacgtaggcgccacgtcagccaaaaccgctctcagaaccgccgagggacctaatctgcaccggttttaatagttgagggacctgttgtgtctggttttccgatcgagggacgaaaatcggattcggtgtaaagttaagggacctcagatgaacttattccatcgtgctcctgctacctataatgggccgcacccccgttctggcccagctaattatgggccgcattttgctcgctgtcacgttccgggccgaaaatacgtgctcggacagaaaagccggcccatcaagatcgtttttcatgaaaaattctctaacattttttgcctgcacagaacgttgttcgactgatctctgagttttggatggccatcgcacttcgcaacggaatggaggatacacatttgcctcttactaccattttacgtgttgtaacccaagcgaataatgctatgcctgcatttaaacttcttcagaaagaggctgacaaactcgcgacataaagatctgaaaactacactcatcttttgcactgaacaaaagtcggtatgaatttggctagttctgaataaaagtcagtatgaatttgactagttctgaagaaaaatctgtatgaattcggctagttctgaagaaaagtgatcatatggatatgctgtgtttactgtttcctgtttttgtgctcaatttcttttcttttgtccgtaccttggaatgatcagtagatgttgaatgttaaatggacaataacatgctttgggggtagatgcttggccacgggatgctgtcatgcattttgggaaacttcaaaccatgcttggagaattttcctccgtgtagcggccatcaacagacctcttaaccaaactcgcttgagagaagttcagagaagaagaaagaaaaactgactcctatcttgtcctcccctattactatcagattctcttaagaaaacatgaaagatgctttttcagatagatagttcctttctcagtttttcctggcttctagcctgctatgtttttgctatgtttagctcagtaaacaactggtttagctaaattgaagctagtgtttagttgtcttgccaggaaaagctggtctagctcagcatgctctacaagacagagtgatttgctaattgctactagaaaatcacccattcaataagaccatttcctgtgaactactgatcaaagtggacctaaaataactgctgtttctatcagtgagcagctcatttagctcataataacacaatatggtattatagtcatttatatttctgatgctatgtcctatgaggctatgatgatggatcaaatccatctctgatacagtcagcttcaggtgtgtagagctgctcgtgtttggatcgttgcgccttacaaaatcatgcataaggaaacaccattttctcacagattgaggtgaattaatgcagcagcttcagttgatcatttccaaaatttcttgttatctccttacatctcttcatattccatttgaggaaactttgctgctaatgcttgtgatagagtatgagtgctcagagcaattttggtatagagcagtgaattactactatgatatcgacaataaaagaagagcatatgctacaaacattgaattgtttggccaaaattggcagctaattctaaaggcgcaaaaatgtacgatagagaattatatgaggaaactagtagctaataaccaatatcactttccagtataactgggtttcacaaaccatgagcaatctcccagagtttattatcacaaattgtgccttttgtggctgcttagttattcttcaataaaatgttgttcattaaaaaatcagaaggaaaagcattcacattgtggcggacgcaagattagcaaaacatccagagtaggtacttgaaagttgaaggaacttatacagttatatgctagttgagtagtatatatgaaattgttcattttttcctgggacctcaggtttactaccttaccttagtacgatgcacgaacattatgtgagcgagctacaaatcagaactaaaacctactggaaggaagtccgttacacaattagtcacttaacaaaagcaataggacaaaattaaatcagttactaagcgtgatctggccacgacactaagaaaacggttaatttctcccaaattttaacatcagtaggcataaagtaacaatgctgagaaaatcacaagctcaattttttttagaatatcgatcacaagctctaatgcttcaattcttagacgattacacagagataccaccagtaatttgttttctttggaagaaaatactactagtacaagataattgagcaaaataaatacctactgggcgccgtcctcggggaagcgcgtgtcgaccccgccgtggccgtgctgccccgcaacgccggaagccgcagccgcggcgccgcccccgccgccgggacccgcggcggaggcacctccggcgccgtgctggagctcgatgacgagccagcggacggccttgctcatctgctcgaggcggacggcgctgatgggcttgatgccgggggcggccagcgccgcggaggaggaggaggaggcgccggtggcctcgtcgacgaggcactcggaaccgattcgctggcggatcgactcgacgagctcctccgcgtggtcgcaggcgacgcggaagagctcccaccgctgcttgaacgcctcgagcgccgcgtccgtggccgcgttcttctctccccccgactgcccccgcgcctccaccaccgccgccgccgccgccacgaactcctggtacgcctcgctcagctcgtccaccgtcgcctccatctcccctcgccgccggcggcttctccccgacacgctccaccgcctccgccgcctagattccccaccaacttgacctctactcgtcacagtgtcaaactcccaaaccagtagcgtcaaaaaaaaaaaaattcctcgtgggccgcagattcgcggcccactttaaaatgggccgtctcgtgctgtatcttcttactgggccgcacgttaaaacttgggctgggacgcgaggcgagggtttttctcgagggataaatatgggcctcgccgctcgccggagcggcggtggcttccccctcgccgacggcgaggcgggcgaccccggtgggatcctgtgagccggcgacggcttcccccaactcccgcctcgccgcgcgccgatgttgccgtctccctgcgcgattccgccgccgccgcgatgtatttattcggtgttcgccatttctagtcaatcgtcaaaggtgatttgactgtaccacgatgatttaatttcatatgcagtactggtgatgatgagatgtttgcttgttgtcaattttgttcgcctcaaatttcatatgctattattgctgaatcgtcactacccgtaggttgtttctcccgttcatatggagtaactgaaatatgaggccgagatctttagattagatcaccagatagactgatggctctatcactggcacacaatcgatgcactacatcttttttttattagaaatgaaaggcagggaatttgtggtgagcaatgggggtgaaggatgtgagaaaggtagagtcttacattaattcataacatgtccctgttcccagcaaattttgccgtgttgtactggcatggcatgacagcgtaccaaatgactttcctcagataatccattcactgcgacttggtagttgagtgttgcgttgtcttccgatagtctcagtcaagagtcaacctttttacctggttaaactggaatcttattctttaatgctaatacgcagtgtgttccctcttttagttgtccaaagtgggaaacgcaaactggtagatagaagtatctcttagttccatcttcaaggccttaccagttgcatgcatgagtatgatgctcaggcagaaaactctgtttagagacaaggtttatgttgctctccctgagcaacccaccgatggcaagtccatactgtcttgggttatcgatcatgcatccagtagcacggagatcatcatcatccacataattactacatcgaactttggttagttatgtgcagtggctttatctaaagttatttttctcgatgtcaataaaggaggtgatatagtcatatagctatcttatgatgtttgtaccataatctttagcttctggctttctgccatattctggtttatttcctctaaccattacttcttgtttctattgtgttttcggttgcataatccttagcaaagttctattgtcttagttgattccttttttgctgaagaaagccggatgcaaaatgtggacaactatctggaccagtgctcaagaaaaaaggtgcaagataatgatattttattttgttttctgaaaagttcatgtaaaaaatatttttattcactctccccacaaagacttctatgagtaaataactaattatagaacataaggaaaaaaaaagtaacaccaagcaagagtgaaaatggttatttttttacttgatatgtccaaatactgattgttcatatattataactgaagatagttcttatagtagtattatcattgcacaaccaaagccacgtccaggtattttttttcgtctaaacaaaaacagttggtattgaagtagaattattttacaaaggtacaaaaatccactccgtgctaatgaaggttggggacatctcttccataaagaccattcgtaggaaatttatacagggtatcttgttttgggtagaagcaagttttggaagaactagggggattttctattttattttattttattttatttttgctgaagctttcaccatatctatttttgcattgattttttttttctgaatactataatgaaccctctggttccatttttttatgtgacaaaactgtaaaaaatccatatttcaaaccctggttaggtaataatccaaaattttgttttaaactgatcgagattaacagggcatcaaggctttctgccacttgtatgctgaatcatatgaatcactgaggtttacatattgaagtcaacttgtttgactatctatggatgcatgttctgcaattctgttctatctattttatccatgatgttgaaaacaaaaaatcgattgcaataagttaacatattttgtaaagaaagtttagggggaaaattaatgcaaaaagtaatatttacttcatcagagggcaaatttcttattcttccttgaccaggttaaagctgagaaagaagtgttcttttttaccaaaattgacgaaggacttcttcatctgatagaaatatatggggtcactaaacttgttatgggtgctgcatcagacagacactacaaaaggtttctctctcttctctttctctgagttctaacaatcgtggtacagtttcacgttatcagttcttattgattgtgacaaaaatatgactatttttgttgcccagaaaaatgaaagcaccacaatcacaaacagcaataagtgtgatgcaaagagcacattcatactgcaatatatggtttatttgcaacgggaagctaacatgtgtcaggtagggcttcaactaccaaatgggactcttatataaatctgactttattttattgtatttatcttaagccccagttttggcattatttcacagcaaggaatctcaacataacagtacaatatgcagcttaaaataatcacatgtaaatctttcagtatagggcctataggcagccatatgattgatacttcagttttgaaactccaaggcaccgaatcggtattaattggacaaataacagaagggatcacaatcttgactgtttaccaagcatgctgtatgtaactgaaggacgaatagttttccagaatcaaagatcacaagcctattgcagcagataaattctggcagaacttcacatatttagaatgagtagaactgagaaaaaaacatgtgtacatttatttttgccttgtatattctttctttgcgaatactttgtcctgtatatgttattaggacagtctaggttatggtcgagtttgtaccatatttagctgatctacaattcgacatgccttatcttataactatctgcattttgtcatgtaaagtatctgttatttttccataagagaatgattatcacaagtttattgaagcctaaataattcttaatttttcactactttgaatttttcttccactaaacgtctctgtttcttttcgcctagggaggccagttgttgccctgtaaaaaggtcaaaatcagcacgcctaccttcttctgtagacagttgcaaggtggatcttcaaagtttgcttgagcctaatatagaggtaaataccactttgtactacaattaacatgagcttttctagcgcggcttagtagatgttcacacaggaagaccattaagcatgtacttcagagataccaagaggtctctaaaactgttctgaagttaggaatgtggaaatgctataataaactcgaaacaaaatgaaacaaggtagtcttggctcagcaggaagaagttaaaatagttttactctgtgtttcagatcctttgcgcttggtatgccgtattatataatatccaaacttttacagtattttctgttaacaatcgctgattgcatttgcaggctaaaagattgggatgcatgtatattaatgaaatggaactaaggaaagagacagaggcaaaactctcacaagaaaaggaagagtcagaatctctcaaacatgccactatggtgctccaaaatgacctggactggctcaaatatcagttgaatgagaaagccaatagattacaagatctaaaccaacagaagcacctccttgaacaccgcatctcagagtcagactcagttgccacttatctagaagagagcatgaaggttacggaatctcgtgtccagtcactgaagttagagtacagtaaaatgaagcgagagcgagatgatgcagttaaagaggcaaggagcatgcgtatagagaaggagctgacgaattcttgtgcctatggagcaataagctctgagttctccttgatggagttggagcaggcaactcagaatttcagcaatgcacttaacatcggtcaaggtggatttggatctgtatacaaaggttctctgcgcaatacgacagtagctataaagatgcttagtactgacagcttgcatggccaatctcagttccatcaagaggtactattcaaaggcctatcatccatttgtataatattgcattgaaaaaacggaactaagataagctaatcattattaaaagttaagctaatgcattctgccgttccaatttgttttcacaggttgctatactcagtagagtaaggcatccaaacttagtcacccttattggagcctgcactgaagcttcagcgcttgtttatgagctcttaccaaatggaagcctggaggaccgactcaactgtgttgacaacaccccgccactcacttggcaagtgcgcatccagatcatcacggagatttgctctgcacttatcttccttcacaagcaccggcctcacccagtggtgcatggggacctcaagccaggcaacatccttcttgatgcgaatttgcagagcaaactcagtgattttgggatttcacgcctccttctggagtccagtgtcactggaagcgacgcacactacacctccaggcctatgggaacaccggcatacatggacccagagttcttcgccacaggggagctgacgccacagtctgatacttactcttttggtgttaccatcatgcgtctcttgaccggacgggcacctctacgcctgattaggacagtgcgggaggcgctgaacgactatgacctgcagtcagtgttggaccattctgcaggtgactggccattggtgcatgtggagcagctcgcacacattgcgctgcagtgcacagagctcagcaagcagaggcgccctgatcttgagcatgatgtgtgggaggtgattgaacctatgaagaaggaagctcattcgccattgtcccagtcttttcgatctatctgtagtgccattgaaactgccaccccgtcctacttcctttgcccaatctctcaggtactacaagttagaaaggtactccctctgtcccaaaatatagctacttttagcttacaaattcataagctaaaggtagctaaattctaggatggagggagtagaatttataagttgctgccgttgtttcgttagaaactgttaccgatgcttccagcattgcttctcgtctgaaactctaataacgatttactgcaattgcatatcttcaggtgaccatgagagatcctcagatggcagcggatggcttcacctatgaagctgatgctataagagattggctggataagggacatgacaggtctccagtgactaaccaaacacttgctaactgtgacactatccccaatatcgcactgcgttcggccattcaagaatatctcaagcagaacaacatgaacaagtcatttgcactatatgaacagcagcattagtggcctgtattgagtttcatctgtgcttcgactgtaatagatcgtttctgtgccagtaagaaactaaggaggtagtgttagaatagtgtttttcttttttcagttgagctgtaaacctaagttaaaacttaggaaccaattcttttcattttacctgagtttttgaaaattaagggttgggtcttctttgaactaattcatgtggaaatcctacaaaactgtgtgttaaattccagcattctaaatgagatcttaatggatatactgagttcatgttcatctttccttctggatttctgataatggaatgatgaaatcatgtatcatacccatttcattagttaaacagaaaaaaacgaactatttcaagatacagcagaaatgatttttctctatcaacttttatttgtttctgaattgagtattgctatagatatgacccatttgtacaactaaacacatgctaccaaaattgctatgcatacgactcagctgtccgactcatgtatgaatgaatttgatcgtacgtgagtcggacagttcacgtacagttaggtcgtatgtgtagcaattttcttttaatcgcgttcatggaggaacataaagggtttaacagactgacatgtgggtcccaccacatgtagtggtagggtcgatccaatctgctctacctggaattggaagggctaaatcgcaaaacctccctgccgcttcgtttcctttccccacacttcatcccccccacttccaccacgccgccgtcgtcgccgccgccgccgccgccggcggtcgcccgacctcgccggcgatatgcctgaaaaggtatcccactctgtccatctctcacttctccatctctctcctcacttcctctggcgctcaccctttttggttttctcctcttcaggcggcggaggccaacctccgcaagcagctggagcaaaccctcgccggcgagccatccagcccgctccaccactacaacctcgtaaccttcgtcatcccgttgcacgaatcctcgccgtggctgcggctctcgctcctccattgcgggcttatcacgcggtagtcgtgtgcgtgcagggcgtcttcctatgggaccgcgcggaggcggcggcgagggaggagggcgaggaggaggaggaggtgaggcggctccgtgcggcggcggccgagcgcttcctcgcggcggccaagctggaccccaacgacggcgtccccttccgcttcctcggccaccattatgcgcttgccggcgacgcgcagcgagcggccaagtgctatcagcgggcggcgacgctcaaccctgatgatgccgaggctggggtgggttggaatgcatatgagcgtgtgcctcgaaggtgtttgttcttttgcctgtgagggtgttttggtatgatatgctgtttgtgtggtttggtgcaggaggcggtctgtgatttgctagatttggagggcaaggaaagcttggagatcgctttgtgcaaggaggcagctggcaagtcaccccgggcattttgggcgttccggaggttggggtacttacaggtatctatctatccttggttggagttgcttgacagcttgagtatattgttgattgaagtaatcatgtccgtaatacttgtgatcaactctggctccacctaaaggggcaaatttgcaaaatattatggcttcattcgatggaatagatccatatggactggttttcaatcacaccatctcagacacacccaaacaaagcctacaggtattagttactgtgatcccaagtcccaacactgttgagataattaaattctgacccaatctagggctagtccaagcttaagtccccatatgcatgcctttcgatttaccaaaatgtaataccattcatatgccattaatatatccagtgccagtttctttcacgccatgaccaccagggtattcaccttccttcacgtcctttagcctcatactagcagatagtattggcgtattggcatgttcctgtcattttggattagttgatagagaatatgtggaaatctataggacaacatggctagtttaggcttgacatttcgcatctctgcaatacctagttttggagccttatctctaatcaaagctgtgactatatcagcctgtcaggcctgctttgatagggagaataggatccaaatccttaggatttgtatcatcccaaaggaaaaagaacaccccgttcttcttcaaaacaaaccctaaattaacaatgtccattgcccagctataatctccaacttttgcttgcttaggaaaatgtaggttttttcctggagcaaggaacaagtagactatgtgctttgcttaaagctaaagttatgcggttaacatctctagatttttcttcatagttttcttgtttatgcatgctaaattatgcactgatgtattttcaataagtattgacaattatggggcatttaggttcatcagaagaaatggtcagaggctatacagagccttcagtatgcaatacgaggttacccaacatgtgcagatttatgggaagtgggtattttttccccttgtttcctttattttgttaatgctggtgaaatctaagtcaggcatgctatttgtatgtaattaatattccatattatggtattaggcactcggtctggcataccaccgtttgggcatgtttactgcagcagtaaaggtgtgttacttttttttagcatcattagtgaatgctgcagtatactatattgaggcttctgaatatgcttaattcagtttatgctggcagtcgtatgggcgagctgttgaactggatggttccaaggtctttgcgttgatagaaagtggaaacatccagctaatgcttggttattttagaaaggtaggaatttttttcacttaatggaactattatattactagatatacacaattttatcagcactatgtataatttaccattgcaaattctatgccagccctttactgctgctaccgctaataatttccatgatcttatacgtgttgggaaatacgcaatgccagggtgttgaacagttccgctctgccttggagatggctcctcaaaatcattccgcgtactttggtcttgcttctgcattgcttgcttgggcaaggcagtgtgtaatgactggggcctttggctgggcagctagtctgttgaaggtatttggacactagtcttggtttcaattgaaacatatcctgctatattgtctcagtgtagtttgttctaggaagcatgcaaagctgccaaagtttgtacttctttgactggaaacctttcctgtgtttggaaactgcatggagatgctcaggtattctctattttactgttaattaatcatttaaatttcagtatcctataattttaagctttcttgctttatgtcagctcgcacttgcaagatgctttccatggggtgatggtaatatcaaggggggtatggatgatggtactttcaggactactgtacttgagtggagaaatacatgtttgttggctgcaaatggtgcaaaattctcataccaacgagctttgcatctcactccctgggaagctaatattcacaatgacactgctatatgtcttgatctcatttataccattgaggagaataatagtctagatcccataacttggtaagtcttttattccacattaatagcttagtagcatgtggcatctgttcttaacaagcgtacatgataaaattttatttctgtgtacaacagggaactgccagagaaaatgtcgttgggtgggttgatactggaaccagtcaataaggatttttgggttacattgggctcggtgtcaagtaatcaagctttaaaacagcattcttttatcagagcactgcatcttgatatgtctctctctgaagcttgggcataccttggaaaggtagtactccccccggacacaaaaacatgtcgttttagtcattgacatgaatacatctttggctgctaattttggttgcgaaacatttgacaaaccccccaaaatatataatattgtgaaattacttttcgaggtaaatctacacacatgattttcacacatggaatacaaatattaaaaataatgtttaaagtttttttaagtttaacttaaaaaaaaatccaaaatgacatgtttccataaccggtgttagtactatttatgcggcagctgactgttcttctattaattgagaggtaagtgatagttcgaccttcagatttacaggcattcaggtgataagcagttggcaagacaagcatttgatcgagctcgaagcattgatccttcactggccttgccatgggcaggaatgtcagctgaaaattaccaccagcctgggtatttctcccatagaatttcatagaagatttcatatattgttacagataatttcttattaagctgattatacgctttggcatgatcttcaagggatgggccagtaaatgaatgttttgaaagctgcttgcgggctgtgcagatacttcctgtaagatagttcatttgtatcatacttgttgtcagtataacattaatgatttggttagtttttctccttcaagtttgttttgatttcattatagcgatgtttttgtattagcttccagagttccagattggtcttggaacaattgctgctcgttctggtgaacttctatcacctcaggtatgctttcaaactcccccctcccctgcaaaaaagaacaaaaacattttaaaaaaagaaggtacttcatggttgaaataagtcctttctttcccgcagcggtgtgctttagtggcaattatcacatgctctattatcattaatgttctaattgctgatgctaaatgctactgttatggtcccagaccacaatagctacatattgcttcattatggtgtcatgtatgcgaagtgttactagctgtccgtgcattgtctgctactttagattgctcagtttttttggatattttagagtaccagactacatggttgacacttgtttcctgttcttttccctgtaacacataatccccttatacttagtcctattatttaggtattgatggctgtaaggcaagctgttcaacgggcacctcattaccctgagtcgcacaacataaatggcttggtttctgaagtgcgatcagacttccaatctgcaattgcatcgtaccgacaagcaaaatttgctttagatatgatgcgcaactccaaaacagactgcagatgtcatattgctgatatttccgtgaatcttgcccggtcactatgtaaggtaagagtattatcatccgctttgatgacaacaaaaaaaaatccatatcaggcagctgaaagatcatgttacttcaaatgttttatgcgcaataagtttgcattttctgtcacattatttacaaatgtttatggaacagttatcctttaaccgttgctttgactgtagactggtcttgcaactgaggcagtgcgggagtgcgaagaattgaaaagacaaggttttttttttatttcatgtagcaatggaaggatctttttttcctattttctcctgaattgccatgcatggcaaataaattcctttaagttattttcttatgctatccaacacacaggctaacaagttatctcaaatttctaggatttctgaatgatgacggattgcagatatatgctctttcattatggaaacttggtcggcatgatgaagctctttcagtatcaagaaacttggctgaaaacttatcgagtatgaagcaggagagtgcaactgcagctttaggattcatatgcacgttgacatacaacatctctgggaaggactctgcagctgcggtcattcataaactgcctggtcaactcaattacagcacacagctgaaatttattatctctgcattagatgctttacagccaaacaagcgttttcagttaccccagctgagtatgcctcctaggcttacatcgtatgaagtcatgagtgaagtccactcaaatattgctcttggaaatgctgtaagtatggttttctaaaattcttggcattctatgtgaaaaaatgcttcttttgggaatgtgctagagcataaatgtgctgatatagattaaaaataatccttgtagattggtggggaatcagacaagtttttaagggttgatggtggcctgtcttacctgaaaaaggttctacacatgtatcccgactgcagtttagtaaggtaatgatcttgcatgcactggtaatatctaggttctagacttgtggcttcaatcgaaatgttgtgcactatatttccttcgttgcatgctgtagaaaccaacttggatctctgctactgtcaagtgaagattggatggcttctcataaagcagtaagggttacttcattgtcccggggatatacatccaataggggcttaagatctccacaccaaattcaagcatgtgcagcagtttcttgctatgctacctgcacttcttacccaaagttctcttttccaacatgtgaagatcaatacctaagcggatacaatgcaatatgccgcctgcaaaggtacatcttctcttactatatttaccatgtatctaatattcttgtgtgtgacttgaccttaagcttgcggtttgactgtaacaatcttgcacatattttccaaagaacaatctatccaactaaacaagctcttatgcttattcccacaggagatgtaacaaccattcatgctttgtatttctaaaccttccattaataaataaaatggcatgagtcttaaaaaagaactaagtgtgtgactttctttgcaggtgggttcatctagaaccgtggaaccaagatgcacgtcgcctccttgtacttacccttttccaaaaagcacgtgaagaaaagtatccgaaacatatctgcaccattttgaagaggctgattttgcaagttctctccagtggtagcaattcacaagacaataaggtggttcagtatgggaactacttgttacttcttgtggcttcagaggttagtttgcaatctggtgaccatggcaactgtattgctcaagctactgaagctcttggagtaacttcttcgagcgtggattctttctttgcacacttgcaactgtgtcgggcctatgtgatgcaaggcaatcttttgaactctaggagtgagtacatgaaatgcctgcaaaaccgtacagatactgaaattggctgggtaatacttaagcaacttgcatctatatgttcactggagggtacccctgatgaaatagagatacatctcggaggatgcgttgaaaggaaaggtagcaatgcatccaaatggatgtctcttttttatctagcatgcgctcagtgttcagtatggaatgaggactttgcaagtgctgaaaaagctattgctcaggcatgtgctgaaggggatcctgacagctgtgtcttatttctcaacggtaattggcatgctacttatttactataatgactaactaaattgggatgttttattgttatttttcttagtagtttactctacactagcccggaataaattctaactaacaatcttgatgtttatttttgacaatgtgctgactgaaacattacccttgtaggcgcaatttgtatggacattgcttggaggttcgcggcccctcaatttatagcccgtgcagcttccagcctcagaaaggcacagcagaaatcacttgcttctttacctattgtgtccctcttactggcccaagcagaaggcagccttggctccaaagccaagtgggagaaaaaccttcgtctagagtggttctcatggcccccaggtctgagcatggcttcatacaaagcacactgttcttgaaatttcaccatttaatttacctttttccgattcgtcgtgcagaattgaggcctgctgagctctatttccagatgcatcttctggcaacgcagtcaagtgcagcaacttcccagcagaaccagctagtggaaaccatgcaaaccccagagaagtggcttctcagggcgatacacctgaacccgtcgtgctctaggtactggacggctctgatgcaactcgtgtacgtgtaacccttcgaaattggaagcactgatctttggtgaaaccaaccacaatgtagcgcatttcttgactcagctgtaagcatatggattggctggatgaactgccgacctgtctgtgataagtgaaaaacctgcatatgcttgcttaccgtgttgagggctgagacgtgagatgtttccggaattaccttttccctgatagactgcaggcatattgtcttcttgtaaactcttctcacaaaccaaccccccccccccccttctcagtttgtgttgtaaaccaattggtgacctttcaattagcagcaagcaagtcgtaactaacaaaaaaaaaagctaaggaatgtgaggcctaagcctgtctatcggtgaacccaaaagcacccaactcagcagcctaatggagattctcaaacaagtgtctagaaccttgttctcctacccatcctcaacacgtaccgttttaaccaccttttcctgtcagatttttttccattgattttgtgcccatcgtttgacaacaaacacagccaaggacgccaccacgtcacggcggcgtcgcgccgggagccgagctcctgccacctcctccacgctcgtaaaataaacccaaagcgcgacacgcggcgccgctcagagcgcgacgcgcccagagcgcgccacgccgcgcggcacctgtcgccttaaacctcgcacttgttgtccttacgcttcatcacccgcgctcactttactcccgctccgaccaagccaaccaacgcgacgtcgcagccagagcgcgaaggaatccgcaccgggcgcgcggcgcgccaccgctttgatcactctcgtcgcgcgcggggcggccatgtcaggcggcgtagggccgacgtgcgggggcggcatcacgctgccgtcgacgggcgcgccgctccccccgctgcacccgacgccgacgtcgccgacggcgcggcctcaccaccactactacctcttctccatcaagcagctcaactcgttcggcgccgcggccgtgctcgccttctccaccaccgtgccactctccgacatcgccttcgccctcctcgtcatcccttacctcgtcgtcctctccgtcctcgccttcccgcagaggcccggcaagcccaacccgggcgcgccggtcttcctcggccgcggccgcttcctcctcagggcccacgacgcgctcggcttcctcgtcggcgccgcgctcccggcgctctacatcctcgacggcctccgctcgggcgacacggcgggcgtcgccgcggcgtccccgcacgcgttcctcctcgccgcgcagatctttaccgagggcctcgccgcggcgtggcccgggaggttctccctccccgtgcgtgccgccgtggtggtgatgtacggcgcgcggaggatgttcgcggcgtcggagtggctccgccaggagatggagaagcgggaccagttcggcggcggcgtcggcggcgcgcccgccgtggcgcgccgcagggtggtggcggggagggtgctggcggtggcgaacctcgcctactgggggatcaacctcttcgccttcctgctgccgttctacctgcccaaggcgttcaacaggtactactgcggcagcgacagcaaggaggacgacgccaccgccgccgccggcgccattgacgccgacgacgccaagaagaaggattcctagagtgtgtttgatcgttcgtcgctgctttctcactcgcgtttgtgcagcttggtgtattagctcttcttcttaattttttttttcttttgaaaaattcacgcatgtattagctcttttttttctcgaaaatttcacgcatgtattagctcaacttgcgtttcgtttggtgaagacaaacttttgagtttgagggtgttcggtgtaaagagatttttctttaaaaacagtaaattttatagaaccatatatcctttaaccaagctatcacaaaacttaaacaaaatatttaagcgtttattagaaaactacagatttgacagtatcacaaaactactgatcattatctttagaaaaatcacaaaacgactgattctactgatttttgaggagaattgtgcagagttcaattctctgttttaccgttatgttggagatgtagttttgtgattaaaattgtcactaaacttaccattttgtgataaatttgctacttagttttatgataaattcgatgctaaatttgaagatctggtcttaataaatactagtatatagttctgcaatagtttgttcagttttactgagctaaattgtgcatcaaatccttgggcctaatttgaatgggccttagttctgggccaatccacttgtatatgcccggaaaactgaactagaaggccgacccattcacgtagatgggccggaatgaaggcccatacaaacgaggcatgctctgtttgctcttagatacggcccatatatgcagaatcgtttctccgcgagtccgacacggcgacacaatgagtgacgccatgacggcgacaacaggattagcgagctccacaagcgaagagagtcaagaaactactatccctttgcgtggatcttttgcaggagatgttggaagaagaagaggaagtggttgcgccgacgacgaggtgagcgggttgacggaggaggaggcagcgcgcgccggcttcgggtgtcgttgtccctgctcgccaggtgctcggtacaatgccccactgtgcgctttgtttcttcagaatattagtagaactctttgaaagaagttagaagttagtaccttgttctcttcggaatgtttgttttcctatgttcttagggtgcatggcatcatttgtgatgctgttagaaatggtcaaaccacttaaatcaccaattggcattggcacacttggaattaacttggaagtgatttgttcatgcatattgatatcagcgtctccatcgcctgcagttgctcctccagactgcagctagcgtgacgagaaacatcttcttgagacgatatcagaaggttttctctacaagcttcccttcgatcgtgtagccagcatctgtaggctatagctcgttagctgtaaaacttgtgctagctcgtttattggttctttcatttgtttcctgttagtcagtttctcctcccccagttttttagcttgttctcttctgttttccagtcgagtgcatgactgcgatttgctcggtcgtgcacatgtcgagcttgacgtgcgcttagtccgcacggagcgcgtcgcgcggcttgatcccacgtttttactttctgtactgaataaaaggaagaaaaaacagagaaaatgctggaacgtttctacgcagcgccaaaacacacctgagttcatcgtgttcttgtgttcattctctctcgcgttctctgctcgagtgactgtggttgcaggttgtcgctgacatactgctgagcagaaaaccagcacccatcggcttagtacctgtctgctctgctgtctcagcctctcaggtcagctgtctttatcttactaaataaattattctgcgaatttttgaagaaaaatcaaacttttagtactttggaagagtagcaaactagattgctttggccacatcacatgctatcactgtcagagccataccttagcaacagcatttagcctgtatatgtatatatcatcggagtaatctatgccgaactttactcaggttgcaaaccccatatcccagagctcgacgccacccatgtggtttttcaacttcaaccgaaatggcccctctggcttctccggcgcctccaccgccgaggaggtcaccgccggcgtcgacgcccggggcttggccgccgtcgtcacaggtacaatcattcaaccaatgttgctgccatgccatttaattaagctcgcaaccttggtcagagagattcagagtgaacttgacgacctggctgcaggcgcgtcgagcggcatcgggctggagacgacgcgcgtgttggcgctgcgcggcgtgcgcgtcgtcatggccgtgcgcaacgtcgccgccgggcacaaggcccgcgaggcgatccgggcggagatccacggcgccatagtccatgtgctggagatggacctcagctccatggattcggtgaggaggtttgcctccgagtttgactctctgaacctacctctcaacatactcatgtaagaacagaaacacgggtcaactcgaacagcgaatttaacctgtgctatactgattcaaacttacttttacgacagcaataacgctggaatcctgtccaaggactgcatacgctccattgacggcctagaattgcattttgcaactaatcacattggtatgcgaaattgcatatggcattcctcgtgcatctcgatattgcttaattgtggattgattgcttttatgacttgaatgacaggccattttcttctaacgaatcttttactggagaacatgaagagcacaagtaggacaactggtgtcgaaggaaggatcataaatgtgtcgtcttcggggcacattttgacctatcctgaagggatatgtttcgatagtgtaaaagatctttcgaggtaattaataaattccgagactctaaaaattaggactaactagctaggccatttttgcatttcaaggagcatagatatgatgtcgattctaacaatataactctgttttacattattcttaacaatataactctgttttacattacagacacaaggaggtaatttcctgtcatccattagagaattggatgaccaaaatcattcttcttttacatttaagaatcaatacattcaggagggccatctcggccatccttgagttaaaagaaaatatttcttccagcggtttatgttaatctgttccttttatttattggttaatgtaagaactttagcttttgtcattctaatgttaacatgaggaattaaggggcctccaattagtaaagataaatatatttattgtgcacttgatttatcttaccagattctccacttatattgcttacggccagtccaagcttgccaacattttgcactctaccgagcttgcacgaattctgaaggtagtgttcttatttgctaagcatgcctatgagtaaattttgtatgttgtctctgtttgcatatgattatagccaaatctatgaatcataagttggaaaccgttaagtatgaatagggagatggtgtgaacatttcagcaaatgcgatccatcccggttttgttggaaccaacctattcaagaactggactatggctaatggtaatccctagacctttcaatgcaaaattgttgaagatatttttggaataaattagtagtacttgaagaagcatactcttcaaaatattaatttgggatgattcccaaacattttgatccttgctgtctggcgtggaaaggttgcatctcctaaacacatgatgctatttgtgaatgcatctccttttataccattataccattttcaattgttcttctccattacagctgtggtgaacaccattggaagaatcgtatgtaaaactgtagaacaggtgaactttttttaaaaaaaatgaaaaatctcgtcttttatatatgttgttatgttgtagtgtggaacatctaggcgactctaacctcgtgatattattttttagggtgctgcaacgacatgttatgtggcattacatcctcaagttactggaataagtgggaagtacttcagcaactgcaatttagagaccccaagctcacaggcttcaaatgcagagttggccaagaaactatgggaatttagctccaacattgtgtcggctgccaaactgtagtttgagttattcatatatgcatgcgctacattttatttcgtgtaagccgaacataaaattttcatagaaagtctacaaataaagagagtgtagttcctcccaagaatcttctctgttatactccattaaaaaaagaagtctgttttgactttgagttgcctaacttcgcataaaaattgtattttaccaataatatcttatacatcatttactctgggtcaaaaccgatgagtatccgtgatggagggagtatattgcctagttagtgtggagattcatcccacctcaccacgcactccatctgttctaaaatataacgtattctgataatctgattggacagaacatactttaggctgcgtttggcaagactagttgagaacccactttatttttcccgcgtgaccgcttttcaaactgttaagcggtgcgtatttttgaaaattcaaactgttaagcagtgtgcttttttaaaaaaatttctatacgaaagttgtttaaaaaaacagttttaaaaaatcacattgatccatttttcaaaaaaaaactaatacttaattaatcatgcgctaatgaatcgctccttttttatgtgggagagattagttcccatcccttaccaccgaacgcactcttagtgttcaaattcgtaatactagaatatagcaccgtccaaattcatagtactatgtctcatcttatcaaaataccttatattttaggttggatggaggaagtccggtcacttcatgggccgacatcgaggctgttataccgaggtcaaacaagattttgacccaaccagatgagcagccccatagtttgaaataagtcaaatatcatatttgtaaataaaaataatttataaataaaacttttacgtacgtgttctaaatgatctaaatctaaagactagaaaataaactatgataaaaaaaccctctaaaattaactcttaatttaaggtgaaaaatttaaattttgattgataaggataagtgaaaagacgagggcgagacgtttgaagaaggcgaggcacacgtctcggcgttttcctccgttcggcagcacaaccagaaccgtctccggtctctccttcccggcgatgcccatggcgacgacgaagggtgctcgcgacggaagagagggttcgtaggatcagcgaactcctcaggcgaaaagagagaagaaaatagtactatcactcagcctcgacgcgtcgaggaccaccatctgttaacctgttggtggggtgggtggctctttgcaggagacgttggaacttggaagtccacggcaccgtcgacggcgaggcgatcgggcggacggaggaggaggcgcgccgctgcgccgggctccggcttcagagcgtatgacccgccggatccgttgtgttgtctgtccgtgcccgccaggtgttcgatacaatgccccagtgcgctttgcttcccttctggtaagaaaaaaagtttgcgacctaagacaaatgggtacgtcatttataatgctgtttcaaaggtttaggcaactcaaatcaccaaatagatgattggatgtagagtgaagaagaagaattgttataaagggtgatgcttttggaagccagtacatacttctgagttagtatacccgttttcttcagaaatgaaattccacttcgtcaacggtaagctcttatatctactcaatactagaatgtactagtatttcgttttggatttggattctagtaattggattactcacaagaaatgatgggacaccagatatatactactactatatgactttgaagaaaaaaaatgataatttgatatactttgtccaccggttgacattggcacacctggaacttggaagtggtttgtgatttgacaatcaatatcagcatctccattgccatcggctacagttgtaacttggaagcggtttctagtttgtcaatgcatatcagcatctccatcgccatcggctgcagtttttcctccatactgtcgtctgtagcatgctgaagagcattattcttttgcacccagccacccacagagctgtagctgaacagaaaaccagcaccccacctcggctttacttctctgctctgctcatcggctgtgtgaggtgttcttatcttattgaagtcttctgggaatttatggtataaaaacaatatctttagtactttggtagagtaacaagctgaaactgctgtggccacatcacattctctcactgtcagagtctaaccatataatttcaggccatctggtgccgaagctgaactcagcttgcaaacaccagtacgccactattccctgagctcgacgtacgccagcttggtacggagtcggcgatgtgctggttcaaccgcaaaggcccctccggcttctccggcgcctccaccgccgaggaggtcaccgccggcgtcgacgctcggggcttggtcgccgtcatcacaggtacggatatgatttttttttgaacgactcgcgcaaagatggtgcgaagttctattatcacaggcaggggcggagctagaacaaaatgaaaggggttccactcgcttgctttactctggtttgaatcaaatttagcttgatatgagtgaaactgacggggtatatatatggtgaaaataaataagctatagttaaattttttttaaccagttcctgggcacccccttagctatactagctccgcccctgatcacaggtacgaatatgatgctgctgctggtctgctgccatgccatttagctcacggtttcgacgttggccagaaaaattcagagtgggctgatgagctgcaggtgcgtcgagcggcatcgggctggagacggcgcgcgtcatggcgctgcgcggcgtgcgcgtcgtcatggccgtgcgcaacgtcgccgccgggcacagggccagcgaggcgatccgggctgagatccccggcgccggtatccatgtgctggagatggacctcagctccatggattcggtgaggagatttgccaccgagtttgaggctctgaacctacctctcaacatactcatgtaagagcaagaatctgaacgcttcttctatatgtactccctcctccgtttgttttagcagatgatgccgtttacatttgacatgacgcttgactatttatctatttaaaataccatttattttgttataacttgttttaccatcaaaataatttttttagggaaaacaacactagattgtgtcttttcattgagtatagcagaagaaaaaacaatccttagaagcaagaaaagtgaaaaactttgtacactttaaaataacttttaaggattgactcatattttttatatttgtactaaaattttttcaataagatgaacaaagtcaaatgtcatgtcaaaatttaacaccatcatctattaaaagccggatggagtattattattttgtcaacttaaataataaatttttaactgtggttataaacagtaataatgctggaatcatgacaaggaactgcacacgctccattgacggcctggaattgcaatttgcaacaaatcacatcggtacgagaaattacacagcatttcttcatgcatctcaatcttattaacggattagctgcttgagtgatttggttaattcttgagactttctgggttgtgagaggatgctcatagtgcactaactgttgacttgaatgacaggccactttcttctaacaaatctcttgctggagaacatgaagaggacaagtagcaaaactggtgttgaaggaaggatcgtaaatgtgtcgtcttcagcacattttgtgacctatcctaaagggatatgtttcgataaggtgaaggagccttcaaggtaattaattctgagattctaaaaattaggactggacaccccattttcgtatatgacacatactagatatcatatggataataacaaaaacaacccaattttacattagtgggtagtgcacaaggagatgatttcctgctgtctgtgggagaactggatgatctattctttttctttgaattaatgttaaatttttgactgtttaatataagaatttttggctttttatcatccaaaaattagcgtaaggtccccttatcaagggagctccaattagtaaagataagtatatttattacgcagtatgcactcaacttattagataatattaagcacttaacttttcttaccagattcatcagtcttattgcttatggccagtctaagcttgccaacattttgcactcaactgagctgtcacgagttctgaaggtagtagcttatgcctaaatttcgtatgtaatctctgatcatatatattatatgtcaaatcaatggagaataaccgggaaaccgttgagtatgaacaggaagatggtgtgaacatttcggctaatgcagtccatcctggtgttgttacaaccaacctgttcaggcacaggactattataaatggtaattcccaaaccattcagaacaaaattttggagtgtaattagaattttggaacaattagtacttgaagaagcacatactccataatgccaatttaggatgatccccaaccattttgattactggtaaacacaacgaacaatgctgcttataaatataatatttcttaactgttcttgtgcattggttctctcttgcagctctagtgaagtccattggaagattcgtacacaaaactgtagaacaggtgactttttttaaaaaaagtatatgttcgtgcgttgtaggtgtggaacatattatgtgtttctaacctcatggttttattgtatagggtgctgcaacgacatgttatgtggcactacattctcaattcaccgggataagtgggaagtacttcagcaactgcaatttagataccccaagctcacaggcttcaaatgcagagttggcaaataaactatgggaatttagctccaagattgtgtcctcttgatgtggctatcaaattatagtttgtgttatgcatcatgtgctacagtctattttctgcaagtttgaacataaaattttcacataaacaaacaaagagatccgtgcaattcctccaagactagttagaacaatctgaattgtaatatatccgcctcagtttagtttagaagttcttcctataatcatgggctggctctggctatgtatttcttaaactaatgtttggactttggaggcccacctcacctctttatgtaagccttacgcttcatggaccaacactccagtgcttctactttcctaaaatttacataaacactgagtagatgtaacgtgcttgtgctgaggtattggactagagatattcttttgaggtgccattgctagtatagtgctaggtgtgtcatgtgtgtggattcaatcctaggatctcatgtttgactcacattcacatgtcttattgattaattgacagataattttatcattcttaaccattcacaaggtacaggagatatcatattttctagtgtaaaatttaatatctctagatactaggtattttaatgtgtaaaatcttaatactctatgtactttctgaagtaccataaaatttcttttaatcgacaccaagcttctcctcttgtgtccaacttgtttttaaaatattattttacttaaaatgggcggtgaatagtgattgcttgccccttcccttgcttcagaatttgtgaagctcaggttggagcaacctaaccttaattgtgtgcatcaccattccctaagtcaaactagtttgcctgcaaattcattcagacaattattttaccaatcttggtgctaattacccttgacataagaactttccatccatagaagttaaattaatctattgctatgacgcacgtgctttgttacggatatatggaagaatctatatctacatccatctatctatacctaattaaaaaatacgtaagacttccggaattattttgtccatcgtcatcgtcatctgcacactaattgattttttttaagcaaaagtgtttgcttgtttagggtagggctcgattccgagctcgatacgaagcggatttgcttcgattcttaggaaaatggaaaaagaatgagataaggatcggaattccctcaatcggatttcatggaggagacggcttccggcggtgtcaagtagctgagagactctgaacgaaggtaagggataacactttagcaatgggcccacgcgacaatgagaggaggaaaaggggataccgattagactttcagttgtttgttgggccggatgcatgcttgtgagccaaggcggagggaaggagaagggaggaaagcaggctagcttggctgcgggctgagaaagaaaatgggctgaaaataacccagagataaagaatggttttttatttatatttttatttaaataaatgttgaaatgatatttgtattaataaaattagcacttgagctctaaaaattctaataaaatttcagatagtgtaattaatcacgaataatttaatcaaaattaaatccagccatgtcattttatttctcacacttactttacttgtaaattaattttattctacacctacctaattaaaaaatacctaagtattccagaaaatttgtattttagttaattacataatctaaatctttctcaacttttgctcaattttctcgtcttttcttcccgttgcaacacattggcacattttctactatatattaaatattatataaatgataggtggaattgagctaaaatgctatgaaaataatgtgagtaatgatgattcagaatgcttatatgttaagttttagatttaatatgctatatttccatattaaactttaagcacttagtgggttggtgtggtatgcttgtaaattaggctttaggatgtacatataattactatgcttttatatgttgagttttaggcgcttagcagattgtaagaaggtaaaatttggtaatttgactttttcaaaaacttattataaaaatgaaccatgccaaaaagaaatcaggaccttaacatcatcgggttcgacgcggagatccaacatcttagcgccactaattttgacgctaacatctcatccgagaggtgacacatatttgctatatttatcataggttagcgccatccctactagcgctagcctctatcatgttaaattgttgtgcaactttcagcctagatgatgttcaacctttatctaactcattttttgaataagttttttagcgcagttgactcttataatgagtttttaagaagggccggattgtcaaattttcggtacatattggcgtctccatcgcctgcagttgctcatccatactgcaaacatcattattaatttctgagataacgtcgactgctattcttcttggtgacccatacctgcagcttagctgtagctaaacagaagcacccttacggaaaaaaaaacgaattccaaataccttgggcaaatccagagagaaaaaaaatccggctttaaaaagcattctgcaagcgaatttttggaagcaaaatggaatcattcctccctccatctaaaaaagataacctaatacatacactacgataaatctagatataaaatatgtccaaatttattatattagaatatatcacatcttaagatgatgctattttttttaatggagggaggtacggtatcgaactagagcttattcggaatggagaagaaacacaggaaaaataaaagattttggttcctatggattactttactgtgacgtcattcggatcacaggaaaacgttcgtagaaaatacatagggaaaattcctgcgctagccatatcagtggaagatcacaggaaaaaaaaatccacgctgacctcttttttctctccctccgcgtgggaacgaggcaaatcatgccatcaagcaactaaagcatactattaggttgattaatgttgtttaatttactagtagcatgtgataattttgtaatagtgcaccttttcttaaagattcctatgtttttactttactccatccaaacacatattcacatgaaattcctatgttttcaaatcctctgttttatacttacatttttatcatattctaatgtttttcctattcctatattttttcaatctgcattccgaaggagcctactgttggccggtcgttgtactacatcatatgctatgaatgtgactgtcagaggctcagaggcatgcattaacattagtagtatttttagccccaacttggattgcaaacgcctgattccaagagctcgccggaaccgcggatgtggtggtagctgaacagaaaaccagcacccccctcggctttacttctctgctctgttcatcggctgtgtgtggtgttcttatcttattgaagtcttctgggaatttttggcataaaaacaatatctttagtactttggtagagtaacaagctgaaactgctgtggccacatcacatggtatcactgtcagagtctgaccatataatttcaggccatctggtgccgaagctgaactcagcttgcaaacaccagtacgccatacggagtcggcgatgtggcggttcaaccgcaaagggccctccggcttctccggcgcctccaccgccgaggaggtcaccgccgggatcgatgcccggggattggtcgccgtcatcacaggtacgatcgatcatatgatgctgccgtttagcctcagtgcgtgtttcaaacagctaattgatatatcgattagtgccatgcttttaagctaatacggtttaagtaacttttttctagcctttttttttttctgaactacagtgtttgttagctgtatgatttttagtttagccatacagcatttcttagggactcaacttcaaaaaccgaatataactcaccctcaacttctaaaaccgctcaatttacatcgctaattccagaatgagaatgaggtggttttcatctgactgacgatatggtggcaatctagtcatcaaagtaaaaataaaaataaaaaaatgtcatgttcattgtgagtagcctctccctttcttttcggtctctccactgcatacttcttgagagaataagtcaaatggtatatttatataaaaaattaatttgtgaataaaacgtttatgtacgttttcttagtgacctaaaatcaaatgttgaaaaataaattttcatgaaaaatattttaaaatcaactttaaatttaaagtttaaagtttggttgataagtataagtgaaaagatgaggttgcacctctcttgagccgccgactaccgcgcctctctactcgtcggaggttggccaccgccgcgcctcttcttgacctctctacgcacatgaattttcccctaaattctcccaccgcccgcttcgcaggagagggcgcatgccgcgaagacgccagaacagacaagaaaacgaacaggagaagggcgaaaaaaaattgaaatcagatcacacgaagatcacaagaacaggtaagaacacggacaggttcatctcaaccgatatttcgtcgcaagtgggaatcagagaggaaaagtaaaaaaagaaacacacacacggccacgcggccactcgggatccctccccatctcgatctctgccatctaccggagaattgctattaaagaccgtagaattg

SEQ ID NO: 43943 - DNA, 7505 bp, Oryza sativa
  unsure (1)..(7505): unsure at all n locations
nnnnnnnnnnnnnnnnnnnnnnnnnnnnnnnnnnnnnnnnnnnnnnnnnnnnnnnnnnnnnncatctatagccatataatagctaattcatataatagctgcttattatactactaatatctggtcccacctatcatacacacattatgtcttagagtcagtgctgcagctagctacagatttatagcctgatgctcttctctttctttctttatctctttaaaatatgtttacatctgacttataacttgctattgtacctgctctgggagaggggccggctgaggacaagccggcaaaggatatctcccaatatgtgaccacgtggtcaaaaccactctcatctcatcgccacataagttaaaaccacctcgatcttatacataaggtagctagagatcgtcccacaatttcttattctttatttcattattgagtgactcattggttgtttgttttatggaaaataatagcaaaatactcatagtctgttatgataaaatgtacatactcatgtgtgtgtgtatatatatatatattgttcacttgatttaaataaatattagattattacatagtattagaatatatcaagaactaacttgtaaggtggtggattggtggtagatatcagttaaatgcctatatgttccaacgggaattaataaagactttaaaacctcaaacactaaaataaaattatccccattgtaaaccatctataatatttttcaccattttgtatctcactttaaaataaattttccttgtttgatggcttctggttaaggaagggataaaagcctacctatctcactattcgggggaccaacatggtaatgatggtgggtagtgacatattcagatataaatatagatatagatatatataatgcatttctattactaaaagtttcaagcatatttttctgtcataataatatatctaatcgtcgagttagagtgtttccttgctcatctatatctatacctattataaaaattcaatgtgtttttgcatgaaaatttgatacatcatctatgttagaatcggttttaattaaatatgtttccgtatcagaatgtttgttttatctgtattttggtttttttccccttggcataaaaggggtgaaaaaaacgtccgtaaaaaaagaaaaaaaaagagcgaaaaaggtcccaaaagaaaagtccgattccctgcgaaaaaagtcgttcgtaaaaaaaataaaagaaagcaaaaataagatctgattctatgcaacgaaaaaaagaaaaaaaagaaaaatacgtaaaaaaaagcgaaaaaaaggccgtgaaaaaaattatatccaaaaggataaaaaaggctaaaaaaacaagaaaaataataagaaaggcaaaaaaatatgcctttcaaaaaagaacaaaacatttccatcataatctttacctattatataaattaaagataatttcatactcatcgtattttcggccgttgtcctttcattttaacgaaccgtcctattccgatttatatatgtttttagcgttgtgataatattcacgttttgctttttatctccacatccaatatgtttctgcacatatgggcctaaaattgtaaaagggtccaaaatattgcccatctgttgacgcgaggctgtctcggtgaaaaatattgcccatcttctaagcatatgtcacatactatttatttcagatttgtttgtgtttattttaataattttgcacacatgcaaatgcaaagcatactaaattttgtatgggcggctttcatgcatgtccgtttattttgtaaaagattcatctacgcatgattcttttcaacattattttttcaacatatgatttcgtacggctatttaggattaagtgatttattattaaaactgaagttgtttccgccggtagttttggtacgttgtgtgtatttaagttggttttaaaattcgttcgcttttaaaaatgcaatggtttaaacttggatatcaatctcaaaataaaaatcacatatacttttttagaaaaaaaaatatatctaacaataatacgattaaaattagtcttcatccgttgtaacgcacgagcttttttttctagtaaaagaaaaagaaaaaggacggttgcaacgttgatcagagcgagagctaattaattaacgagaagcgcgcaggtgcgtcgagtggcatcgggctggagacggcgcgcgtcctggcgctgcgcggcgtgcacgtcgtcatggccgtgcgcaacgtcgccgccgggcgaaatgccagcgaggcgatccgggcggagatccccggcgccatagtccatgtgctggagatggacctcagctccatggattcggtgaggaggtttgcctccgagtttgattctctgaacctgccgctcaacatactcatgtaagaacagaaatactccctccgtacttataaagaaagtcatttaagaaaacgacacggtcttcaaaacacaactttgatttattatttctataaaaatatttattaaaaaatgatatatgtatacttttataaaagtatttttcaagacaaatatattcatataatttttacattttcaaacttaacaacttgagagttattcatgatttatattctcaaggtttgatttaaacattgtcctaaacgacttcctttacgagtacggaggggtatactccatattaaagtattaattgttactgcccctgggcataaattcttcggcgtttaagacctaattgtgtatcaataacttctcaaatgcctcattgtaaaaaaaaagaatgtgtgttgttttgcctcaaagtattatcatagataatgaattttgttgtaaaattgatggttagagttttaaaagtttgacttgattttttcgcatatgtgagaatatttatggccgtagaaagtattatgattgtgtcaactctaacggcaaacattttactctgtttccaaacttcctgtgacgacagtaacaacgctggaatcaaggcatggggctgcacacggtccgttgacggcctggaattgcattttgcaactaactacattggtatgcgaaattacaatgcattaattcttcatgcatctcaatcttgtttgcctactaagtttcctgtgtgatgtggttaattagttcttgagatttaagggttgattatgagttatatgctcatagtgcagtactttaatgtcaggccattttctactgacaaatctcttgatggagaacatgaagagcacaagtagtgaaagcggtgttgaaggaaggatcgtaaatgtgtcgtcttggtggcactttgctatttatcctgaagggatatgtttcgataaagtgaagaatccttcgaggtaatttataaatatatactacaaattaggtcttatttgtttcagcttaagattattaaatataatctagattattgagccagattactataagttagattatgataagctaagttgttagctatttgtttttttattaatagttgttagccaccaaataatctaaaaaaaacaactttagagtgtattaccatattacagtaatctgacttatagattataataatctatcataataaactatctgtttgtttcagcccacttctaacgattcaggttataataataataaactgaatcatacaaggccttaaatacctccctccatttcccaacgaaaaataataataatcttccatgcccttatttgttcttaacagtataagtggcgtcccaattctaacaaaaataaccccttctacattagtcaccacccaagtgtttcacgtactactgctgttgctattataaatacttcttttgaaaaaaaaatattggcaatttttcaaattataatcacttaaactaaaggaagacatactccgcacgttagttacaacttgcaaactattcattttatattttggaattaaaatagtataatataaaatcgagggtccattatatttataactacatatttaatttgaattttaaattattaattttataaaactaaaactaaagagataatggtatttctctatgcatgttttatttcacatgaactctgaaaacaatttatgattttggagatcttaattttaatatggatgctctctcatagtgctcaaataatataaaataatatagatatagagatgaaaaatattttgaattgtttcatatatcccgcagcaaagcgtagagcttcatctaggatactccattcgttttacactataaatcgttttaactttggtcaaaatcaaaatgctctaagtttgaccaagtttgtagaaaaaaatattgacattttaaccctaatacaaatatattatgaaaatatgttccattatagatttaatgaaacttattttcaatgactcttttttcccaacgtgtaagcatgtgtttggtttggggacaaagtgggatgtgttagacctatccttgttttgtgggatgggatgatttcagtagtttgtttggtttacggtatgtgatggttatagtttttatttggtagaagggattgaggtgggattggatgaacgaatttgtactgaccgttaatgccgtttgggggtggaggagctcggcggcgcgagcagaggagaggtggtggcgggtgcggacgagcaacggcagtcgaggaggcgaggcggctcctggatctgagaggagcggcggcggtcgcggaggtggcggcggtcgcagacgagcggtagcggtcgcggtcgcggaggtggcgaaggacgtgaacgaggcggcagcgctcacggacgagcgacggtgcttgcgaaggtggcgaaaagcgcgaactaggcggtggcgctcgaggacgaggtggcggttgtggacgagcggccgtggtcgcggacgaggcgggggagggtgcggacgaggcggcggcgctcgcggagatggcggatggcacagtgacgccgttcgctcgtcccaggtgggacgagttcgtccgcgagatttttacggatcggttggtcccggatctgagagaaatatttctctccagagactaacccatcccactcacttctaaaccaaacattcctaaaaataggttcactccatctcatccaatccttcattgcaaccaaacactacctatcctaatggttcacttatggtcaactgcaatattttgaccatccaaattttctttgtttgatttggcgtccggcgtatgtgtagttgtgcctacatagaaaaggagatgctttcttgcaatcgtttagagaattggatgaccaaaatacttttgttttagcctttgagatctaatatatgggccatttcggctatcaggagttaaaaaaaaatcatggtctttcacttgttaatgatgaaatttgtaactgtatttttattttgagtgtaatgcaggaattttaactttttaccattgtagtattaacgtgaggactttaaggggcctccaattagtaaagataaatatatttattgtgctgatttatcttaccagattcagcggtatttttgcttaccctcagtccaagcttgccagtattttgcactccactgagttgcaattggcacgaattctaaaggtactagtgttgttatttgcttggcgtgcttatgcctaaatttcatatgtaatctctattcgtatatgattatatgtcaaatcaatgaatgctaagtttgaaatggttaactacaaatagggagagggagacggtgttaacatttcggcaaatgcaataaatcccggtgttgttgaaaccaaaatgttgacgcacaacaatattgctaatggtacttcgcataacttataatatacctatgtttataccattatattatttttaaactgttcttatgcatcggttctcttgcagctctagtgttccccattggaagaatcgtacgtaaaactatagagcaggtgactctttaagaagaaaatattatgtcgttttttatgttcttgcgttatgtgtgtgtgtggggaacatattatgtgcttaacctcatggaattattgtttagggtgctgcaacgacatgttatgtcgcactacatcctcaagtcaaggggataagcggaaagtacttcagcaattgcaatttagatagcccaagctcacatgcttcaaatgcagagttggcaaagaaactatgggaatttagctctaaggttgtgtcctaatgtggttattaaagtatagtttgagttacacatatgaatacatatgctattttatttcatgtaaattgaacacataattttcacatacattctaaaagcaaaacgagtgtggttcctccaaaatacatccaaattaaatgttttaactataatatatacatctgcctctaattagtctagaagttgggtaaatagacttcaagcaaagttcaggttcaaaagtagattttataatccatttttgaagtcaacctttgctcgaagtctatttttcaccctgaatttatgaaggcggttttttgcgcatagtactcttatggtatatattttgttaatgatgatcacctaagaccccactcagtgtagatggaccaataggttattgatacggaatattttccccatgtttaagaaaataaaatttgtccaaaaactttatgcattaacattgcttagaccacttgttctgagttatttgtctgtaaataagtagatcatccatttaatagccttcatcatattttatctaattaatcactatcatatgttagtgaaaaatcactatcatatcaatctaaactaccatgaaaaatagtttatagtgtggtttgtcctttctaaaattggagatgaaaaataaccggtattgtacttcgaccaaagattaagggcgacatatggattttacacttacgagttattcctagagatgtaatatgcttcattctttagtaatgtggaggcccacctcttctaagcctgatcacttcattggccgacatttgagtgagtcttcattaagttatggcctccatcgtttcctctatacaaaatcagccgctaccaaaaatttaaattttgaaagttaattttcaagttgatattaattttttttcatcgaagtttatcttttagcattaacatttaaatcgctaagaacacatatattataaaagttttacatacaattttttttgttaatatgtctgtcagtgttacatataagacatattagcaaatacaagaccacccgggaggataggccaagacaatccaacatacgccaacacagatctaaacaactccaataatacaagacaactccaatctcaccgagttcatattcgaggaaatcgattgtcgctcgccgtcaaccacatgtgagggctttatgacgcaaggctgacagagactagattagatcatcctcaatattgtaatcgtatgatattgatatataatggcaatattagctttggcccgtaagaaggggtccgaacc

SEQ ID NO: 43944 - DNA, 11102 bp, Oryza sativa
  unsure (1)..(11102): unsure at all n locations
aacctgtataaaaaaattctcgtctctcgtctcttttatcatattctcgtgtatgccttggtatcaacgatgcacatactatcaaataccgtaagtaggaatagcccatcaacaatatcgtacaacgtatttttagcatttggccaaaagatgagggcctacacaaatttggggtgagtgccctttttacctgacccacttgtgtacatcaccattaattctttcacgtcaaactagtttgctcgtgtcactgcactgatcattcagataattgttttacatatctagcttggggttaacccggcctttacatgagaactttccactagtagaagtaacatttatttattacaggaaagatcatgtataccagacatgaaactaacttctggagtgtggatgtttcaagagatgcatgcagtgccatgtaaagttagctagctaccctcaagttaaatagctttattgtggtgtagttagcatacatgtctagtgataaaaagtgagcatcaacagccaaagcccaaaagcattgcctagctagatggaaaatttgttgtcacaatgccattgtgcaaccaatggcaaaatgtcttgtcaggcaattaaaaaacggattgatggatggccattggactggccaatactatatcatcctcagcacatagtgcaagagaatgataattgaaaatgaaggggagaaccctacacatttgttttattcagaatatgatataaatctcgcttttctcaacacctttttccttaaagtacgacatgagatatatagggcatgtaatcaaagatatttcctttccttgctttttgttttaaaggaagatttttttttctttgttgagatcattggtaaattagctcaatgcacttatttttgtgtaaggaaaatcgagcaatttattaatttgttttgtggccgagttgccacaagttcagatgtatatctttcttttgagaaggttgacaaattgagttaaaagttagatactacttgactgaaaaataaggacaaatggattaaagcaagcacgatctttttttaagaacacaagaaagatcttatcaccggcatatatgcttgtagtcctcattgcacattctatactaagatacctgtgtatatgcatgctttttgtaaaggcttaaattgcccccagtagttactctaaaatgattacattatttcaagtagcagattccctacaattttcctatgatacatccgaatgcaatttttttttttttagaattcgtgaggtttagcttcccataggattggagtctatagctatttctattcctcctttttttctatttctatggatgaaattttcttcaaaatgaatagcccttagtatttagtatttgcaatttttgggaaaaaagatgaacggttaatgttttaaaatgaatagtgtccagcgtcagttatttgaaaaatggagggaatatttaagtttcagactggtcgagcttaccagctggaaccgatgcaattccaattaatcctctaattgattaagattcctacctaaatcctccatttcaacagcagagacttatcaatttatcactttctttatgtcacctcacacataccctgccatggttaagcaaaactacaaccgtacaaggtcaaaatatctagtctatatatcattactacctgactacatgaagatcattatatacattaacagcgatgtgtatactatggtttgacaagtacattgctaacaggacgaatgttggaccaacacactagctagatgatgatcttgacaagtttttttttctaaattaaagttgtttttcagttataagaaaaatgccaacttttttatcgtttcaacgcggttacattgatcaaagtagctagcagacaagtattgtcaatttgtcatggttagtgtaccgtacggctgtcaaaattccaccatcttgatctatctatccgactaggacaccaccaggcaccagccatggctgcaccagcagaatagggttttttgaactgtattgagtgcccaaccgacttgttggacacacatatttgtaatgtttttatttctttcacttagcataagagtaattacacagtaaagctaagccacacagccacgcaatgtgccaagaacctaacatattttgcccaaacatataaatattcttcactgcatatacatcttagtttgttactcgaatgagtgttcttctccctttcctttcctttttccagggaatagattctaaactctccagagaagatgtgccctcgttttcttataccatccaaatagttatatttcttttttttttttgaaaaaaataacacaacagattctatctagattcgtagttctatgtggtgtctaattcagtactagattgttatattttaaaacagaggaatatgtaatatatcactccacaaacatataaatttaaatttgaccgctacaattaagttgtaaaaaaagaacaaactaaattattgctagtatgcgtatattcacatttatatttattttgttttttttacttgtagaaatcaaatttaagcttccatgcatgtttgtggagtgatgtatcatgtattaatctattttttaatttttttcataactatttagatgacatataagaaacaagaggacatcctcttaagggattaaaatagtatgccccttttttcaccaccttttgttttaatttcaatatataaggtgagtacttttgtactataaagagcagtaagtacatttacttttcaattccatataacatttgcttttcaatttcatatgctaattgtctagctagtgtgtatatataactacatggagaaatatatagggagtggaatcaagaggggaccaatgcacaacactctagctagatagtataagtcgccatctttgatatatctttcttattcgtacaagtggccagcataggaggtagagagctgttacgttggtgtgaccctgatttaatctgatcaatctatctccactgagtgcacgcatgcatcattaatctcactaagattaattaggagacgtaatatgcgaatgaattaacaaacgtacggtcggcagaggccgaagatgtaacccattttcgtaaccattgaaagaaaataatgttagagaacaacatgcctagctaacttaaatgtgcaatctagctacgtacgcactaggcaagatcggttaaacaaagagggagcaaattgacaagtgcacaaagccaaattaactttattaaaagttcaaaactgattgcaagtttggagcaatgaggtaatccggcatgcgtacttgagtcactagctcattcgctagtgctagctttgttgctatcaacttcattcaaacagagaccagctggcaacagggatacagtacatatatacatgcattctgctgttcatttgccttattaccatgcaccaatataatgcatcctcctctctagcttatcataagtactaattaactaattatcccagagcatggcaccaatataattgatccacttgagaccaagcatagtgtacacttgaacacatgcatgcattggcatgcacatagtacggcttgatcacaaacttaatcatcatactagcttccttggattaatatgatcatatcacatcccttgtaatttgcatgaattcttgcatgctcgatcattctgccttcttctgatcgttgtagatagtagctagccggattatattaattaattaatttaatgaatactagatgttgatcttgccgatgagagggatgccgatggcggtgacgacgagggtggatgggagtccgaagatgacgtggttccagaaggtgaggtcgtaggcgttgcgcgtcgcccgcctcgcctgctcgcacacgatcaggttcgccgccgaccccagcagcgacaggttccccgccaccgtgctcacccacgccagcagcagccacgaccgcgtcaccgccgccggtgatatcgtcgccgccgccgccgccacctcatcccccatcaacaacactacacccacatatataaattaatttacaattaccactcaaataacatgtaaaaaatgagttgttcttttttaattatgagagacaaaaaaaatttttttcttttaataatcattcatcttattaaaaaatataattacatttattttattttgacttgatttattgtctgatttaatctttttatatttacaaaagaaattgaataagatccattcatcgataaaaaaaagtcagatatcatgtattaaaagaaactgatgtactgtacagtacaaatgttagtgctgggtgagtcgggacacattgggtactagcaatagcatggtgcgagaaaggttgtgagtaagtacgtaccggtggggacgttggaggcgaggttggagaggaggaggatgatgacggagaggacggtgacgccggtgacgtggttgatctttgagtagggcgccatcacgttccagatggccccgggtagccccgtcttgttgaacccgctcaccgtcacgaacatccccgagaagaacaccagcagcgagtacgacacctgcatcatccattcacatccacgcacacgtggcacccagttcacatattgcttcttgtccgcatggccgccacgtgtacttgctcgtgtggcctagagttatagtgatttggacggatatgggttaccttgtcgaggcatggctcggcgtcgcggaagtcgacgacgacgagggcgatggcggtcgtgatggcggtccacgacatgttgaggccgagcatgtaggcgacgagcatgccgacggtgaccacgtacgcgaagctcttgaggaacagcttccgccggtgctccgagcactgcatgaaccaccggtgcttcgtcgagatgttctccgacatcatcgactcggcgtcgccgccgtcgtcgtcctccggcgatgcgggggtggcggcgtcgccgtcgtctttcttgttgttgttgagcgccgtgcggcggccctcctcgatggcctccatctgcttgccggcggcgacctcgtcggggctgcaggcgccgccgtcgagctccttccagtacatgcagagcagcatgagcatgttgatccccatgccggcgagcatggcggggaggatgccgaggaggaaggaaataaaggagatcttgctgttgaaggcgatgaccaggttctgcgggttgccgatgggcgtcgcgctggagccgatgttggcgctggtggcgagcgcgagcaggaacggcttcgccgggaggttgcgctcggcggcgagctcgagcacgaactcggtgaggacgacgcagcaggtgtcgttggtgaagagcgcgctggcgagcgcggtgacgacgcagacgcggcacatgaggtcgcgcccgccctggctccgccacgccagcagccggcccaggtgcctgaacatgccggcgttcttgaggtagccgccgacgaccatggtggcgaagaggaggcccaggatggggaggtcgatggaggcgtaggcgtcgtcggcgctgatcacgtggaacacgatcatcagcaccgcgcccagcagcgcccccgccgtccgcccgatcggcaggaacggcaccgacgggaacaccgccagcatccagaacacaccgaacgccaccgaccccatcaccaccttcggcagcgacgccagcgccatggccgcctctctctctcactacaatgcagctagcgtcttggagtgggaggtggtggtggcgattagagtgaggaagagaggcgactccccgtgggcttaagtactcccagccaggacgaacagctggcatcagttgcagctgatgtcagtgtccagctaggtaggcagatgattacgatccagaggcaagggcacgtacatttaagcacttaattacatgccattcttttgctaattttttcctttttatcttccagatggtaatcttgtaactttttctactatatctatataaacttctactccctccataaaaaaaaggcaaaccctaagttttcgtgtccaattttaactgtccgtcttatatgaaatttttttataattcgtatttttattgttgttagatgataaaacatgattaatattttatgcgtgacttatctttttaatttttttcataatttttttaaataagacggacggttaaatgttagacacgaaaaccaacgtttgtcttttttggtacgaagggagtagattgtaatcttataatttttttctgctatatctatataaacttcgcctgtatggtgcgagtagttagttttttacctaattgttataatgatgacattaattagtgataatgttaattattatctaanactgtattaagtaaactacaaancaacataatagtatgctgtttgactactactgctactccatactccttttaaaggaaatcgtcttgggaataagggagtacattcatgtgcagcagcaattccgtaacatttatgtgatactactagctactattccgtactacacatctacacagatgcatgtgtaacacatcatctatgtagggtggacacgtgtacgtgcaggattcatccttagccacgactggagctaagcatcgatatgggtccatgggtcaacgtgtcagtgtcatcaaatgttcctgtccggttcgtgtctgcgaagagaatgtactgtacgaaaaatggcggagcacatgcacgcagtgatctctctcttacccgttgcgagtgctaatttcaggttaagccttatctaaataataaacaatactgccgtataaattaattagttaaaagtattaaccaacttgctaagcaaattgtcctttattttactttatataggagagcatatcaacgtcgtcagacaagttttagagggatttatttacccgactatatgtatttaaataaggagaagaagataaatttatggcttaagaaaatacctcaagctatttgctccgttcattttaattataagtcgatttgactcttgtcaaagtcaaactataagtttgactaattttgtagacaaatataataatatttacaacaccaaattaagtttattaaatctataattaaatatattttcataatatatttgtcttaagataaaatataactattttttttataaatttggtcaaatttaaaacagcttaactttgactaaagtcaaaacgacttctaatctgaaacggatggggtagtaaccaaggtttacataaaaaaatatacctcctaatactttcttaaatatgataaaattaaagtagaatgcatggagaaaaaagccgttgctagcttaagcgtgcaccgccatgaggccattaggatgaacaagtgatgatcatctgatcaaaaggtggcaaatgcttattacattttaattactagggatatgtcataaagcatgattaattagctagctagcttcctgttcgattaaacatgaaagccatacacctatatgctttcgtagcggcgacctggttggatcgatggatctagccttcacgactagaaaaagcattttcgccgatgttgggtattaattttcacaagtggatatgatccttagaatcaaatagccacctacaaaaatataaattagggtgaagttcactgtctattttcgcaaacggaccacttaagccgtgcctgcaaaaatgattttcgcaggcggaccacatgagatgtgcctgtgaaaattagcgtggtatatatacagtgacacatcggctgatatttttctaagtgtcatttctcccctcactcacctctcctctcccctccccttcacctccccgaccgccggcggaaggggcagacgtgcacgggacggccagcggctggcggcggctcccctcccccctccctcccagatctagccagaggagggacgggggaggccggcgggggcaacggcggcgactacggcacggggcggcggcggcgacgacggcgcagggcggtggcggctcccctctccccctccctcctagatctatccagaggagggaggggggaggccagcgggggcagtggcggcgactacggcgcggggcagcggtgactatggcgcggggcggcggcggctacgacgacgtgcggggccacggcggcagctcccctccccccttcctccagatctggccggaggagggaggggggaggccggcgggggcaacggcggcaactacggcgcggggcggcggcggcaacgacggcgcagggcagcggcggcggctcccctcctccatccctcccagatctggccggaggagggaggggagaggctagcgagggcgcgacggtgactacggcgcgaggcagcggcggtgacgacgacgacggcgcggggcagcggcgacggcgacgcccggcgcggctcccctcccctcccctcccagatccggtcgggggagggcggcggcggcggcaaggcgcggccgcgttttttttttttcgttcaatggattttcgtaggcgggccattatcccgactgcgaaaatcgttggactgcagacggtccaacccccgcgtaaaaaaatcacttttggtcgcctgaaaaaaaatactttttctactattgcttatggccagatccggtgacctcgcgtagtaagcaagacggtaacggcgcgcgcaaaacaacgtcaggcttgttgccggtgccgaagatcatgaggcgcgacgttggatctaaggtctaagagcctcttattttcttttgttattcctcggttaagtctaagtgtttgctacaacctttagctgttttatatccacatatagatctagacgctggatttctatccatttctttttataaaatacacctgtgcgctgctgggacagcttcagaccatagctaccattccatgatcaacacgtatatataagagcaggataaattaggtcacagccctgtaaattaattaattaatctgctcattttgcagccctgtaaattaattaattaatttgctcattttgcaggatgctttgctttgtgataagtatattattatgtaaaaaataagttgtccaagagatcttgtggttacacgttcctttctcgcggccttttgacttaatgaaattaaatttctaagatcttctggtcgatcaccgtttcgttcgtgtatgcatagcttaagcaaaatttccacttcagttttacagtctgttagttcttgatggcaacttgcattgtcattgttaatttacactgctggaagaccagcaggtaagtgtgttggttcaaataaagtctggtggaaaatgaacttaaaactgtatattattcatatctattactccctctattttaaaatgtacgacgccgtttgatttttttataacgtttgatcaaaggtctgattaagaaaaaaattaatatcatttaacatgtttatattataaatttttaataagatgaatgatcaaatgttatagaaaaacaataacattttcaaaaggaggttagtactaataattaacttgatatatgtatatcagctatgtcttagatggtgccgcgagatcgtgagactcaccacggtctcgcggaccgagggtgcaaggccgcgacttcacatccgaactagtgcgattaatcattaatagattaattagcatcattagcaattaattaatttattgttatttctttaattagcattattagtaatcaattattcactaatcatgataacgaattacaatcattaatcatttccaaaggggtgtcactgtcatcgtttgaccctgttgaggtcttgttcggttacacaaggattcgttctgggtcagaaatgatatgtataacaagaaatttataataggtacaacaagagaccgagatttattccaggttaggaatcaatttaatcgtattaggtataacaaaacatccggattagttccacacttcttgactagtggattgattcccggtctcttattctccctatcatgaataaattggttcctggcctggaataaatcccagtctcttctcgttgtatctatcataaatttcttactatacttgtcattcctagcccagatcgaatccttgtgtaaccgaacaaggcctgagactgctcgaaccgcaacacgtcgtcgtttttcttaacggttcagtgatatcgggtcaattttacactcccatacagcgacggcagtatatttgtgaaaaaaaaatgtatcccggatatttctgagaaaaaataaacagtatatttttaaatttaattcttttcttggcgggtattactatgatcacaaccaatgtacgtgctattatagttgatagatatagattgatcgtagtggtttcgcgttgttacttgaggtaggcaccgctaatggatgtcaatttgctcttgaaaatctggatgctagtatcgatcaaatcttttcattgagctgatcatatatactgatccaatcatatctcggctaagaaatataatgcatgcttggtcatccctaaggttggagatattttatacaagtcggcacacatcaagctagtcacttcggaaatgaacacaaaggcttcgttccgaacatgagaattccatcatatacgatgagaggattataattgtagagcatgattcaaaaagacgctagacgctaattagacgactagctaggtgacacctaggccagaccaacaagttaaatttaagatattaagaaccatatcacatatataataacaactaaactatatatatagcacgaaaatagcaacgaaatatcaacaaaggcagtttagccgtctaatgcatcatctaatgcctaattgtgtggctacccgatgcctagctagcaccaacttttaaaacattgttgtagagagcttgtttcaagatctacaaaataatccatgatttttttatgggcacaaaccaccaaggatatagcatcaaagccatcaagtaatatattttgtcagccaaccgagtaatacccgccaagtctaaagagcaaggaaaattttattttcttgacggctaacca

SEQ ID NO: 43945 - DNA, 1866 bp, Oryza sativa
  unsure (1)..(1866): unsure at all n locations
nnnnnnnnnnnnnnnnnnnnnnnnnnnnnnnnnnnnnnnaggaaataaaggagatcttgctgttgaaggcgatgaccaggttctgcgggttgccgatgggcgtcgcgctggagccgatgttggcgctggtggcgagcgcgagcaggaacggcttcgccgggaggttgcgctcggcggcgagctcgagcacgaactcggtgaggacgacgcagcaggtgtcgttggtgaagagcgcgctggcgagcgcggtgacgacgcagacgcggcacatgaggtcgcgcccgccctggctccgccacgccagcagccggcccaggtgcctgaacatgccggcgttcttgaggtagccgccgacgaccatggtggcgaagaggaggcccaggatggggaggtcgatggaggcgtaggcgtcgtcggcgctgatcacgtggaacacgatcatcagcaccgcgcccagcagcgcccccgccgtccgcccgatcggcaggaacggcaccgacgggaacaccgccagcatccagaacacaccgaacgccaccgaccccatcaccaccttcggcagcgacgccagcgccatggccgcctctctctctcactacaatgcagctagcgtcttggagtgggaggtggtggtggcgatgagagtgaggaagagaggcgactccccgtgggcttaagtactcccagccaggacgaacagctggcatcagttgcagctgatgtcagtgtccagctaggtaggcagatgattacgatccagaggcaagggcacgtacatctaagcacttaatttacatgccattcttttgctaattttttcctttttatcttccagatggtaatcttgtaactttttctactatatctatataaacttctactccctccataaaaaaaaggcaaaccctaagttttcgtgtccaattttaactgtccgtcttatatgaaatttttttataattcgtatttttattgttgttagatgataaaacatgattaatattttatgcgtgacttatctttttaatttttttcataatttttttaaataagacggacggttaaatgttagacacgaaaaccaacgtttgtcttttttggtacgaagggagtagattgtaatcttataatttttttctgctatatctatataaacttcgcctgtatggtgcgagtagttagttttttacctaattgttataatgatgacattaattagtgataatgttaattattatctaatactgtattaagtaaactacaaaacaacataatagtatgctgtttgactactactgctactccatactccttttaaaggaaatcgtcttgggaataagggagtacattcatgtgcagcagcaattccgtaacatttatgtgatactactagctactattccgtactacacatctacacagatgcatgtgtaacacatcatctatgtagggtggacacgtgtacgtgcaggattcatccttagccacgactggagctaagcatcgatatgggtccatgggtcaacgtgtcagtgtcatcaaatgttcctgtccggttcgtgtctgcgaagagaatgtactgtacgaaaaatggcggagcacatgcacgcagtgatctctctcttacccgttgcgagtgctaatttcaggttaagccttatctaaataataaacaatactgccgtataaattaattagttaaaagtattaaccaacttgctaagcaaattgtcctttattttactttatataggagagcatatcaacgtcgtcagacaagttttagagggatttatttaccccactatatgtttttaaataaggagaagaagataaatttattgcttaagaaaatacctaagctat

SEQ ID NO: 43946 - DNA, 706 bp, Oryza sativa
ctgctgcttctgctgcataaattcctcaatggcagaacgaagagcgagattcgggatcagctgaagatgttccagagttgattttgtcatcggggaggtgttgtgcccgctgccgagccatcctttgatggcctcctcttcgtaactgaacccatctgctgcaatgtgaggatccctcatgacctcctacaatattgtttcaaccaagctcagcagctgttagactgttagtagcatattattattccccaccaaaaaatgctgcaaggaactttaatattctacttcagcaagcataatataattattcagaaagttatatcagaaaaaaaaaatagttccagaacaacaataaaatctgagagatcaaagcatgcacacttgttaacattcatattttccctcagaaagaagttccgatctctgtccctcattaagtgtggcaacagttctcaaggaagcaactctcggtaaaaccagaacttgttttagaacagagatagctcctagtatctttaagccttgaacatgggtgatttttaagcacgagatgctgtatttctaaactaacatgccataagtctaaaaatatcaaagttaaattcagtcgtactatacacagaaccgccaacacaataacttttggatagttctgagaaacatttgcttttagataatggattaaaccggcctctacatccaaacg

SEQ ID NO: 43947 - DNA, 869 bp, Oryza sativa
gccacatcaagaggacacaatcttgaagctaaattcccatagtttatttgccaactctgcatttgaagcctgtgagcttggggtatctaaattgcagttgctgaagtacttcccacttatcccggtgaattgagaatgtagtgccacataacatgtcgttgcagcaccctatacaataaaaccatgaggttagaaacacataatatgttccacacctacaacgcacgaacatatactttttttaaaaaaagtcacctgttctacagttttgtgtacgaatcttccaatggacttcactagagctgcaagagagaaccaatgcacaagaacagttaagaaatattatatttataagcagcattgttcgttgtgtttaccagtaatcaaaatggttggggatcatcctaaattggcattatggagtatgtgcttcttcaagtactaattgttccaaaattctaattacactccaaaattttgttctgaatggtttgggaattaccatttataatagtcctgtgcctgaacaggttggttgtaacaacaccaggatggactgcattagccgaaatgttcacaccatcttcctgttcatactcaacggtttcccggttattctccattgatttgacatataatatatatgatcagagattacatacgaaatttaggcataagctactaccttcagaactcgggacagctcagttgagtgcaaaatgttggcaagcttagactggccataagcaataagactgatgaatctggtaagaaaagttaagtgcttaatattatctaataaggtgagtgcatactgcgtaataaatatacttatctttactaattggagctcccttgataaggggacc

SEQ ID NO: 43948 - DNA, 1520 bp, Oryza sativa
  unsure (1)..(1520): unsure at all n locations
nnnnnnnnnnnnnnnnnnnnnnnnnnnnnnnnnnnnnnnnnnnnnnnnnnnnnntgtgtatatatttctccatgtagttatatatacacactagctagacaattagcatatgaaattgaaaagcaaatgttatatggaattgaaaagtaaatgtacttactgctctttatagtacaaaagtactcaccttatatattgaaattaaaacaaaaggtggtgaaaaaaggggcatactattttaatcccttaagaggatgtcctcttgtttcttatatgtcatctaaatagttatgaaaaaaattaaaaaatagattaatacatgatacatcactccacaaacatgcatggaagcttaaatttgatttctacaagtaaaaaaaacaaaataaatataaatgtgaatatacgcatactagcaataatttagtttgttctttttttacaacttaattgtagcggtcaaatttaaatttatatgtttgtggagtgatatattacatattcctctgttttaaaatataacaatctagtactgaattagacaccacatagaactacgaatctagatagaatctgttgtgttatttttttcaaaaaaaaaaaagaaatataactatttggatggtataagaaaacgagggcacatcttctctggagagtttagaatctattccctggaaaaaggaaaggaaagggagaagaacactcattcgagtaacaaactaagatgtatatgcagtgaagaatatttatatgtttgggcaaaatatgttaggttcttggcacattgcgtggctgtgtggcttagctttactgtgtaattactcttatgctaagtgaaagaaataaaaacattacaaatatgtgtgtccaacaagtcgcttggccactcagtacagttcagaaaaacttatcctgctggtgcagccatggctggtgcctggtggtgtcctagtcggatagatagatcaagatggtggaattttgacagccgtacggtacactaaccatgacaaattgacaatacttgtctgctagctactttgatcaatgtaaccgcgttgaaacgataaaaaagttggcatttttcttataactgaaaaacaactttaatttagaaaaaaaaacttgtcaagatcatcatctagctagtgtgttggtccaacattcgtcctgttagcaatgtacttgtcaaaccatagtatacacatcgctgttaatgtatataatgatcttcatgtagtcaggtagtaatgatatatagactagatattttgaccttgtacggttgtagttttgcttaaccatggcagggtatgtgtgaggtgacataaagaaagtgataaattgataagtctctgctgttgaaatggaggatttaggtaggaatcttaatcaattagaggattaattggaattgcatcggttccagctggtaagctcgaccagtctgaaacttaaatattccctccatttttcaaataactgacgctggacactattcattttaaaacattaac

SEQ ID NO: 43949 - DNA, 826 bp, Oryza sativa
  unsure (1)..(826): unsure at all n locations
ttttcacttatccctatcaatcaaaatttaaatttttcaccctaaattaagagttaattttagagggtttttttatcatagttcattttctcgtctttagatttagatcatttagaacacgtacgtaaaagttttatttataaattatttttatttacaaatatgatatttgacttatttcaaactatggggctgctcatctggttgggtcaaaatcttgtttgacctcggtataacagcctcgatgtcggcccatgaagtgaccggacttcctccatccaacctaaaatataaggtattttgataagatgagacatagtactatgaatttggacggtgctatattctagtattacgaatttgaacactaagagtgcgttcggtggtaagggatgggaactaatctctcccacataaaaaaggagcgattcattagcgcatgattaattaagtattagtttttttttgaaaaatggatcaatgtgattttttaaaactgtttttttaaacaactttcgtatagaaatttttttaaaaaagcacactgcttaacagtttgaattttcaaaaatacgcaccgcttaacagtttgaaaagcggtcacgcgggaaaaataaagtgggttctcaactagtcttgccaaacgcagcctaaagtatgttctgtccaatcagattatcagaatacgttatattttagaacagatggagtgcgtggtgaggtgggatgaatctccacactaactaggcaatatactccctccatcacggatactcatcggttttgannnnnnnnnnnnnnnnnnnnnnnnnnnnnnnnnnnnnnn

SEQ ID NO: 43950 - DNA, 1860 bp, Oryza sativa
  unsure (1)..(1860): unsure at all n locations
aagtatatttattacgcagtatgcactcaacttattagataatattaagcacttaacttttcttaccagattcatcagtcttattgcttatggccagtctaagcttgccaacattttgcactcaactgagctgtcacgagttctgaaggtagtagcttatgcctaaatttcgtatgtaatctctgatcatatatattatatgtcaaatcaatggagaataaccgggaaaccgttgagtatgaacaggaagatggtgtgaacatttcggctaatgcagtccatcctggtgttgttacaaccaacctgttcaggcacaggactattataaatggtaattcccaaaccattcagaacaaaattttggagtgtaattagaattttggaacaattagtacttgaagaagcacatactccataatgccaatttaggatgatccccaaccattttgattactggtaaacacaacgaacaatgctgcttataaatataatatttcttaactgttcttgtgcattggttctctcttgcagctctagtgaagtccattggaagattcgtacacaaaactgtagaacaggtgactttttttaaaaaaagtatatgttcgtgcgttgtaggtgtggaacatattatgtgtttctaacctcatggttttattgtatagggtgctgcaacgacatgttatgtggcactacattctcaattcaccgggataagtgggaagtacttcagcaactgcaatttagataccccaagctcacaggcttcaaatgcagagttggcaaataaactatgggaatttagctccaagattgtgtcctcttgatgtggctatcaaattatagtttgtgttatgcatcatgtgctacagtctattttctgcaagtttgaacataaaattttcacataaacaaacaaagagatccgtgcaattcctccaagactagttagaacaatctgaattgtaatatatccgcctcagtttagtttagaagttcttcctataatcatgggctggctctggctatgtatttcttaaactaatgtttggactttggaggcccacctcacctctttatgtaagccttacgcttcatggaccaacactccagtgcttctactttcctaaaatttacataaacactgagtagatgtaacgtgcttgtgctgaggtattggactagagatattcttttgaggtgccattgctagtatagtgctaggtgtgtcatgtgtgtggattcaatcctaggatctcatgtttgactcacattcacatgtcttattgattaattgacagataattttatcattcttaaccattcacaaggtacaggagatatcatattttctagtgtaaaatttaatatctctagatactaggtattttaatgtgtaaaatcttaatactctatgtactttctgaagtaccataaaatttcttttaatcgacaccaagcttctcctcttgtgtccaacttgtttttaaaatattattttacttaaaatgggcggtgaatagtgattgcttgccccttcccttgcttcagaatttgtgaagctcaggttggagcaacctaaccttaattgtgtgcatcaccattccctaagtcaaactagtttgcctgcaaattcattcagacaattattttaccaatcttggtgctaattacccttgacataagaactttccatccatagaagttaaattaatctattgctatgacgcacgtgctttgttacggatatatggaagaatctatatctacatccatctatctatacctaattaaaannnnnnnnnnnnnnnnnnnnnnnnnnnnnnnnnnnnnnnnnnnnnnnnnnnnnnnnnnnnnnnn

SEQ ID NO: 43951 - DNA, 2453 bp, Oryza sativa
  unsure (1)..(2453): unsure at all n locations
nnnnnnnnnnnnnnnnnnnnnnnnnnnnnnnnnnnnnnnnnnnnnnnnnnnnnnnncatggcactaatcgatatatcaattagctgtttgaaacacgcactgaggctaaacggcagcatcatatgatcgatcgtacctgtgatgacggcgaccaatccccgggcatcgatcccggcggtgacctcctcggcggtggaggcgccggagaagccggagggccctttgcggttgaaccgccacatcgccgactccgtatggcgtactggtgtttgcaagctgagttcagcttcggcaccagatggcctgaaattatatggtcagactctgacagtgataccatgtgatgtggccacagcagtttcagcttgttactctaccaaagtactaaagatattgtttttatgccaaaaattcccagaagacttcaataagataagaacaccacacacagccgatgaacagagcagagaagtaaagccgaggggggtgctggttttctgttcagctaccaccacatccgcggttccggcgagctcttggaatcaggcgtttgcaatccaagttggggctaaaaatactactaatgttaatgcatgcctctgagcctctgacagtcacattcatagcatatgatgtagtacaacgaccggccaacagtaggctccttcggaatgcagattgaaaaaatataggaataggaaaaacattagaatatgataaaaatgtaagtataaaacagaggatttgaaaacataggaatttcatgtgaatatgtgtttggatggagtaaagtaaaaacataggaatctttaagaaaaggtgcactattacaaaattatcacatgctactagtaaattaaacaacattaatcaacctaatagtatgctttagttgcttgatggcatgatttgcctcgttcccacgcggagggagagaaaaaagaggtcagcgtggatttttttttcctgtgatcttccactgatatggctagcgcaggaattttccctatgtattttctacgaacgttttcctgtgatccgaatgacgtcacagtaaagtaatccataggaaccaaaatcttttatttttcctgtgtttcttctccattccgaataagctctagttcgataccgtacctccctccattaaaaaaaatagcatcatcttaagatgtgatatattctaatataataaatttggacatattttatatctagatttatcgtagtgtatgtattaggttatcttttttagatggagggaggaatgattccattttgcttccaaaaattcgcttgcagaatgctttttaaagccggattttttttctctctggatttgcccaaggtatttggaattcgtttttttttccgtaagggtgcttctgtttagctacagctaagctgcaggtatgggtcaccaagaagaatagcagtcgacgttatctcagaaattaataatgatgtttgcagtatggatgagcaactgcaggcgatggagacgccaatatgtaccgaaaatttgacaatccggcccttcttaaaaactcattataagagtcaactgcgctaaaaaacttattcaaaaaatgagttagataaaggttgaacatcatctaggctgaaagttgcacaacaatttaacatgatagaggctagcgctagtagggatggcgctaacctatgataaatatagcaaatatgtgtcacctctcggatgagatgttagcgtcaaaattagtggcgctaagatgttggatctccgcgtcgaacccgatgatgttaaggtcctgatttctttttggcatggttcatttttataataagtttttgaaaaagtcaaattaccaaattttaccttcttacaatctgctaagcgcataaaactcaacatataaaagcatagtaattatatgtacatcctaaagcctaattacaagcatacccacaccaacccactaagtgcttanagtttaatatggaaatatagcatattaaatctaaaacttaacatataagcattctgaatcatcattactcacattattttcatagcattttagctcaattccacctatcatttatataatatttaatatatagtagaaaatgtgccaatgtgttgcaaggggaagaaaagacgagaaaattgagcaaaagttgagaaagatttagattatgtaattaactaaaatacaaattttctggaatacttaggtattttttaattaggtaggtgtagaataaaattaatttacaagtaaagtaagtgtgagaaataaaatgacatggctggatttaattttgattaaattattcgtgattaattacactatctgaaattttattagaatttttagagctcaagtgctaattttattaatacaaatatcatttcaacatttatttaaataaaaatataaataaaaaaccattctttatctctgggttat

SEQ ID NO: 43952 - DNA, 774 bp, Oryza sativa
  unsure (1)..(774): unsure at all n locations
nnnnnnnnnnnnnnnnnnnnnnnnnnnnnnnnnnnnnnnaataccttcaacagactagctgcccagccaaaggccccagtcattacacactgccttgcccaagcaagcaatgcagaagcaagaccaaagtacgcggaatgattttgaggagccatctccaaggcagagcggaactgttcaacaccctggcattgcgtatttcccaacacgtataagatcatggaaattattagcggtagcagcagtaaagggctggcatagaatttgcaatggtaaattatacatagtgctgataaaattgtgtatatctagtaatataatagttccattaagtgaaaaaaattcctacctttctaaaataaccaagcattagctggatgtttccactttctatcaacgcaaagaccttggaaccatccagttcaacagctcgcccatacgactgccagcataaactgaattaagcatattcagaagcctcaatatagtatactgcagcattcactaatgatgctaaaaaaaagtaacacacctttactgctgcagtaaacatgcccaaacggtggtatgccagaccgagtgcctaataccataatatggaatattaattacatacaaatagcatgcctgacttagatttcaccagcattaacaaaataaaggaaacaaggggaaaaaatacccacttcccataaatctgcacatgttgggtaacctcgtattgcatactgaaggctctgtatagcctctgaccatttcttctgatgaacctaa

SEQ ID NO: 43953 - DNA, 726 bp, Oryza sativa
aatattcttgtgtgtgacttgaccttaagcttgcggtttgactgtaacaatcttgcacatattttccaaagaacaatctatccaactaaacaagctcttatgcttattcccacaggagatgtaacaaccattcatgctttgtatttctaaaccttccattaataaataaaatggcatgagtcttaaaaaagaactaagtgtgtgactttctttgcaggtgggttcatctagaaccgtggaaccaagatgcacgtcgcctccttgtacttacccttttccaaaaagcacgtgaagaaaagtatccgaaacatatctgcaccattttgaagaggctgattttgcaagttctctccagtggtagcaattcacaagacaataaggtggttcagtatgggaactacttgttacttcttgtggcttcagaggttagtttgcaatctggtgaccatggcaactgtattgctcaagctactgaagctcttggagtaacttcttcgagcgtggattctttctttgcacacttgcaactgtgtcgggcctatgtgatgcaaggcaatcttttgaactctaggagtgagtacatgaaatgcctgcaaaaccgtacagatactgaaattggctgggtaatacttaagcaacttgcatctatatgttcactgaagggtacccctgatgaaatagagatacatctcggaggatgcgttgaaaagaaaggtagcaatgcat

SEQ ID NO: 43954 - DNA, 871 bp, Oryza sativa
cggatgataatactcttaccttacatagtgaccgggcaagattcacggaaatatcagcaatatgacatctgcagtctgttttggagttgcgcatcatatctaaagcaaattttgcttgtcggtacgatgcaattgcagattggaagtctgatcgcacttcagaaaccaagccatttatgttgtgcgactcagggtaatgaggtgcccgttgaacagcttgccttacagccatcaatacctaaataataggactaagtataaggggattatgtgttacagggaaaagaacaggaaacaagtgtcaaccatgtagtctggtactctaaaatatccaaaaaaactgagcaatctaaagtagcagacaatgcacggacagctagtaacacttcgcatacatgacaccataatgaagcaatatgtagctattgtggtctgggaccataacagtagcatttagcatcagcaattagaacattaatgataatagagcatgtgataattgccactaaagcacaccgctgcgggaaagaaaggacttatttcaaccatgaagtaccttctttttttaaaatgtttttgttcttttttgcaggggaggggggagtttgaaagcatacctgaggtgatagaagttcaccagaacgagcagcaattgttccaagaccaatctggaactctggaagctaatacaaaaacatcgctataatgaaatcaaaacaaacttgaaggagaaaaactaaccaaatcattaatgttatactgacaacaagtatgatacaaatgaactattttacaggaagtatctgcacagcccgcaagcagttttaaaacatttatttactggcccatcccttgaaatcatgccaaagcg

SEQ ID NO: 43955 - DNA, 2794 bp, Oryza sativa
  unsure (1)..(2794): unsure at all n locations
agtaaagggctggcatagaatttgcaatggtaaattatacatagtgctgataaaattgtgtatatctagtaatataatagttccattaagtgaaaaaaattcctacctttctaaaataaccaagcattagctggatgtttccactttctatcaacgcaaagaccttggaaccatccagttcaacagctcgcccatacgactgccagcataaactgaattaagcatattcagaagcctcaatatagtatactgcagcattcactaatgatgctaaaaaaaagtaacacacctttactgctgcagtaaacatgcccaaacggtggtatgccagaccgagtgcctaataccataatatggaatattaattacatacaaatagcatgcctgacttagatttcaccagcattaacaaaataaaggaaacaaggggaaaaaatacccacttcccataaatctgcacatgttgggtaacctcgtattgcatactgaaggctctgtatagcctctgaccatttcttctgatgaacctaaatgccccataattgtcaatacttattgaaaatacatcagtgcataatttagcatgcataaacaagaaaactatgaagaaaaatctagagatgttaaccgcataactttagctttaagcaaagcacatagtctacttgttccttgctccaggaaaaaacctacattttcctaagcaagcaaaagttggagattatagctgggcaatggacattgttaatttagggtttgttttgaagaagaacggggtgttctttttcctttgggatgatacaaatcctaaggatttggatcctattctccctatcaaagcaggcctgacaggctgatatagtcacagctttgattagagataaggctccaaaactaggtattgcagagatgcgaaatgtcaagcctaaactagccatgttgtcctatagatttccacatattctctatcaactaatccaaaatgacaggaacatgccaatacgccaatactatctgctagtatgaggctaaaggacgtgaaggaaggtgaataccctggtggtcatggcgtgaaagaaactggcactggatatattaatggcatatgaatggtattacattttggtaaatcgaaaggcatgcatatggggacttaagcttggactagccctagattgggtcagaatttaattatctcaacagtgttgggacttgggatcacagtaactaatacctgtaggctttgtttgggtgtgtctgagatggtgtgattgaaaaccagtccatatggatctattccatcgaatgaagccataatattttgcaaatttgcccctttaggtggagccagagttgatcacaagtattacggacatgattacttcaatcaacaatatactcaagctgtcaagcaactccaaccaaggatagatagatacctgtaagtaccccaaccttcggaacgcccaaaatgcccggggtgacttgccagctgcctccttgcacaaagcgatctccaagctttccttgccctccaaatctagcaaatcacagaccgccttctgcaccaaaccacacaaacagcatatcataccaaaacaccctcacaggcaaaagaacaaacaccttcgaggcacacgctcatatgcattccaacccaccccagcctcggcatcatcagggttgagcgtctccgcccgctgatagcacttggccgctcgctgcgcgtcgccggcaagcgcataatggtggccgaggaagcggaaggggacgccgtcgttggggtccagcttggccgccgcgaggaagcgctcggccgccgccgcacggagccgnctaacctactactnctgctcgccctcctccctcgccgccgccttcgggcggtcccataggaagacgccctgcacgcacacgactaccgcgtgataagcccgcaatggaggagcgagagccgcagccacggcgaggattcgtgcaaccggatgacgaaggttacgaggttgtagtggtggagcgggcttgatggctcgccggcgagggtttgctccagctgcttgcggaggttggcctccgccgcctgaagaggagaaaaccaaaaagggtgagcgccagaggaagtgaggagagagatggagaagtgagagatggacagagtgggataccttttcaggcatatcgccggcgaggtcgggcgaccgccggcggcggcggcggcggcgacgacggcggcgtggtggaagtgggggggatgaagtgtggggaaaggaaacgaagcggcagggaggttttgcgatttagcccttccaattccaggtagagcagattggatcgaccctaccactacatgtggtgggacccacatgtcagtctgttaaaccctttatgttcctccatgaacgcgattaaaagaaaattgctacacatacgacctaactgtacgtgaactgtccgactcacgtacgatcaaattcattcatacatgagtcggacagctgagtcgtatgcatagcaattttggtagcatgtgtttagttgtacaaatgggtcatatctatagcaatactcaattcagaaacaaataaaagttgatagagaaaaatcatttctgctgtatcttgaaatagttcgtttttttctgtttaactaatgaaatgggtatgatacatgatttcatcattccattatcagaaatccagaaggaaagatgaacatgaactcagtatatccattaagatctcatttagaatgctggaatttaacacacagttttgtaggatttccacatgaatta

SEQ ID NO: 43956 - DNA, 910 bp, Oryza sativa
  unsure (1)..(910): unsure at all n locations
nnnnnnnnnnnnnnnnnnnnnnnnnnnnnnnnnnnnnnnnnnnnnnnnnnnnnnnnnnatgtattcatgtcaatgactaaaacgacatgtttttgtgtccggggggagtactacctttccaaggtatgcccaagcttcagagagagacatatcaagatgcagtgctctgataaaagaatgctgttttaaagcttgattacttgacaccgagcccaatgtaacccaaaaatccttattgactggttccagtatcaacccacccaacgacattttctctggcagttccctgttgtacacagaaataaaattttatcatgtacgcttgttaagaacagatgccacatgctactaagctattaatgtggaataaaagacttaccaagttatgggatctagactattattctcctcaatggtataaatgagatcaagacatatagcagtgtcattgtgaatattagcttcccagggagtgagatgcaaagctcgttggtatgagaattttgcaccatttgcagccaacaaacatgtatttctccactcaagtacagtagtcctgaaagtaccatcatccataccccccttgatattaccatcaccccatggaaagcatcttgcaagtgcgagctgacataaagcaagaaagcttaaaattataggatactgaaatttaaatgattaattaacagtaaaatagagaatacctgagcatcttcatgcagtttccaaacacaggaaaggtttccagtcaaagaagtacaaactttggcagctttgcatgctttctagaacaaactacactgagacaatatagcaggatatgtttcaaattgaaaccaaggactagtgccaaataccttcaaaagactagctgccaagccaaaagccccagtcaatacacactgncttg

SEQ ID NO: 43957 - DNA, 1734 bp, Oryza sativa
tgcgtagaaacgttccagcattttctctgttttttcttccttttattcagtacagaaagtaaaaacgtgggatcaagccgcgcgacgcgctccgtgcggactaagcgcacgtcaagctcgacatgtgcacgaccgagcaaatcgcagtcatgcactcgactggaaaacagaagagaacaagctaaaaaactgggggaggagaaactgactaacaggaaacaaatgaaagaaccaataaacgagctagcacaagttttacagctaacgagctatagcctacagatgctggctacacgatcgaagggaagcttgtagagaaaaccttctgatatcgtctcaagaagatgtttctcgtcacgctagctgcagtctggaggagcaactgcaggcgatggagacgctgatatcaatatgcatgaacaaatcacttccaagttaattccaagtgtgccaatgccaattggtgatttaagtggtttgaccatttctaacagcatcacaaatgatgccatgcaccctaagaacataggaaaacaaacattccgaagagaacaaggtactaacttctaacttctttcaaagagttctactaatattctgaagaaacaaagcgcacagtggggcattgtaccgagcacctggcgagcagggacaacgacacccgaagccggcgcgcgctgcctcctcctccgtcaacccgctcacctcgtcgtcggcgcaaccacttcctcttcttcttccaacatctcctgcaaaagatccacgcaaagggatagtagtttcttgactctcttcgcttgtggagctcgctaatcctgttgtcgccgtcatggcgtcactcattgtgtcgccgtgtcggactcgcggagaaacgattctgcatatatgggccgtatctaagagcaaacagagcatgcctcgtttgtatgggccttcattccggcccatctacgtgaatgggtcggccttctagttcagttttccgggcatatacaagtggattggcccagaactaaggcccattcaaattaggcccaaggatttgatgcacaatttagctcagtaaaactgaacaaactattgcagaactatatactagtatttattaagaccagatcttcaaatttagcatcgaatttatcataaaactaagtagcaaatttatcacaaaatggtaagtttagtgacaattttaatcacaaaactacatctccaacataacggtaaaacagagaattgaactctgcacaattctcctcaaaaatcagtagaatcagtcgttttgtgatttttctaaagataatgatcagtagttttgtgatactgtcaaatctgtagttttctaataaacgcttaaatattttgtttaagttttgtgatagcttggttaaaggatatatggttctataaaatttactgtttttaaagaaaaatctctttacaccgaacaccctcaaactcaaaagtttgtcttcaccaaacgaaacgcaagttgagctaatacatgcgtgaaattttcgagaaaaaaaagagctaatacatgcgtgaatttttcaaaagaaaaaaaaaattaagaagaagagctaatacaccaagctgcacaaacgcgagtgagaaagcagcgacgaacgatcaaacacactctaggaatccttcttcttggcgtcgtcggcgtcaatggcgccggcggcggcggtggcgtcgtcctccttgctgtcgctgccgcagtagtac

SEQ ID NO: 43958 - DNA, 744 bp, Oryza sativa
  unsure (1)..(744): unsure at all n locations
nnnnnnnnnnnnnnnnnnnnnnnnnnnnnnnnnnnnnnncgaatataactcaccctcaacttctaaaaccgctcaatttacatcgctaattccagaatgagaatgaggtggttttcatctgactgacgatatggtggcaatctagtcatcaaagtaaaaataaaaataaaaaaatgtcatgttcattgtgagtagcctctccctttcttttcggtctctccactgcatacttcttgagagaataagtcaaatggtatatttatataaaaaattaatttgtgaataaaacgtttatgtacgttttcttagtgacctaaaatcaaatgttgaaaaataaattttcatgaaaaatattttaaaatcaactttaaatttaaagtttaaagtttggttgataagtataagtgaaaagatgaggttgcacctctcttgagccgccgactaccgcgcctctctactcgtcggaggttggccaccgccgcgcctcttcttgacctctctacgcacatgaattttcccctaaattctcccaccgcccgcttcgcaggagagggcgcatgccgcgaagacgccagaacagacaagaaaacgaacaggagaagggcgaaaaaaaattgaaatcagatcacacgaagatcacaagaacaggtaagaacacggacaggttcatctcaaccgatatttcgtcgcaagtgggaatcagagaggaaaagtaaaaaaagaaacacacacacggccacccgg

SEQ ID NO: 43959 - DNA, 1392 bp, Oryza sativa
  unsure (1)..(1392): unsure at all n locations
nnnnnnnnnnnnnnnnnnnnnnnnnnnnnnnnnnnnnnnttatatttcttttttttttttgaaaaaaataacacaacagattctatctagattcgtagttctatgtggtgtctaattcagtactagattgttatattttaaaacagaggaatatgtaatatatcactccacaaacatataaatttaaatttgaccgctacaattaagttgtaaaaaaagaacaaactaaattattgctagtatgcgtatattcacatttatatttattttgttttttttacttgtagaaatcaaatttaagcttccatgcatgtttgtggagtgatgtatcatgtattaatctattttttaatttttttcataactatttagatgacatataagaaacaagaggacatcctcttaagggattaaaatagtatgccccttttttcaccaccttttgttttaatttcaatatataaggggagtacttttgtactataaagagcagtaagtacatttacttttcaattccatataacatttgcttttcaatttcatatgctaattggctagctagtgtgtatatataactacatggagaaatatatagggagtggaatcaagaggggaccaatgcacaacactctagctagatagtataagtcgccatctttgatatatctttcttattcgtacaagtggccagcatagaaggtagagagctgttacgttggtgtgaccctgatttaatctgatcaatctatctccactgagtgcacgcatgcatcattaatctcactaagattaattaggagacgtaatatgcgaatgaattaacaaacgtacggtcggcagaggccgaagatgtaacccattttcgtaaccattgaaagaaaataatgttagagaacaacatgcctagctaacttaaatgtgcaatctagctacgtacgcactaggcaagatcggttaaacaaagagggagcaaattgacaagtgcacaaagccaaattaactttattaaaagttcaaaactgattgcaagtttggagcaatgaggtaatccggcatgcgtacttgagtcactagctcattcgctagtgctagctttgttgctatcaacttcattcaaacagagaccagctggcaacagggatacagtacatatatacatgcattctgctgttcatttgccttattaccatgcaccaatataatgcatcctcctctctagcttatcataagtactaattaactaattatcccagagcatggcaccaatataattgatccacttgagaccaagcatagtgtacacttgaacacatgcatgcattggcatgnnnnnnnnnnnnnnnnnnnnnnnnnnnnnnnnnnnnnnnnnnnnnnnnnnnnnnnnnnnnnnnn

SEQ ID NO: 43960 - DNA, 1685 bp, Oryza sativa
  unsure (1)..(1685): unsure at all n locations
nnnnnnnnnnnnnnnnnnnnnnnnnnnnnnnnnnnnnnnnnnnnnnnnnnnnnnnnnnnaataaatcccagtctcttctcgttgtatctatcataaatttcttactatacttgtcattcctagcccagatcgaatccttgtgtaaccgaacaaggcctgagactgctcgaaccgcaacacgtcgtcgtttttcttaacggttcagtgatatcgggtcaattttacactcccatacagcgacggcagtatatttgtgaaaaaaaaatgtatcccggatatttctgagaaaaaataaacagtatatttttaaatttaattcttttcttggcgggtattactatgatcacaaccaatgtacgtgctattatagttgatagatatagattgatcgtagtggtttcgcgttgttacttgaggtaggcaccgctaatggatgtcaatttgctcttgaaaatctggatgctagtatcgatcaaatcttttcattgagctgatcatatatactgatccaatcatatctcggctaagaaatataatgcatgcttggtcatccctaaggttggagatattttatacaagtccgcacacatcaagctagtcactttggaaatgaacacaaaggcttcgttccgaacatgagaattccatcatatacgatgagaggattataattgtagagcatgattcaaaaagacgctagacgctaattagacgactagctaggtgacacctaggccagaccaacaagttaaatttaagatattaagaaccatatcacatatataataacaactaaactatatatatagcacgaaaatagcaacgaaatatcaacaaaggcagtttagccgtctaatgcatcatctaatgcctaattgtgtggctacccgatgcctagctagcaccaacttttaaaacattgttgtagagagcttgtttcaagatctacaaaataatccatgatttttttatgggcacaaaccaccaaggatatagcatcaaagccatcaagtaatatattttgtcagccaaccgagtaatacccgccaagtctaaagagcaaggaaaattttattttcttgacggctaaccattatttatgcccaactcttatagatgtcatgtgtcgatctacgaaaaatggttaaacttgtgcaagcatgtataatagtccttgtcccataatatagttatctttatgtttttatattgggactaagaaagtgtttggaataaggagaactatgtaaaaaaataaatgagatgatcgtgatttatcgaaatgatcgagagagtatacaaagaagtaactgttgtattttgaaacgaaagaagtaggtgataactagccttccaatttccaacataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43961 - DNA, 2115 bp, Oryza sativa
  unsure (1)..(2115): unsure at all n locations
catgaagaaatgctgtgtaatttctcgtaccgatgtgatttgttgcaaattgcaattccaggccgtcaatggagcgtgtgcagttccttgtcatgattccagcattattactgtttataaccacagttaaaaatttattatttaagttgacaaaataataatactccatccggcttttaatagatgatggtgttaaattttgacatgacatttgactttgttcatcttattgaaaaaattttagtacaaatataaaaaatatgagtcaatccttaaaagttattttaaagtgtacaaagtttttcacttttcttgcttctaaggattgttttttcttctgctatactcaatgaaaagacacaatctagtgttgttttccctaaaaaaattattttgatggtaaaacaagttataacaaaataaatggtattttaaatagataaatagtcaagcgtcatgtcaaatgtaaacggcatcatctgctaaaacaaacggaggagggagtacatatagaagaagcgttcagattcttgctcttacatgagtatgttgagaggtaggttcagagcctcaaactcggtggcaaatctcctcaccgaatccatggagctgaggtccatctccagcacatggataccggcgccggggatctcagcccggatcgcctcgctggccctgtgcccggcggcgacgttgcgcacgggcatgacgacgcgcacgccgcgcagcgccatgacgcgcgccgtcttcagcccgatgccgctcgacgcacctgcagctcatcagcccactctgaatttttctggccaacgtcgaaaccgtgagctaaatggcatggcagcagaccagcagcagcatcatattcgtacctgtgatcaggggcggagctagtatagctaagggggtgcccaggaactggttaaaaaaaatttaactatagcttatttattttcaccatatatataccccgtcagtttcactcatatcaagctaaatttgattcaaaccagagtaaagcaagcgagtggaacccctttcattttgttctagctccgcccctgcctgtgataatagaacttcgcaccatctttgcgcgagtcgttcaaaaaaaaatcatatccgtacctgtgatgacggcgaccaagccccgagcgtcgacgccggcggtgacctcctcggcggtggaggcgccggagaagccggaggggcctttgcggttgaaccagcacatcgccgactccgtaccaagctggcgtacgtcgagctcaaggaatagtggcgtactggtgtttgcaagctgagttcagcttcggcaccagatggcctgaaattatatggttagactctgacagtgagagaatgtgatgtggccacagcagtttcagcttgttactctaccaaagtactaaagatattgtttttataccataaattcccagaagacttcaataagataagaacacctcacacagccgatgagcagagcagagaagtaaagccgaggtggggtgctggttttctgttcagctacagctctgtgggtggctgggtgcaaaagaataatgctcttcagcatgctacagacgacagtatggaggaaaaactgcagccgatggcgatggagatgctgatatgcattgacaaactagaaaccgcttccaagttacaactgtagccgatggcaatggagatgctgatattgattgtcaaatcacaaaccacttccaagttccaggtgtgccaatgtcaaccggtggacaaagtatatcaaattatcattttttttcttcaaagtcatatagtagtagtatatatctggtgtcccatcatttcttgtgagtaatccaattactagaatccaaatccaaaacgaaatactagtacattctagtattgagtagatataagagcttaccgttgacgaagtggaatttcatttctgaagaaaacgggtatactaactcagaagtatgtactggcttccaaaagcatcaccctttataacaattcttcttcttcactctacatccaatcatctatttggtgatttgagttgcctannnnnnnnnnnnnnnnnnnnnnnnnnnnnnnnnnnnnnnnnnnnnnnnnnnnnnn

SEQ ID NO: 43962 - DNA, 1361 bp, Oryza sativa
actgacgccctattcaaactttctactaccactgtccattctggttctgtatcacatgtatgcttagttacactacattttgggaccgatgtagtatacttttttaggtataccgactgatagcagtaactgcacatcacggaggattgttattgagtactccctctgtcccataatatagcaacctagtatttggattggatattttatagtatatcgaatctagacagaagagtgtctagattcattgtaatatgaaatgtcctatctggtattaagttgctatattataggacggaggaagtagctcattgtcaagaattatatatatatatccgtgttcgtctctctcgtcgaatcagcctagtcataccagtagacatgtaccatattatgtaccatatttatctgttgtgcacgatattgagtgccaacccttgcatccaatcatattaatatgtttatatatgtagttaatattattattttttggacggtgtaaaaataatgctagattccgtgctgacctgcataagagccgatctacccctaccgcacactaatcacttgtcaatttgtcattcctaactaatatcgactcgtgttctctttagcaatcgatcactcatacgaattacgtgcaaataaaatcttatatactcccttaattctaaaaaaaaggtcaacctaaaatttagattaaattatggatgggatataattagtacaacgaatcttgatagaacggagggagtagaaaatagcaactggagtagtacaattaattaagttatacacatcaagaacgccgtgatcttttgatccatcacgtcgaagctggaagcctcgggaggcagaaggaagcagcggccccagcggccgagcgtggccgtccgaagccctccgtctttgccgtacttgaggcggaacatccgcacgtacatgagccgactcgccgtcgccgccggctgctccacgcactcgagcagacagaagttgctgtcgctgcccatgtagtggagagcgacccctcggtgccgctccttgtccttgcagaagaggacgtccttgccgatcttgcacgacgggacccgccacctgctgtcccggcctctgatgcgcggggccgggacgtcggacgagcagaggcggccgggcttgtccgggtggcggcagatgccaacccaggcgtccagctcggcgtcgtagtgtccctgaccctggaacggcagcatccagcagccgtagtcggtccactccaagctctccgtgtcgaagcagaaggtggagcccgcgtgcagccacggccagccacggctcaacgtggggaagaagggcacgtcctttctcgccacggacac

SEQ ID NO: 43963 - DNA, 1491 bp, Oryza sativa
gaagtagtacgtcgtccatatcgattctgcggaagccgtagccgtgcttggagtcatccagcaccaagtacaggcgccgtttcccgccgccgccgccgccgccgtcgccgtgtgatgacatgctgcgctctgaacccgtcttctgttctacccacgtgtcacggtgattaatcgggttccctcctctgctttcgtaattcgtatcgcgctgatcccgtgctatatcgtgacaggttatataggagtagacacgtagctaggctgcagtgcagggtccgagtcggaaccgtacttattagttctaccgaccttaactcctagggagacgccatgccagctttgctactccatttggaccaactccaaaatacagcccataacttgtgcgcacaagtccttttgttccacggcccaccgtgccggcacgaccccatctcggcctgtcaccccttctaaaaatctctcccgtttgcaaatactgctacttaacatcagccgttgccagaattaaaatattaaaaacttttatcgaaatttattttttaccatacaattaaatcgctaaaaacatatatatataaaattcttgacaatgagctactcaataccaatcctccgttatgtgcagttagtgctatcagtcggtatacctaaaaaagtactacatcggtcccaaaaatgtagtgtaaagcatacatgtgatacagaactagaatggacagtggtagtagaaagtttgaatagtaacgtcagtacagctaaaaaaatatagtatcaaccatttatacagagtgttttcagcctcgcatcacactcctaaacacgtgaaaccatttatacgcacgagtcactgcgtgcggcagagatttttgggggtagggatgaaaacggatattccgatcggatatgatacctttcagattggatatttctcggatagttcggatgtggatacaaatacggatattttctcccagatacaaattaatacggatatggtacctgggtttccatcagatacggataatcagtggcggacgcaggattaaaataaagatggggggcgaagatgctattctcaataagaacaactaaacgcaaaaaataccatatttatgttgtaattatatgttatataaacatatagtataatcaataaattaaggcaaacaaaaaacaaaaatgatattaaaataaagtaataatttttgcgccatattcatcatacataaaaagatactagtaaacatatcaatttgtaaatatgagtcaattcagaaagcatagttgatagatatcttttaaaaaataaatatatgaaaagatatcgcatacccagaataagataattattattttgcttagaagggagagagagagaaaaacattaggcacctaactatagtaggggacgggggtgagtagtgtcgaggaattgactcaggaaagcatcacatacgcaggcattaaaattggacagttgggctgctt

SEQ ID NO: 43964 - DNA, 2547 bp, Oryza sativa
catgtccgattatattcgattcttattcatattcgagataatccgtatttgtttccgtattcgaactatccgtattcgttttcatatccgataaaaaaaatgaaaacgaatatggtacaagcattatcggtccgtgtccgctcaatttttatccctgggaggaggggggttggctggaggtaggcagaattttttttatttataattttttttattaaaagttttacaaaaataattttccattttgaaaattgacggaagtagtcccctaccaccctctgggagggcgatttttaaaaatcgccctctcagagggcggcgaaaatgacgtgacagacggccgtcaacgaaatttgcaggcggcccccttgccgtcctccgctagggcgattttatactgtgcgggggagggcgatttttgcctcccccctataaagcccagtccctcctctgtgaaatttcattatattcactaaaaatccaaaaaaaacgaaagagagagaggggagggcagcagaagaggagcggcgaagccctgctggttcgctcaattcatcacaggtatgctcccatacatcttttgcatttgtactaatatgttatgtttgagtatatatgttgcgttttagttttagttccatatattttagcacatctgtagcacacaacacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgttaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacaacactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgagatatggcacatttggagcttcttatgaataattgcctcgtttgttagccaccattgcccagaggaataataatacatactatgacctacatacatttacatcggttgatgatcgaacaaagagtgtgttgcaaagagcctttttctcattgggtgcttgcatcaatgctgttgtgcatagtcgacctgttctatgcatagcatggaacttatatgacaggtaaataccgaggtcagatattgacagcaattgggtgtgatgggaaacaaccaggttctacctatggcttttgcatttgtagagagtgagaacactgaaagctggtactggttcctagagagagtgcacattgcagtggtgcgtatgaggcccaacgtttgccttatacatgatcgtcatgcaggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgag

SEQ ID NO: 43965 - DNA, 1373 bp, Oryza sativa
acctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgtcgtacttatgtttgaagtttgctctatacaggttgcatgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgaccggatgagtgttttgtactaaaatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgcacacagaaggagccgtcgctgcgagagcaccgctaggaatttcgggcttgtgcacacgcgaccaggcttactggctctccatcct

SEQ ID NO: 43966 - DNA, 7629 bp, Oryza sativa
tcaccccgtcgtaacttgatgttccatcctcgcaggacctcgtttgccttcgagtgcccctagcttcggagcagtgcgacctacaacaccggtttcgcacggtacagttcagcccagatattagttcatttttgtttcagcttttgcacgaatatgtcactatgttttaactgcacgtttcctcatcgcaggacctcgtctgccttcgagcacgttcgcaggcacgaccggcgcttccgcgagctccgcaggggcgttcgccacctcttcgggcgcgttcgccagctcttcctctcacggagcgtcgatccctcgcccacacggtactttactttttattaccactgttaaatacttgtacgaaactgatggtccttgtccagcaggatttgcagccgggatcttcggtactggggcctcttcgtctcacgccggtaggactggtcctactagccagttctacgatgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaaattgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgattcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatagaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttaccagtcttggagattttaatcttgtatagttttcaatataaaaagatttgataactattgatatttataaaaaaatttagagcacagtataaaatcgccctcccccagggcggcaagggggccgcctgcaaaattccatgcccccctcaccgcccatttgcaggcggcccccccacagtacaaaatcgctctagcggagggcggcaagggggccgcctgcaaaattccatgcccccctcgccgcccatttgcaggcggccccccgcacagtataaaatcgccctagcggagggcggcaagggggccgcctgcaaatttcgttgacggccgtcgcccgagagcgaacggccggctgccacgtcattttcgccgccctctcgccctcccagagggcggtaggcgactacttccgtcaatttttaaaatggaaaattatttttgtaaaacttttaataaaaaaaattataaataaaaaaattcgaggtaggcagccccaagaggggtatttttcatccaaacaaacgccgtcagtgggtgagcgaaactagcaagaaacgcgtgcgtaccgacaatgcaagaaaaaaatatctctttgatacggcaaaaatctgtatacgatcatgcacgacaatgtatacataacaccaaactcggtatgccatcattttgatttacagagatcggtacgtaatcatgcaacattggttttggaactccacatgcatacgcgaatgtgcatgtgattcttgatggccaatccaaagaaactaccaaagctgcacttggtcctgattaactgaagaagttaaaaggcttgttacctgtcaaaaataaaagaataataaaacgataaataataaatatatacttcctccgtttcgcaatgttaagtcattctagcattttccacatttatattgatgttaatgaatatatatgtctagattcattaacatcaatataaatgtgagaaatactagaatgacttacattgcgaaacggagggagtatcttataataatctcatttgcaggccactggtaaagttccatttgatattatagcgacaacaaaggattatagtgttaaaaggtgcggaatggcaaaacgaaagatgcacattgagttttacttttgagagtagccagctatatttccgaatatgtggtctgctatcatatacccatataggtgacaacaaactgtgaccgcaaaattttgcatatacagttaaaaacaacctttcaaaatgtcattagcaagagttattggttatgaacttacaggagcaagttatatggatactattcttctctaccataatacatggaagatataaattgactgaaatcgatatggagtaaaagcttgctgacagcgaacttcaattgacttatgctgcgccaaggaaactttcaaattgtactaattactaaacataagtggaagctagcaaaaccttgtgtaaactttgaaatgttcatgttttatttgggggaaaatatgcacatcagtacatgacatgcatgatatcatgatggaagacatggagaaaaatgagaaggcatatggtcagcaggcggtgaaagtgcaagaattacaaagagagtaaatgcttcaagcttgagattgcagacatatagagtttttcttttaaaaaaggttcataaagcaaccattaccagcaaaggattgctcctactgttgcagaccatgacttaaaaagttgaaataaagcatgaacttcctagtcttaatctatgtgaacctaaaatctcgcattataaggtaaatctgagatcctaaaagtgaactttctggctggaatttgtaagattaaggtggacaatgaagtaatgaaccatcaatgtagatgacactgtaggggcacaactacagtcattagaagagcagattttgctgaacatatataatgcatgaaacaatcacagaacattgattgtcataagtaagaagcactgcatatgacaaaagtaataatactgcagaaattagcacttgtatgaccaagcagtatgagcttcatgtgcccatgcagaagtaactttaatatggtacgctgggatactcacatcttcactaagaattgggaagccggcatttctgtaatttcagcttgttcactgttgccatttgaacctcttaaggtcactgagagcatcttagtatggttgaaaatacggaccaatcattttcatgcatagagaatgaatgagcctttgttttgatgcttgaaagccataatgtctgtttagaagcaaatcacagtgccctggcctggaactccttccgatcacaatatttctagttgcataattgatcctagaaagaaggagaaaaaggcatcatcacaaggtcaatcaaacttagggaaaattctccaagccctattactattttgtatagccacaaaccattcagtaataaatatcattgacagcatgctggattaagtctgatggcacttcttaattagtgtgactttttgtacatagaactgcgagatgatttatattaacaatatgaggtatacgactggaatattgattcaaacagcagactgagcgtagtgtatttacatcaaaggatcagttacataccttgaaagttaaaattgtcactcatcccttcatagtgttaggaaacaggaacatcaagaaaataaacaatgacgaactgaccattcctgataggtttacaatgaggcaaaaattagcagttgcttaattgctttaggcgatgtcatattagctcatgtaagtacaaaagagctgcattccagaaacacactgcaacaaacaaaaaggcatacgtacatgtgcttgtgtttcaaaatggtactcttaagacaccaactcagacgcaagttctgtttcccaaatcaaaactcttagaaaacgagcataaagaaaaggatcaatctagcatttgccgtgcccccaaatcaaataaaccctagaacataatctccaacaaatactgcaaagaaacctgccatatcaaccatatagcttgagctgttcgcctcccgcggccatacagcctactgcgatcctttgtcttcagccttcagtggcaacgtccgcatcgttgagcaggtgccctaatgggagatgatgaatgagataggggagaaagagaagtgatataatggctgagcaccccatctcgcctaaagttgcaacctcgcactcgccttgaccacgcctccacaatagctactaatgctgccactgacagtggatcatgcatgaaccatgttggcaagttcaaatgccccaaactgcttagagatggggttttttgaacctttgatccatttacatgggtattttgaaaccaggtgcttagacactggggtttatgaaacacaagcatatgtacatggggttctctgatatttactctttatttttcaatggaatggatgggcacaagatttacttctgcatcagtgagatcctaatcagtagtgagtagtaagtatgcccaaatctaatatccgtgaaatacagcagaagtaaattagcaagcagcagcatcagtaacagcagccatgaacagttagcagtagccaggaggagaagcatggctgcgaggaacggctcccaaactcacctgagaagagaacggagaggagattcaaattgagcgagcgaggagggcgcaaataaaaaaacccaccatgattgtggcgccgtgctccttctccttcgttcttctccccgacctccgccatccccacaccccagtgctccgaccaccatcttctaccggatctggcggcccctgtgcaagaacctgcatcgagtggggagaagagggagagaagaagtggcctgtggcggcggcggcttacgccatcgcggaagagcgacgatggcggcggcggtggctggaggaggcgaggatgcggcggcggcgggcgcgaggctgcgggagaggccagcgagggggctatggcttggtgcgggtgagcgaaatctgcgccgtccgttcccgatccgacgatccacgggtgcgaaagggccgccacagcgtgaaacgtggacggtcagatcggccctatagagagatcgaacggacattgttattgggaaccagtatgtaattaacgaaaacgcaagggttctgctgcaaaaattgctgacgcggcgcgattaatttacagcgatcgcattagagtggttaatattttctctcttctttttttttttcacccggccttctctccctcgccttcctctcctcctcgccttcctcccattcctctcgattccggcgtccaatagccaggcgcgccggccgccggtacccgcggcggcggcggcggcggtgcctccccttccttcgcggcgtcttcctcctttgcgccggcatccttcgtcgcgcacgcagggaaatcaacgcctctcccgggtggttagtaatctttttctcgtcttcctcccaagcctcttgctaggttagggtttaatcccatgttgtttcagattgcgccgagaggggtagggagaagggagggagatccggccaccctgcaaggcatcgtcaccgccgtgatctggtaagaatctctctcgcctcgctgcaatggatccttagttttggcctgttgttcaagcagagctggtcttgtttgcgttcttggtttttttttttttttgggtgagggtgggggtggggggcggaggaggtgggggttggggttggcggtggcgcggcgggaaggtgggggttcaaattggtgtcactttcttgatcatcgagttgtcgtgtggcatcgctttaaaaagtttcttgtattttaattctcttgttcaaaaaatctgctagtcatgcgattaaccatctgtacatggtacagtaataaccaccgatgaaaataacatcaaatgaggagaaatctctgctttagcagttacttgtcactactgatgaagataatatcaattaagaaattatctgctttagcagtttagttagtactcctagtactactagtataaatatgaatttcagaattgcagtaatatgaatagttcaaatgtatcatgtttctttctaggaaacaagaaccatgtgttacctgtttgcacttcttgctttactgtcttcattagcacagtctatgattgccccaatatacaagtgagttggagtcactttgccttcttttttttcctcaaacaaaaatgcctctgtcaaaatcaggaaaatatgaaaccatgactacaaaatcacttggctgactaatttttctgtggttattttcttttcaaaaggtactacagaactgctctagtttgcttggattagctcccattttttttctgaacataacgttttgtctcttgtatcgaacaaatatctgagattgactttggttcattataaattgtcatacaacgacacttctgtacttatgatataagcaacgatcttttgtactttcaccaccattttacgatccaaacttaattaatcttttgtactttatcgtgctatacttaattgcaaggaaatcatagaatcttctattttggcatcctatgatgctttgataggtaattatgttgtcaactcactattcactgatggtctacaccaaaatcgctatatattttctgcaggaagcactatatacaactacatagtgaatctgaggccattgtttggtgcatgccttcatcggaagttctgccttttttttttaacttgagttgtatggactacttatgaacgtggaacttctctatccttttgtaataaaacactataattcagatggttggagtgtaatgcttgtgataaagcaaaatgcttttactcttatttggagtttacagactgagttgcctgtaaatttgtaaaaaataggttggaaaattggtatgaaaaatctgactatctgagagtactagatgatgcttatttgtttttattaacctgacatttctgctatgcctgattttggtgtgcttctgtatgtggaactcctgcaatgcgttcgcaggtcactctcttttaaattttgattactaccaaaatgctatgagtaaaatgtccattctttgctttttcccatgcttatttcaatatatgttattcacttgactcaaccaaatgttagactattgtataatattagaaaaatatgagggggctaattatagaacatgcaaaattagtagttatgggttggtggtcagttggtggcagaaccactaccaccactatttctgttatagtaggattattttttaatttttg

SEQ ID NO: 43967 - DNA, 5798 bp, Oryza sativa
ccagttgctactctaatgtctttgggattgactagttatggtcactaatcagcaattggtagtagtaacaatcagccggcttgcccaaatatacaagtgagttggggtcactttgccccttttttttttccacaaacaaaaatgtcactgtcaaaatcaggacaaaaatgaaaccatgactacacaatcacttggttgactaatttttctgtggtgatatatatattttttttcaaaaggtattacaaaacttctctattttgcttggattagctccttttttttttctggacataacgtttttgtctcttatatcgaacaaacctctgagattgactttggttcattataaatggtcatacaacgacacttctgtacttattatgatataagcaatgatcttttgtactttcaccaccatttaggagccaatcttaattaatccttttgtactttatcacactaatatacttacttgcaaggaaatcacagaatatgctattttggcatcctgtgatgctttgatagctaattatgatcactatattatgttgtcaactcacagttcactgatggtctacaccaaaatcactatatattttctgcaggaagctctatggccattgtttggtgcatgccttcatcgaaagttttgcctgatttttttttagaaacttgagttgtatggactacttatgagcttggaacttctctatccttttgtaatacaacactataattaagatggttggaggataatgcttgtaataaagctaaatgcttgtactcttatttggagtttacagactgaattgcttgtaaatttgtaaaaaaataggttggaatttggtatgaaaaatatgacagtactagacgatgcttatttgtttttattaacctgacatttctactatgtctgattttggtgtgctttctgtttgtggaactcctgcaatgcgttctcaggtcactctctttttttttttggattattctgttaaactttgtaatttgctgtcattcctatgttcaggaagaagcaatccctgctattcttctgatactaacctcacgctttactgcgggagtttagtacgataacaataaatagaaataatatgtaagacagctagattgacacaagtttatgatatacgataattcaaatagtatatggaatgatgattcaatgtaatagtaaggtgatgtagttttatgagagaagaaaagaaaagagataatttagaccataggttaattatcgaatggctaaaaacaattgagatgatatggctcaatgagagaatttggattatagattaatcatctaagggttaaaaataattgagatatagcttaataagagaagagagaaataacattaactaagtgggagatactgaaatttatgtgaattatgtgagatgatttaacatgtttgtattttaaagctctaaagtttaataaatatatagttgtataaatatagcatacatgatgattaagatgtaataattgttagtagatgatgatataacatctttgtattggccggttaagaaggtgggtttggctcaagaggaggcaaccggtattgctcggttgaatgggcgacaagggcaatgattacgacgatgagtatgaattgattagtaaaaattgtgattccaactaatcctttggatatatgccctggtacactatatatagagatcaaggctgagtgattcacgtctgataaaatcagtcccaattctttgagcatgctctatccccttctcgctcctcttattgtgacttttctcctaccttactctgagttttatcgtaaattgatgtaatcgatgcttgtttctgtcgacatcctctttcctgcgagccaaagatagcggtaaagattaaataacatgccattgtttgtttatcatattgctcatttcgttttaaaagaattaaaaaccattccgtgttgacctacatctctttttttcgtatttggtgattactttttttttcttaaaattgctttgattgattattgttatgtaaacttcctcttcatgagaaccgaagatgggtaaagattgaagaatctttgttgtttgacatttgcttgtttatcttggtttttaagcattagaatcccttatgtgtagatgttttttttaaagaaattgctttgatagttgattcttgtttatgttgcagcccgccgatattcgcttggaattgtttcttcatcgtcctgcacgtgtcacttgtgcagttgtaaggcgaacaaactatcttacacctccaacctgccaggtagaggtaagaacaagtccatcttgagaaataatttgttttttggttcttttaatcatggcagagttcttgtgctgcagacagcaccattttttgttgaattggttgaattttttttctctgttggtatctagtttgatctaaggcagatgtcttcttgtttattccagggaaattagtaaatcacatcacgatgtgggaattactattttgggatctgctaggcagggaaaaaaagaaaatgaaaaagagaagagaactactcaagatcagaggcaacctaactgctgaggtatgtttcattcttatacaatgccctcgaaactttgcttttagtagagagtagtaacaattctgaatttacacgagtcataaatgtacgggtaaacctgctcttgtaaatttatgctaagagaaaaatgctattatgccatttatgatgctacatcaatcacattaacacaattagttctagttggtagtggtctgtgggccaacaggcaaaccacggtagatacatgtgcatggcagtggcacccctaaaacttaaagaaaatagtattgcgccgtggattatccatgtatgttactctctctattcccaattaatcattatataatttttataaggttattttcaaattatattcattccctagttattatttgtgcatgggagtgaatagacattagtgcatgcatccatgtacacaactctttacaaccaatattcaatgtctttgctttgttagtggctaggaaatagcgggatggtgcatgcataagtttgttataaatgtagtacgggagagttattgtttcttcttaatcctagtgcacttatatagtgtgatatcaattggaaacggagggagtatcaacatagggctgtaggaataggtcatttgacaaccatgctttggtggcggctcattttttttttctcttttctctatttgtttatagttcaatttattcttagcagtagttctaatgcattaatggtctgatttttggattatgatcccagttcaagactaatccagccgcacctaaaaaattaaaagaaaaagcccttttactctatttttggattatgatcccagttcaagactaatccagtagttctaatgcattaatggtctgatttttggagtatctattttcatgctaccagtgttcttccctaaggtttgacttacagaagactgcgaattaatgttgaatttctactgatgacatgctgcaaatgtaagggaaagtagttgtatatggagcttatgttaagtcgaagcggttatctattttttatgcagagaaccgatttcttgaggaaaatgcattcgcatgtgatttgtgatctacaagaggaaggccagagattggatttttatgttgaagaaaaagagcttataagtgaagtgagcgtgccagggtcagaaagcactctaaggataagcactgaagtttgcagagctgttcttttcaagataatcaaaaggttccaatccatgcactctgctggattcagtctaggtgggtttgaacacaaaattctgtttgtcacgtcagattttgaggtgaaaattggtggtattagtagagtgaaagatttcaccaagacaagaggatcgaaggattacaagagcatcggaaaaattgcccgggaagtgatattctcatcagtgacaaatttgccggttgatatcgagcaactacttgaccttttgaccgacaatcctatggagcaaacagcccttttgggcatgcactactctttattggacccattgactcaagtatctgagttcctttggtggcacaagcgcctcattcacctcaaagacataaatccagaaaagtttcaaagaatcatggaaaacatcccaactggtaacaattggatgagtcgggcggtggagaataagtacataagaaaggtttcactgggcattcctaagaggagaaagggattagtacataccaccgaggaagtgaagcctgaaacaacagcggcaagtcaaggtactggtattgagggagtaaaaccaaaaactgcagttggccaggataccaatattgaggacccaaaacctgaaactgcaacaccaaaatgcaagtactcggaagattcatgggggcagagtttgttgtgtaggaactcaatagaacacctggacagatgggcagcattgagaaggatcaaaaaaaagaaatcaggtggcaagataagaacggtaaaagttcaattcgaggaaatgggcagatgctatatcataatacaagcattctctaagttctttggagagttgcaaaaagccttggcagaagagaatgaactgccacagaagaagcagtgaagttttggtgtcgaaaaggtgatgttcactgtagcaatgatgttgtgcaaaaacgaggttccctggatacttgttagcagaagatgatgaggttcattgaaaatattaattgcattgaataagcaatgatgttccgttgatactgtgcttaacagaaaggtgatgaggttaattggaaatagtgcttaacagaaaggtgatgaggttaattggaaatagtagttgtattggtatattggctgagaaatgatgtagtgcaaaaatgaggttccgttgatacttgatactatgcttataagaagatgatgaggttcattggatatagcagttgtatagcagttgtattggatatacatcaacggttacgtgactactacttcttacactgaagagagaatgtgattgattgttgatacagccacgtcgtataggacaaccagaatcccagattacggtgtgtattgtgaacatgctctactcgtacaatacaaacacccacaccaatatttgatatattccatcactgccctggcaaacattctactgccgcattgtctctctctctctcttgccgccggcgggctcgcctccccctcgccgccgcctgctgtcagccgccggcccggggacggaaggagaggcggtgagtcctcgtgggctgccgccgccgctgccggatcaccggcaccggcacgcgggcgacccgatctgcggcacgacacgtcgttggccgcgggagttttggtgagcagctggcaccaatacgacgggaccaaacatctcttacaatttggggatctcgcgcgctgccccgatttgccttcaaaatgtttccctcttctcttcgtttctttctgtttctattttgtccctggtgttttaatgttttaataatctgattttctttgttgcgttgataccagttgaagatttctctggcctcacctaacaatttggacaaaaaaaaaaagagtgatcacattatctctaattccatagtgctggtgtggcagtacccttttgcaaacaaattcctttgccgcaatgtcaaagcttgccattctaggccgcaggtatgtttttattttctactacttcctccgtttcataacgtaagtcattctagcattt

SEQ ID NO: 43968 - DNA, 15842 bp, Oryza sativa
gtgggaaatgctagaatgacttacattatgaaacggaggtagtagtacgtagctgatgtactgtactaatgtctgatcactattagcaatatgtttatttttttctgtagtgctcataaatatgcgtcataattttattattactattattattttgtcaatcttcaacagcagtggcttgccaagatcaaatgagggcatgaggctcctattctcagcagttattggtgttatgctaggttacttgtttgggatttcatttcctactgtcaatgtaaccaaggtaaatatggatcatttgcttctcttgttttcttctaccagccgcttttgttcagggaaaaaagaactgattgtatcttgcagctccacttcccttccagtattatctcatatattgaagacaaagactctggtatcacaacccaaacattgttgaatcatgcatggacatctgcaaatagtaaaaagaggaacaattctgagtctaactctgacgaaattcctaaggtactttgccaaactgtgatttatgccatcattattttagttttgtgagtaaaggctgattctattacattctgcattattatttcctggtcaatgtcttttatattactcaacttatgtattccactatttctcatgcatggtgtgtgaagtttcaactttcaagatatgaggttgcatgaaggatgtaaatataggaatttatgcctatgttaagtttggcactgtatattaggtcctcatttacctgtgtactttgatatctcctttactggagtgtatgccatcatgtgctaaatcaacgttgttgctaatgatttctttcttcatttctattatttctgtattactgttctggttaatctacataattctttgctcaagatttatgtgccaacaaaccctaaaggtgctgaaggccttgcacctggcattgttgtgcctgaaacagacctttatcttcgaagattgtggggtgaacctagtgaggttagttaccatttcactttttcagtacttgtatcaaccaatacctttgaatggtgggtcttttaacctcttctgttttgtatgtggacgtgtggtttatgatctgaaccatatgaaccatcaggatcttactagccagccaagataccttattaccttcacagttggatactctcaaaaggcaaatattgatgcagcagtcaaaaaggtaattacttagacaactagcatgtgtaaactgattgcattgaataagcatacaattgctttgttcaaaatagtcttcagaatagaaaaaaaaaacttatgttcaactataaggcatctatcatgcttaaacagttaactgagacatctatcattcacttcaaatttacatgccttattatatagttttcagaaaacttcacaattatgttgttccactatgatggtcggactaatgactgggatgaatttgagtggtcaaaaagggccattcatgtgagtgtcagaaggcagactaaatggtaaattattgtaacagatcctgttgtgttttttcatcttctagtttagcactatgtatttgacaaccaaaggctaagtgttttactctttttttttatacaaggtggtatgccaagagatttttacatcctgatattgttgccccgtatgactacatatttatctgggatgaggatctaagtgtacaacatttcaatgcagaggcgtaagcatacaccaccttccccccttgtttgtttattttcggtctgctaaggaagagtatttcaacatgaatttttaggtacattaagcttgttaggaagcatgggttggagatctctcagcctggtttggaacctgataaaggtctgacatggcaaatgaccaaacggctaggagatcaagaagttcacaagtgagctgatgaatctacaatgcttcattgttgcttgatcatcacctacttgtattagtttcttgagtgatacttctctatgtacagagtaaccgaagagaggccaggctggtgcactgatccacatctaccaccatgtgcagcgtaatggctcagtcatttatcatgatgttttcttttctttttttttctttttttttttgaaacgatcgcggcaagaaccttgccgaatatattagaagagtgaaataaacagttttacattagacgattacaaaccagacggataagcgacatgaaggaaaaacagcaacggcataacaaaacggaaggaggatcagatgttttctttttcttaaaactatccgtcttcacattctgtttcacatgcagatttgttgaaattatggcaactgtgttctctagggatgcatggcgctgtgtatggcatatgattcaggtggagtggcatctgcactgttcttagctttgcttgaagctgtatgcttatgcccggctttttgcagaatgacttagtccatggatggggcctcgatttcgctcttagaagatgtgttgaggtatctttttttttttacattaataagactctgccctactgcattgttatatagtcctaaccagcagaaggtctaggttttcttaattttaagattctttttaaatttaattatcttggggactagtggtgtgccaatctattaagagcaaggaaaatgtgggggctaagtgattcatgtagcgaactaatacagatgacagggcagtaggtttttctcgataaacggagggcatgttaactgttttattcatgctcctagcaagctagcacaatctattatgtactggttgccaactttgttatgacagttatctggttttctccactccacatttatttatttcaaatcagtcatgttttattgagtcagaactttggtttgacagccagctcacgagaaaatcggagttgttgattctcagtgggttattcatcaggttattccgtcactggggaaccaggtatatgcactgcttatctcacttctcactccatacaattatatgatgttgtaagttgtaacattatctcctggtactggtagggcacggctgagaatggaagaacaccatgggaaggggtaagctagctctgatgtattcctcgcttctcatctgggcatttccgatgcatgaattctagacttaacaacatcctatatgaatcgcaaccatccgcaatgcggatttgctcttacgattttatttgataatgtgccataggtgcaccgaataaaaccgtatgagcaaagacccagagtcttaccggctagcaccataagttggtgggctagcccgccttggtttgagcctcaccaccgagaaacgctcaggggttttccggctagttccacaagatggtgggctagacgacctgagttcgaagcctcacccccttctaattatttgatattaggtcattccctaatattcgcgtttgagcctcaccacctcttaatatacaactttttttcacaggtgagagctcgctgtagaaaagaatgggggatgttccaaaaaaggttggctgatgctgagaaggcatattacttaggaaaagggatcacaccgccaaattgaacagcagtttagatgaaaatacacgcacatcaggagtaacaagtcttagcaagttttccatttcggaaatctgcctcttgcgtataggaatagagatgttcatcaaagcattgtcgccaaaataagaagagaaagaaagcagctgccttctgcaaatttcagggcaagttttgtacatgagaatcgccagttctcgcctttttttcacttggttttattattattctttggtagtgagattagctatgttgttagtacagtagccgctgtaacaggggattctatgctctgcttccttgttcatacacattttttgtattattggccagacggccagacctgatgcaaaatctatgctactgacaataatacacattttgttatagtcaattaagtcgagcgtattagtaatcatcaaacctttataaaaccttatacattatcatcatttaccacatagtggatgcagagcatctataataagacatacaatttattttctgatacattagagatcttagtagtaatagtaacttcttaagccaagcgtcgaacagtttattttaagcgcatcagcaacgcaattgatattttttttttacttacgcgcggttaattagtttgggattaggccatgattcggaaacatggcttggcattgccacgcacgcatccgccgttgccgccgccgccgccggcgtagcccacctgggtggagctctcgtacttctggtagcgttgcgcgccgccgccgtgctcctcgtggcgctcgtatgcatggtagtggttgcggccgccggcgtgctgcttctcctcgtgctggtacgccgcctggtggtagctgtggacgctgccttggcggctaggtgggcagtggccgtcgtcgtcgtcgtcgtcgctctcgtcgtcgtcgtcgtcctcgcagtcgtcctcgtcggaatcttcctcctcgcattcgtaggattggtggtggtattgggtatggccgccgctgctgtggtggccggcggcggcggcagtgaagtgctgcttgttggaggcgttgccatacgcggcggcagtggcgccaccgtagtggtgctgcccgccgccagccacggcgacggcttggtggcggttgtagttgtacccgccggcgccgcagccgttgacaccctcgatggcctggtgctgcttgtaggtggcgtgctgcttcacggcgccgccgccggcgccgtggtggcggccgtaccctcctccggctgcggcgtcgcactcctcttcgtcgcggcggtaggaggagtactgcttctgcacgccgccgccgttgtggcgagcgtacccaccggcgtcgtactcctcttcctcgcggtaggagtactgcttcttcacgccgccggcgccggcgccgttgtggcgagcggcggcgtacccaccgccggcgctctcgtaccctttcaacacctcgtgctggtacgtggcgtgcttctgcccaccgccggcgccgtgctggcgagcgtagccgccgcagccgccgccgcctccgccatggttgctctcctcgtacacctcctcctccttcttctcctcgtaggtgtgcttctgcacggcgcctgcagcagcgccgccattgcggcacacctgcacgtcgccgccggcgccgccctgctgctcgtacaccttctcctcccggaacgacgacgacatcttctgcacggcgttctcgtggacgctcatctcgtccatcttcgtcacgacggtggtgacgctctcggagctctggctgtggtagttcacctgcggcttgctgtagccgtagccgtagctgtaggcgccgtactggtagccgccattgccgcgcctagccatcgccattttttcttttggcaaatctctctagcttgttgctgggcagtagtgctagctagctgcttgtgttgttgtgttgcgttgcgttgcaagggttgtgtttttataggcggggagatgggcgcgcgcgcgggacgggagcatttgtgctcgatcggtttttcttcgtggcacatatgggcggtgcatctaatcggtaagatatgataaacttttttaatcgagtcggcatccgctgtatgctgcatgtcaagtataaaaaattaaaaatactaataaatatagggtgtatttagtttttttgggggtaaagtttttttttaaaatatactagtattaaacatagactaataacaaaacaaattacatattccgtccgtaaattacagattctgcccgtaaactgtgagatgaatttattaagcctaattaatatgtcattagcaaatgtttactgtagcatcacattgtcaatcatggcgtaattaggctcaaaacattcgtctcgcaatttacatgcaaactgtgcaattagtttttttccccacatttaatgcctcatgcatgtgtccaaacatttaatgtgatgttttcggccaaaaattttggatataaaaaaggccatagattaatagataataaatcatgaaaattcaaagttaactcttaccggttataacataaagtttatttctaaaaaaataatataactaattggttacatgtaataaatactaataggatgttccttgagctattagaatctctctccggtgagatatactccctccttctctaaatgtttgatgacattaacttttttaaatatgtttgaccgtttgtcttattcaaaaatttttgtgaaatatgtaaaaatatatgtatacataaaagtatatttaacaataaagtaaataatagaaaaagaattaataattacttaaattttttgaataagacgaacggtcaaatattttttaaaaagttaacagcgtcaaatattttggaattgagggagtatgttgtgcaactttttatcttgataggcatctctcgtcattcgagcctgcagccagggaggcgccatacatatcttcaatttggtctatgtgttcatcgggcatcttgtaatttggcgcatatactcaggccgacggcctttggttgaatgatgataaagcgaatcaaaagatcctatgcgcctgccatgttagatggtctgtgttttttccttcactagctatcatgccgtagctagcgcttatcctggcatatcacagccaaaaaattgatcatggtttactgaaagtccgcaactgatggaattttcatcttgcagtgattttatgagaacacacattgaaacatagatatggcatgggagatgttttttttcttttttggatatggattgtctgcagtcacatgtattattgaccgtcagtactgcaaataattctcgtcgattctttgcactttaaatcaatcaattcttgcatgacattcaaacaactatgaaatatttaaatttttttttgataagatcaatatatgatattcataaatatgtaagtttaaatataacttctacaaattacaatgaaagagaataaactaaactcttaaccattaagtgcattattcagccatactttctttttcaacttatataggttgaattaaatttatatgtttgtacagtgatatcgacgtaccacatattaatttatttaattatttttttattactatttagattacatgtagaacaccaggagacagctccttgaggagaaaatgacttttcccctggcatactgaagtagctagcagaacaaaactactccactatatttgtttcgtacatgtcgttcaaaaagttatcaaaaaaaattaaaaaaaaatcaagatagatcaatatatgatatatcttttcgtaaacaagtgagttaaaattcgacatatataattcaaaacaaaaataataaatttgaccatgaattacgtgttttgttcatagtcaaatttgttatttttatttctacttgcataatttgaatttaaatttgcatgtttgcgaagtgacgtatcacatattgatctatcatactaatttttttcaattttttatgactttttaagtgacatgtaaaaatgatcttagggatgaattgcgttttcccactatactctattttttaagagaaaaactcaatgacattccatggatttattaggcatcttgtaatttggtgtatatatactccggtcattgattgaacgataaagcagagatcctattcgcctgccatgttagatggcttctttttttccttgcctgccttggtacttatcctaacttgttagagcatgtataatagcagaatataagttagctataaatatattttaaaaaaattaaagaaaagataaaaaagcagtggactacaaatctgtagccagctgtaacacggactccaaaacataatgtgtgtatgacatgtgggatcagatattaatagtatagtaagcaactattgtatgaattgactattatattggttacagataatttaaaattagtagttgactacactattaaacttgctcttacagtgcaaaatgatcatctttttttttgagaggcaaaatgatcatctcgctgtgctttcactagtaacaaactgaaactgatggaagaattcccatcttgctgtgccttcatgagtacacactaaaacatacgtagtacatcgacacatagacatgagtgacatgctgaaggctgaagcagctagcagaataaaaaactccatgatatattgatattccattgctcataattcgtccacttttgggaaagcttggaataaccaacaccttgcctcaagttgatctcactgacctttcggctactactagaaaagatcaacgtacgcgatgcttgtgactgtgggtgagggcattcccaaccaagaaactaatatagattccataaacttaacagcataaaaaaaaaaactagtactatagacactattcttctaatacaaacactactattccatacttaaatttaatactacttatctcatataatgtcttagatgttgtatagaaactatgtctcatgcaagatattgtttccttctcttttcttatttatttacttaccacatcattttttatcttaggtggtagcttatttaatgctaaagacgcatcctagccctgatacggcgcctgcacccagacctgcacacgaccgtgacacactgacatgcaggtggttttgcgtttcagcgtggtgttgcgtactgtcgcctgatcgtccgtcgtgcggtcgtgccgttggtgttgacagttgagcgtgggatgtttctctcctttgaatattagcagccgcgtagcaagttatgacttactgtatatatgcatatcagagttggaatatatgaataccaataaatgaagaagattcttattttttttaagactgataactggggggcaaagtgcccacctttacatattacttggaaccaaatggcaggtttagccgcgtaagcacatgagccctgtagaataaagtgaaggaatacacgggagacttaaaaaaaattatgttattattttctcttcttttgggggtgggtgggtggggggggattttatgttgctttttgttgttagctacaacctccgtcctaaagacgtcgttgattttttatcacatgtttgaccattcgtcttattcaaagaatttacgtaattataatttattttgttatgagttgttttataactcatagtattttatgtgtgatttatatcttatatatttgcataaaatttttgaataagacgaatggtcaaacatgtgagaaaaagtcaacagtgtcatctattaaaaaacggaggtagtagcaatttttagctatgagatatacagctaaaaatacttacattttggaacggagggagtatatcatcggtttgttggtagccataacgaaatttttaattttaattagagttgattttagaaagaagctgtgagttttgcatgctaacgctggtccaaatattctcgtgtgcaatgtaatgccacaataaaacggtgggtgcatatatgtcgagcatcaaaaaatcggccgggagtactacacgatttatttagacatcgtcgacacatcgtaagatcgtcgaaataattttgtctcactccctcaacagatcaacctcgtctcccgcacgcgcgttaacaaagactataataaggctgtgtttgagggagaggagattgagaagattgggaagatacggaaaacgagatgagccattagcgcatgattaattgagtattaactattttaaactttaaaaatagattaatatgattttttaaagtaacttttatatagaatttttttgcaaaatacgcaccgtttagtagtttgggaagcgtgcgcgcggaaaacgaaacaaacattcccccatttgttctccaaacgaacgcagcctaagtgacgcgcgatttatgccatcagaagcgcttgctcgggcgcgcaaccctcgatgcagccgagcgcccggccaccgacacggaagcagatctctcacgctattgcacaccatgacatactgttaggtggtcttcttttctcctgaagacttgaagataaaaattaagttttttacgtaaaatgagatggtattaggtggtcttcttttctcctgaagatttgaagataaaaattaagttttttacgtaaaatgagatggtattaatgtatgattgattgagttttaattattacaaacttaaaaaatagattaatatgatattttaaaacaactttcatatagaaagttttcccacgaaatataccatttagtagtttgaaaaatgtgtcacacaaattttaatcttcatcgttggagaaaagaacaggaccttaagctcataaataattctcgggtccacatgtcaaccaccacatcaaaattaaggaaattacacgatgaggatctcaatcccaccagcacgacttcctcctccgatccttgcacaactcgtactctcgtagcggcgtggctgctggtggagacggagagtacgtagtcctccttgcggcggctgacgtacgtcgtgctcctcctccccctcgccgatggtagtgttctcgatcgtatgcgcctcgtagcgcggtagcgctgcacccgttgcacactgctgctttcttcttgtcatggtggcggcgaccggcgatggtacgtgcctcaagacaacaaccaccccgagtgcctcgttgcggacggcgtgacgtgctgcatggcgccgccagcgctgtggcagagacgtggtggcggtggttcagatgagcgtgggccggcggcggcgaaatatcggcatgccctgcttactctgtttccttgtcttatctgtgtacgtgcaggtgtagattgtgtttgctactgtatggcgtggtaagtgctagcaatgagacgcaggcagtatatgcgaccgatccattgatctagtttacggcttgcatttagtatttgttttaagaaacacagtagatctacggcggcataatgttcttttctttttcaagattaccggcgcatgcataatgttctatgttctcccactctcaactcccaagccacggttgtggccttttgtcggctggtgggctggtttctattcttacctgctggcgcaggcacagcaagcgggcgaggacacacaggtggcagcccaatatcccagcccatatgggtgttaccactaggctcggcttgcaacatcggaactccctagtcccaacaaacgttggccgtagtttgatggctccattccagttcgtccgctataataagagagattttaaataaatataacatattctaatatgattaatagtattaagatgtgttatattttattaaaattttttatattttgagacagagcaagtattaaacttgaatacaaccgggaagccgtgttccgccgttccgcgcgacgcgcgcgcccacctcgcgtgtgtgtatactgtcgtgtcggcttgccgcgtggtcgcgccggccgccactcgagtctcgccagggcttgcgcgaccgtcgtgtcgtgacattgataaccggcgcacgaccgcctagtgcgcgcgcaaaaggaaatatggaatcctgcaactgcttgcatgcatttgtgggtttgtgctctggctagcgcgatctcgctaaaattgtgcgtgcgctagccactataaaaagcatttttgcagacgacaaaaagcaatttttacaggcggaggggaggaccgcctgcaaacagacaacggtgaaaatcatccatcttcacaagcaggcaaatggcccgcctgcgaaaatccaataaaaaaacaaaaaaaaatcgcctcgccgccgccgccgcaccgggagagggccgccgccgaaggggagccgcccacgtcgccgccgccgccgctgccctcccccggtctccctccccgccgtcgccgcaccgggtcgccgccgtgtccgcgcgcgccgctgccaccgcgttcacgcaccgccgccgctgccctctcccccggcctccctccggccagatctaggaggggaggccggggaaccacgtcgcggcagccgccgccgcgctcccctggcctccctccggccggatctgggaaggaggggagggagccgagccggccccgagcgtcgccaccgccaatccacgcctcgccgttgccgccattgacccgcatcttgccgctgccgccataggtcctcccccttacccctcggccagatatgggacgaaggggagggagtcgagccggccccgagtgtcgccgccgccgaccagcgcgacctgtgccttaccgttgccgccgccgaccccgcgcctcgccgttgccgccgccgacctcgctggtgccgccgccgaccctgcgcctcgccatcgcgcgcggatcctcacctcgctggagagaaaggtgagggagaggataagtgagggagataatgggacttagaaaaaatctactctagcctggtctatttatattgctccttattttcgcagtcggaccatataaggagcgcttgcgaaaataattttcgcaggcgccgcttaagtggtccaaatatcaccccaatttatatttttgtagacggtcatttggcaccaaaagtcatgtccgactacaaaaaataaaaccccaacgttggggaaaatgttttatctagtagagagcccgtccatccccccgtatgatctttaccacaacagagaacacgtacgcatgaatgaaaaggagtactgtaacaaacgtgcatatatagaagcacgtcgaagctcttatttattcatgtaccacggtctcatttattctcgtacgtacagaccatagataagatgctgcatgtgcgcgtagacacacgctcgtacgtgcgtcagagcgcgcacacacacaccatgtacacgaccgtgcacacacacacacacacactcacacatagtcatacagaaactgcagcctcgcgtacgtcgtccggtgcgaccgaacgtgctcagccgtagtactggccggtgcaggagtcgtactggcgcccgccgccgtggccgtggcggtgctcgtcaccgtggacgaggtgctcctcccggtggccgcccagatgggcatcaccgtggcggctgccgctgtagcccaggtggccgccgccgccgccgttgccgtggtggtgccccctgccggcgcgcgccatctcgtccacctcctcgtacgactccctcctgacggcgtagtgctcgccgccggcgtgcggcggcctgttcatctcctccgcgcagtggtccacctccgagtagtactgcgccatggtgcaaacaactagctgcaaattaattactacgagtgtttctgtgatgtgcaatgcagggttacaatgttgggtttgttaatgtttggttctgctatttatagtgtgcctgcaacaccagcagcccccaaaggtgtgcgtgcgtgtgtgcaagggaatttgttctgagatagatgcctttgtgcattgctgtctgccgagacgtgccagatggccgtttcgacgggaaggtaggagagaaatctagacacatttctacctatcaatatgcccgcgaatttctgactgagctgaaagtttcaggcaagctagggcctagggaaggcagacagttacacagatcatatggattgaagcaaagaagaatgtagatggaataaaagaagagcttggatgcttggtaaatggagtatatatatcctgcaaactagaagagatgagaataacaaagaattaatgtaatgttttgttggaaaaagaagcatgcgtatattgtgaacgtttagcctcagttcgaaggagttgtggggcttgcttaattattagcggtatgcaaaacgagataaatcattagcgtatgattagtcaagtattaattatataaactttaaaatgaatttatttgatttttttaaagagacttctgtatagaaaacgtttacaataaatacaccatttcgagttgttctttagaattcggcctttagcatgaatgggcataccggcatactgtatgaaggaaaccattgtctgatttatgcatggttttatcggagaaagtaaatttcagtccctttccagaatttgatgagtatgttactctgtactgaactttgtttcaattaatatccgggtgaaatcttcttatgtttgcaatgctagaaaatcttataatatgaaacggagggagtactttgatttgggttgtgatggcatggatgtgacaaatacagtatattaagatttacatatttatatatgcggagcaatcctataagtatatgaccatatcatatgtaagaagtattaaaataaaaacttgcaaaagaacaaacgataatcctgtacatgcggaagaatatttggaatctgtaaactaatatgaacaaatagtgcaaaattgcattatatatccattttcacaagaagctcgttttcattctacacctaccaaactgacatcctttagtatggtttatgaaacctcaccaaaaaaaaggtacagtttataaaagaaccaattgataggaacaatttgtgtttgagctgttctgctactcacactgtttttttcttgtgaatgtatgtcctttcattattgttcttgtcctgcttggtagttgtcatcaatgaattgcactgcctgaacaaaaggcagaaagatggcatcctgatatattgtggattacagatgggatcgataacagagatgtacagagatgtgcaatctgcaatgtttccaccattttgaagttcttcctgatcgagcacaacttaacaacgagtaaagatagatggaccccgtgcatatataataggtgttagaaagggggtggccgggtggggaactatatacatgggctgcaggaagaaaatgtgttaaatcaatctacagtctcattaggagattggaaaagaattgaaggtaaagactacaagagtgtcctgaaatgacgagagcccgcgattgagtgcatcatgcatcgattggatcaaacagggatcatgattcatgagcatgagaggcaggaggagcacgaggatttggcgagttcgctgccaacgcacaaccatgtttagatggtgcttgttcgtaaggcgttttactaccagtttaaatcatgctgaattttcctttttgccttctgttcttctgttcttctgtaattggctttaaattttgttatcagctacacgatgttaattatcagtccttatcttttcctaaaaatttactagctagaattctgataagaaagatggttcaatacaaggaccattgtatattccatctgtcttgaaatacttttctgtggatgttattcacctcttaacttggttgtttttttatttgaagaaaatgtttaattacttagaagtatatttcctaacaaaatatattacattctaatataatcataaaatgttattatattttcctataaacttgatcaaacttaaagaaatttaacttgtaaaaagtcaaaatgacttataatatgaaatggaggtagtagtcaataggcatcattatttggaacgtgagagagtatgtaaagaataatttttaaagataataccattttaatagaaaattgtaaaatagaagttggttggctgaaagtttgtaaaaacagtattactttaacaaaattcagtatgtaaaaaagtaattacttacaaatgacaacgccgtaatagtatagtaggagtaaaatttagcatatatgttaaaattaaggaccttctaatttagcgtgttacaattaggcaccgttattggctctcataccctagcttccatacg

SEQ ID NO: 43969 - DNA, 1920 bp, Oryza sativa
agaacagtaatcgaccggtgataattaggacaagctttattatattcaggtcacgaatttatttttcatacaccccccctctccgttcgtagtgatcgcacagagaagaaggtgctaattagctaagctccgtgtacgcacgtacacacgcacgcacgatatacacgtagagctaagccaccacatgaccaccacgactacgtacgggcacacatatacgtacgtacgtacacgggtacacacagcaggttcgatcagtcggacttgagcaggaagctctgcttgcgctcgcggaactcgccggtgcaggtgttgaagtcctcctccaccttggtctcgcgcaccatcaggtagtcgttgccgtggttgtggttgtggtggtggcggccggagccggacctgtcgatctcctggaacgtctccttgacgacgtgctgctgctgcacgccgccgcggccgaggaagccgccggtgggggtcaccgacctcacctcctccgagcagtagtccacctcctggtagtgagccattgttttttagttggggagtgaggtgaggtggtgttgtgatgagcgagaaatggttaattagggtttcggtggtgtacgggatggtagggttagtgtagggggcggttttatagtgtggaggtgtggttagggaatctggttcgtgagagaggtgcatgtgtgcacactgcacaggctcacacaggctttgtgcttttcgggctttcagcttcgctttttggtgttcatctggaagtatttggaatattattgatttatcggccaggatgatacctctgcggcggctgggtgaactgtaattggacaagagagagataagatggactaaatagtattaatctgccgttaatgaggatgtttttcatgaggaatggtgggtgattttgagttttaaccagccaatcatggatctgtgcaagcaagtgttctgtacttctgtcgtgtacatatgttcagatttcagagtatcaactcacgagaaggcgcgcctgaagattcgtgctaaaatagaggaaatggagaaagccaatcttgaacatggtacatggaccatgcaggcagaggtaatatataatatgtttattcattcattagtttctaaaacaaaacatacttttattagggttttttttgggaagtatattagttaggtttgataataaaggtacaatggatgaattgttagagaacaataaaatattccatcgaaaccaattggtccaattaatcataatacaacgggcatctctgtttggttctcaaaatagctgaaatagaaccctggtgtttaattaacccttttgttactagctaaaaaactattgtcatgtaagcattttccatttcatgtggcttagctaagctgccttttaacctgatgcaaaattgcatttccatgttaccgctggtaaatgaacttatcgagatttgcaggtcacattcgaaataagtcaccggtcgggtaagaagaatatactcatcctttgtactacctttgtgttagtgggaatatatacttgcgttccgccctgcaccgcattattactgcacttgggatggtgacctcaagatgctcgcaggtgtgatgggagaaaagaggaaccaaagtttggaaatggtgaacacatccagacgtgtatgtgatcagttatgcgatgcatcgcccatttcagattccttccagcatccataaaaaaggaagaagaaatcattcacagcagtcattttctgaccagccgccgttggttttaaaccaagcggttattcaagaatgtggtacaggaggattccggaaacactatctggcaattggcatgatcatgagtcacaggattacaaacaaaatcataacgacagattaccaattgacttaagtatcgacgatcaatat

SEQ ID NO: 43970 - DNA, 1974 bp, Oryza sativa
tagctcgtcaagccgtgtaggtgggcctgattgtagcaatggcagccgacaaggacaacaaggaggcggctgctcgagacacggcaacagcgaagctggtcgccgtgcgtctgcgattgttcccaggcaatagggaaagcaagtaagcaacagtgacaatggccaagacaaccaaaactagtgcttagtgagtcttttaacttcattttcttttagaaagcatcaactactaagtataatccacctagctactttgtttatttggctggttcttcattattgtttcatcttgtttagaggactaaaacaagagtctcaaactgtgatatacagtacattagcttggtattttcttgtatgtactgagtttatattttccgtgtttgcattttcacagtagatgttgattcgaaatcactcggttagtatgtatctgcttatttcataaatacaatatgggcatttaaatgtttttcctgtggttggattgaaatgctcttagacgattcattcgtctccgccataactatgattttttccagggtccgccattggttacatggctggtgcggaaggaacgaaagtacgaaacacacggattttcaatggaaaggcgctgtcagtacaggccgggcgctctgtgcggctatatatggaggacaaatggaagacatggcaggaagctggtctgctaaacgcccagaatgacgacggaagcgcaatggggtggcgattggcgaaagtaacgctgtgtcgctgcgtatctggcttgagttgtatatatgtgctgggctggtgatgtgctctgtggcgccagctcgagtctctcggcggctctcgtgctgtagttcttcgagtcctgtaaatttgtggaacgttttttcccccaccttaataaacttcggccgcattctcgctggcccggcgaaataaattaaaattaagggcagcgggcagcctgattgccttcttctagtaccaaatatcaaactcatagtacatctaaataacaaaattagatacaactagctggtactcaaagcacattatgcaatcccacaaacaagaaccaacgagctttagtaagaaccaccaaataccatcagcataagtactagtttactacgtgagagaaatatcacgaaatttgcaagtaatgaatggtgcaggatttcctagtgctccttgaagctagattttcgtcctaaagttggcaagatttgtgttattgcaagttgctagagctgcaaaagctgaagaaaaataatctctatccccaaaggtgtatctcgagccagagacttactggaggcagcgccacggagggaggtcaagcggtgggcggcggcgagatccggcccggcctcgccgctcgccggcgcccgctgtggtgaaggggtgaggagagaagaaaaaaaaaatggtgaagtgaggaagaagaaaggggagaggaggaagaaaaaggaaaaatgacgaacacgatgaagatatttgcctcccagttgacagctgtttgccaattttgcaatcttatccttcgacttcttcaaactgccacataagggtcttctcttttttggctttttatttctggatccttagaaactttcttatttggcggttgagtccttagcatcaccgcagcgtcctactctctttcccgtgctcgcggagaaatttaacaatatgccactctataggtgtgactttaacatgatgccacctcataggatgaccttataaaaacgccacttcgtagatgtggcttcttaatgaaatgccactttaggatgattagaggcttttaatcatactttgggtgattagcacactttttaaccgaaccatcgccttctaaccacctcgccgctgaccacgacgacctcctccgctttcatcgccgctgtcgccgagcccctctgcctcgcctcccgccgcctcgccgccgtgctccacccgctgctcttcctcctc

SEQ ID NO: 43971 - DNA, 4320 bp, Oryza sativa
ctgctgctcctcctccttctcgccgccgcttgccagtttacgcccttccgctcagtcgtcacccatccgcgcgcccgccggcgtcggctcccaggtggagggatgcggcggcgggccacatctcgcttgcgggctccgcgcagcccggcgccgaggcgggcgtgggagtattcggcgaacgcgagggcaacggcggcagcacaagcgaagaagggaggaaggagtggtgggaagggccgagagacgtggagcaggcggccggcgaccaccacgtcagctccggcaacaggcggcaaggagccgcctcgtcacctcgtgctctccacggcaaggcagtgcagggacaggaaggaggacccgtcgcgcgttggccgaggtggggaccatgtggaagatgggcagacggcctcgaccccggcgagcgcgcaggcgagggagacagggtcggaaaggtcgacggcgaggtggtgggtgagtgggaacgtgaagaagtagacggcgtgggcggggccggtgccgagcgccatcgcggggaggcctcggtacaacgccctgacgccgccctcgccgtcgagctaggcccgtcgtcatcgcgtccaactaccacctcgttccagagcaccgcctccccgcggcgctcgaggacaccgaggtggctctcctttggctcgcgtcgcaggcgcctcggcggccaaggaaggtggaacggccgagagaatcctgttaaaacctctaatcaccccaaagtgtgattaaaagcctcaaatcacctcaaagtggtatttcattaagaagccacctctataaagtggtatttttataaggacatcctatggggtggcatcctgttaaagctacacctatagagtggcatattgttaaatttatagtgctcgcgttatctgtacggctgtaccgttcgtttgttgtgtattgcgggaacacgatttgcaccgaaagtttggaaatttgcctcttcaataaaaacttttttcataaaaagaattgtattgataaaaaaaagaagtgtaacctcgcaaccagccctaatggcgctgagatccaacaggttaacattgtgctaagtcttcactaataagaaaacattgtgctaagtccataccaccgccgtggctacctcgtctcgttatcgggtcaacgtagcaaatgggtgtacgccataccacttggcgttgaaccaccgacctcaacacaagggctactatagatttaacttacattcaggagatgcttgaaaaagttaaaacaatcctatcacatacttcctcctttccaaaataactcaatttagtatgggatgcgactcatcatttattcttcagattcgttgtcctaggatgggtcacatcccatcctatgttgagttattttgggatggatggagtataaaatcacaatgtcattgtagcatatggttaccgatgcttgttagttttaatttaagtgaattgtaatttgggccacattttattgctaaagttatattttgcactacctttaaactaaccttattatttttggattggataactgtgttttttttagtttggaccacccaaaaaaacttaattaaacacagatgaacttctacatccctatacaggctgtattttcaccataaatagatggtagacatagaattgggtggttcaaagaaaaactttatttaacaataaagagtggtttaaactacaatttactcatttattttttaggcatggatttgaccaacagtgttatttaaatatcaaatcacgtattatcttattgtaccttttcatttgtgtcctttttacactgctaatagagtaacgggaaaagccagaaggcttagggcttgtttggtttgaagccaacttttactttactacaatcttggtagtgtcataagcttggtaagttttggcactaacaaattgagtagtattaagattaaactttatggtaaaaatttgggtagcaaaccaaatatgtatttactactattgaagttacaagaatttagtagcacaataaccaaacaaagcccttaattactttcggtcaaaactaacaaatattaacctctctaaaatcgaatttggtaggatttgtgaagatttaatgcgccacgtcagtccaccttttgcaaaagaaccccgctcgttcagttaattccgcaccaggtccccgctacggctctacgtccaccgtccgatctcgcggtaggttcgatcttaccgtccatgtgtctcactgtgacggcctttccacaccgctcccccaccaccacgcgcgccgcctcgccccacctcgcgccgtcgccgccgccgccgcagctccctcctgctccactccctcgccctactccagctgctgcctgtccctcccaccgagcagccggatctcccagtgagtaggcccgggccgccagatccggtgaccccggtctcctcgccggtgtatccggcgccgcagggagggacgagagccgccggcgctgccgccctttctcctctctcatccctgccacgccactgcctccctcgccctagacctctacgcctcgatcagtgcggtgtaatatggctcggggaccgtctgactcatcgaccttgacagaaggtgagaagggaggggagagcgccgactcggccacgaccgcgacgaagacagccgcggctcggcgtcggcaacgacggctacctggtcgttcctgctctcctttttcctttttggttctagctcagtgccatgagaaggaagtggctggaccttagttcttgatgacgattacaaccttgatttgcttataatgtgtgtaaggcatgatttagttacagtgtgtaggttgtgcagagaaatttccctcggcatgtacttcaacactgtcatgtgtgatcaaactgtttagtttgaaacaatgcacactgctactcacatttctctatgctgcgattatttatttcagttaggaattgcatatacaactttggagggcaaaacgataatgttgataggtttatttgttaccatttgtgctgcagggcgtattttcatattcagacagttttggaagctgcaagtacacatggcttgcctcttgaatgtacatcaaaggagttttttatatgctgctgtactgtgttcctttcactgatgtgtgctatatgctccaagcgcataaattacaggtatgttccacaccaatttccatgtggtttatggttgtccatctactatatttcctgaaatttccatgcttacatatttatattagctacttagctccaaagaagtctgtaccactatttgccattatctctgttcagttatttcattttgtaatcttatcttctcgattggcaatgatgtgttgtttgcatctgcttgaagcagatatactgcatgcatgcttcagcttcacatcaatgttgatgtagtatgttattgctcatctaatatttggtagcattcttcattcattaatatttcatttatctcagtgaagactttcattctgtccaccattattgctgctcagtttttttctttccaactatataaacagtgttctaaaaatcgccattaggcggcacctcggcgccgtgattagcccctcggtggcgagttcggcggctgccctgccgcgacggtcaacatcggtccacctcggcgcctaggcggcctaggcacggtggcgactagtcgacgaggcggccgactgagctagctatgcgggctgctgtggcgggtatataaggtgggtgcatcctggctgcttgacttaatcccaaaatcagagtgcgtgaaggggcggctagggtttggagctgccttaggacggtgcgcaggcgcaggcgcaggcgcagccgccatagtagtttgatccgccggcagctcagctgctctgcttctctccgcgaccaagcgactagcctaccatcctctgttctttttcacacggtcgtgcttgcgcagttgtgcctcgactcgtcgatgactctgctcaggtgctcaggtgctctgctctgcccccatccttcctgccaaccaccgtgttctgctccaagctgccgacaccagcaccaccatggtgaacactggcgaatcgagcaagtaagccattctctttgctttgctgctctctaccctctactcctctgagctcgtctcaaatctcaatattctagtattactatgtgctatgctctgttactctactctttacttctttagtatttacttgatctaaatgttcttgtacaaattgctcttgtttttgttgtgggtgtggctggtggtggtggattggtgttg

SEQ ID NO: 43972 - DNA, 3258 bp, Oryza sativa
caatgcttattatgtggtcacaaaatgcaggatcaaagaacatattggccacattataccatgcaaagtctattcacatcacaagacattggccttgatgaggaagcacacgaagaagagagataccataaggccgggtgtgactagatttgctttagcatttctaaccttgcaaagcttgattgagaagaagcgtgagctaagggcaatggcgcttagtgtggagtgggattgtgggaacaatgcacccgcactaaaaaaagcaaaaggcaagatagctacctctacactaatgagtaggaccttttggaatgatgtttctcagtgtttgaaggtaatacaagcatcctaaccttataccatgtgctgtcctgcatgttgatcaatcaatatttgcataattgacatgtgctatttcatctcttgcaggtttttgagccattagtcaaagtacttcacatggttaatagtgatggtctatcctgaccttcatctgtggacaaattctagaggcaaagaaggaaatcatggtagctgcaaaaaacttggagaacacctacaatcccatctttgaacatattgctaaaaagatggagggtaggcttgatgctccactgcatttgacagcatatatattgattccttattacacttaccatgatcaatctatctttttggatccttctatcatggatggtttctttgattgtattgaaaccttttatgtggtgatgatgatcttcaagctcaagtgatcaatgaacttcccaagtttaaggactagctaggggcatttgggaaacctgctgcggaactggatgtcaaaaatcgcatttctcctggtaattttctgctgcaactacaatctgcattatatttgttccatgttgcattgctgtgtcattaactcgttatttcactatttgttaaatgataaatcatacttcttatagctgactggtgggcagcatatggatgccatgttcctaatttgcaaaagatggccataaggatcctctccttgacatatagttcctctggttgtgaaaggaattggagtatttttgatatggtaacttgtcaaccttacatgcagatgcagttagcactttgtttagttgctactttcaattaagtatttacttcgtcacttctgaatcataggttcatacaaagaagagaaataggcttggggctggtcgcctaaacaacttagtctatgttcaattcaatgcaaggttgctgaaaagggctgagaaacgcaatggaaaaataacaaagatgtgctcctagctacagatgcattccatgcgcaagggtggatcactgatggtggagatgaggaagatattgatcccatttcaggacttccattcagtctcatctatgaagcaagtggggctactaaagccatgcaacctcgtaggagtgctagagtgagggagcttcatgaagatgatttcaattctggagaagaagatgaggccaatgaagagggtattgactttgagtctgacaaggatgagatcgttccaactaaagtttatgaccaggaggatgaagattgactcaatccttgatgattgatgtaatgatatcaattttgcttgcttaatggctacctctgtttcctctactatgcttattttgtccaagacttgtgagagttgagaaactgagaactctggtttagtttcattgtgctgatatggtgtattagaactgctatttggcttttccgctttggcatatgtaggttaattattctgaattttggataatctgcttcaaccttcaatgtttcattgcttcttgcaccttattcttgttgaggtgataccgtatttaaccatttgtactactgtcctgagtcctgtggaaacagtggtgattcaaccaaggaaccaaagctataaaggtacattttctcttaccaacttatttttgtattgcactattgccaacttaaaagttgacaattttaattatactagcttaactgactatatgattatttttccattgcattgctggcatgctgcttgttgatgatgagcttcttcactgagctgaaggcctaagccctggaattggaggtgcagttgtatgttcagcctttggcatgttggcaccatcaaacaaaaggtaatataaaatattcaaatcctaaacacatgtattttctccaagttggctgttggcatgctgcaatttgctatgttatataaatgaaattgataaattggcttagccattggatacaagttgcctgctgactcctccctccctagtcagacctaggcgccacctagttggccctaggcgctaggcaccaccctcccgcccaactagcgtctagcgtcttcttgaacactgtagataaatgcctagatggggaaaggacattctctgtacaaaagagaatgttcattttttttaagtagcacagcatcatttttttttttagattttatagaatgtcttagcaaattttagagaggttatgagtcaacctttgatgccatatttctgtacaaaaaaagatgagcaccaaaagaataacatgttgtttaaagaaaatgtaattgttgccagtctccagattatgactatacacacttttaggatatgtctcggacccgatcattttcattaaaaggaagatgactccaattttgagtcttgaaaacattcggtctctagaataaccttgatttattcatgcttcatgacatacctctatattccttttttattaggtcgcaacagaaaatggatggattggatccatcatggagagatgatttcctgttcatcttttaaacggacacaaatttcatttaaaggtacatttcaatttagtttgcgcatcaacttgttcaatggcaatgttttcctaaacatatcctaactgtatattgctcacgatgcaaaggtaaagcaatatcatgagtcaaatctttttatattttatctttgaattggtttgctttaatatatacatctctgtgctcagagatagattatttcattgtttagtttatcaatcttttttatacatgttttatttcattatttgtgaagccatgcttttgaatcctaaaatttgtgtaaccgatctgtttcgcaaggttgctgtggttcgtcaaactaagtgtaatctgctgccgctgtgctctacaaagctcattgtttcaacgttgtgtatttgacggctactgacaaaaggaccagggcagaaaaaaaatggagcctaca

SEQ ID NO: 43973 - DNA, 2993 bp, Oryza sativa
gggccagcagtggtagaatagaaagatacacatacactgatacgcatgtgcaacgctcgtttctatatttgtgtacatggattctccagttccatctctgtagattgatcggccctgtttgttggcaaaggctgtgtttagatccaaagtttggatccaaacttcaatccttttccatcacatcaatctgtcatacacacacaacttttcagtcacatcatctccaatttcaacaaaaatccaaactttacgctgaactaaacacagccaaaatgtttttctaacatgtgtggacttttgatgaggaggcacaggagaatggcactagcagtagtaacagacggatgatcactgttacagtgctgcccatgtcaaactggaatcctggatgagggcacaatgtgcaactggaatcccaagcaggtagggatccaaattattttattaatggactggctgtgattagcattcgtaatggtacgtggttctgcaatgcagtcacagtttttaccgaatacattgtagcaggggtagtgtgtttcaggtcttccagacgaggttcagttgagttcagtgcagcttgtttgcgacgtaaaggaggtggctgatgtttgttggggggtagttctgcaggagcttgagattggaagtgaaatcaccagccaataggcgttttcggacaagaatcagcattgcacagcagattctgagcaaggtctcctgcactcggcagataaagtttcaggcgacgaactggaaaaaccaagccttgcaggataaaccagggtgttttgtttgctacctgaggaccatcaggatcacttaatagtgtgtcccatatgtgaatagtgtcagcaaagttgaactcctgggttaacagtagcgtaatccaccggaatgcgtagaactgaggattaatctgcagaaacagaaaccatgcttgtgttaattttgctgcaggcacaaataaggatagcagtggcagtagtgtggatttcctgctacaatgtttcctagcatgatgacaaaactactgtatgaattattaggtccatgccagatcgaaatagatgcaatgtagtttgaacactacataaagcaaatctgtcagaggaccacactaaacacatcagaaattgacagtactcagtacaaagaacatacttacttctgttgttatttccaaataacgctgaagctctccatcatacttcgcaacaagttgcgacagttttgagagagtaccttgaatgccaacagcactgttgtctagtttctggcagaagttgtctctaaacccactaagtaactccatgaagcagaagaaagaatcagcttctgcaaagttctgtagggattccggatagcaaaataaaatcatggttagatagtcccacagaaactattgctataacgaacagcaactgactacagtctgctctaaatcatacagggcattaagcatatatatggtaaaacaattgcttactccatacagcatttttatcatctggatcattccgaaacacaaagaagagaggtgccaaaatttcattcatcccttgtacataacgtattccggcattcagctttgcaaagataatcagtatatttttcagagattcctggtaaggatgacctatgatcagtcaggtttctgagcagaactctgtttagacttagatagtggagttcacctgattggactttgcaaaagatgagtctccacagaaaaaatgcatgtcagggtgagtgcgcttcacatcacggtcaatttgctcgataatctctgaatactgcacgaaagatatatgtcaaagctgatataaattagtagtaacatcagaatgatgcaagctggtgaaaaatacaaacatagggtgcgcgtactagaacaaaaatctgatcctcctaatactaaaatgcaaacctattcttttaaccagcacgtatttgactaattatgtagtccccaaaataacaaactgaaacaaagaagagcacaatagtttagagattagcatcatgtcaagtggtttacaatattctagttatgcttggtcttttctatgatcaaatcacaaaagctccaaaatagttccaaaagaatgtaagcacatctgctactggcaccaatctagttctaatataagatctaagaagatgcaactagtcacaatgtgacaataatttgtagatgaacaaacaaacaacaacaacaacatatgtaaaaagatccatatccaaaggcaacagtgggcacctcaaagaactgattccatgcagttgtcttcccaaggctcaatgggtgctcttcttgtgtaacctctgatctatgaagtaacccattatatatactccctgcattctcactcccttggccttctaattcccgttgccgtgcaatttccatctacctaacagaattagaattcaggatctctattttgtagtgaggtctaacaagcaaaaagggatctcaggtactatactacaccgcacgtgtatcttaaaattacaatcaaaatagagaaagtcacaaatctgaatctgaaggggcatacagggttgctaaggaattcttctttaaaggctgcgtactgtgatctcttctttgccaactcctgctcccacagggcacgatcactcggcaaatagcccagcaacagctgcaaaactaacatagattttatcacacataaagcataactttttgaaggctggcatgctgatcacatcaaattaactaacagaaaaaaaacagcagccctgagtagatgaacaataggaccataaggccgattttaatcggacattacgtcataaaggataggggtaaaggattagactaaataatggacatgtgtaatcaacgatcagaaacataagacagtagaataattgaacaatgtctagactctagaacgcaacagaaagtaatctactgtcattacgctcatgaacctaacctccaaacctgtacggctgtacct

SEQ ID NO: 43974 - DNA, 5205 bp, Oryza sativa
aagatacgcatcgcgatccgttctggtccgtagatcttgtgggacccggtgtaatacgctcatggacggctcagatcgtaagcttacttttcatgcttaagtagggcccacttcacggtctcattaaagcggccaccagtttcatgtgggcttcctaataattgagaatgtgtactgggccgaaatttcggcccagctatgaatcccagtttagtcgtagctctgtcacaggcctaactgaagtgcaagcccaacaattatgtacagcatcagaaccaaactctgaacttttttcttttttatttcataattattactgtttttttccctcgaatacgcttatacacataagagctacgtatcattgcgttaagaagaagagaagtacaagtagacgggcattacaaacaccagatcataattaatttacagatagatctttgacgtacgatcagaggcaaagataagaagaggaccaaggaaattgaacaaatgacaacatatgctctctcttcatatcaatcgcacactcaaaaaaaaaaatcaccaacttgtactgtgttgggaactactaaatcattttgacacctaacaaagcttgcgaatgatgctttcattggattgtgacgatagtgacaacaagattatagataccatctcgtgtttggcacataattaatctctgtcaatatcaagtattagtagtcggtgcaggaagctgaggcgaagtagataggaatgctctgcaagaaaatgataacgttagaggtgatcaactagacgagtaagtcagaaggtcaggcgtaagtgtacacgcatatataccaagtggagtattttacggtgcagatgacaaagtgacgtatatatgttcctagaacaaaatcgagtgcacaagtctgaaactctgaatttgactaggccaggaacaaattggtctttctcaacccgtcttaaaaaaaattggtctttctctggatgaactgtgctgttagttgcaatatcaagcgttgagatctttgttatgggtcagcttttcagagcattttccatgtgtgtatataatagtcttataatgggaaaattagctggtctgagacaaaaatcacacaaaaagggctgaccacggagtagttgttctggtcttgcagcttgcaggttaaggcccctagtcacccatgtgtttatcccagcatcataagtccctccatgattctttttgtctgccttaattgcagaagtccttttcattacttgcaaattataatcggtaaatttacatttaatatagataagttttgatgctctggcatttgaacagaagatggaactagtgaatctgtgatgcggatattcagtgtgcgataattttgcagcagctcaactctgaagccgacagagcccgcagcaatagtgtcatgcatgaacacacatatgctgaagtgttaaacaggtcaatgattaatctggtcccaccccatcaatgtcattagcagtcatcacctcctgaactaagattactgcaatggtgacattggattgctgcaaggggcaaattaacctccttctcagtggcccagaaatggcgtgtctgaaaggtcaaactataccagaagaaaactagtgtacttaggaaatttgtttggtaaacgaagtgatcagatatctcaagcgatctaataaccatctatcttaaccgataagttgaatctttttttaggccatgatgtttggtataagcaattcttagggctcgagaaaaggtaagctcaacagaaagctaggtataactagcataggttctttcctccagattaatgcatagctaggtataactagcataggttctttcctccagattaatgcatggacctcttcttcatgtcatgcacagactacttaatttatccatggaattaaacatagttcgtagctaaccaaaatatgctctatagaataatcttggaactaacctttggcactccgaagaagcaaaaagtgctcaaaagtgcacatttaagaacagtgcatgtcaattcaactgcactatttatattctgtagaattctttagaattgctacacttgatgcaacagatcaagcatggtttaatccatccaaaaagagataagtctcacaaaaaccatgcaccctactcgccacgtccgccgttcatgcatgtggccgagacatcccataacccacaaccaacttgctactaattactcgattagtaactaatcgcggggccgtacaagggggactaaactaatcaggcgccacgtcggatgtgcttaccacgtcgcctcccccggatagagcccaaggtggtcgcctcgccgcggaggcgggggcgatgctgagctgtcactggctgttgcttcctttgggccgtggtgggcccatgcggatgaggacggggtggggcccacgggggcgccacgtcgacgttgtggggggaggcttatgtggcgcttgctcgttccaagagccggtttagctactcgacctctaggaggcgacgcgaccacgcacgcccacggcgcccgcgtttgccagccagatttttgcggtttgatcccttggttacttgtgaactctgtagaggggctcgtgcatttttgccttatgttagcgttttgtgtcggccacttgtgtaactagtggtactataaattaacttagctaccatccatgatctttgcgtgctgattgtaaaagacttcctggagaactgtagacagagtagggaatatttttatactgtatactaatgctgtctcaaagataaatattgttagctataaatctatataactgcgtgttcatatccatagctaaaacctgctataactcgctcaatatacatacttttttttcctcatatgattacgttccataaataagtttgtgcagttgacgatggtcagcccgtcttaaaccaacctcacgtagtcacgtcctcaccacgcacagtgtagagaaggataaagggcttttgtgaaaataaaattctacccgggggcttccatcaaaaaagaacagccgttcaaaggaccgcagtttttggatttctatataaaccttcaaaaacccgcggcaattgccctcagatgcatagtactcgcacgccgcgacgcctctgctgaacatttcgctctcttccaagatattttttcctcccacgattccttcctcccatccctgtggggattcatcggctcatccgtactagcacaagatgtgcgagggtgtgcgggccgccggcgacgccgccgccgccgccgacgtcgacgtcatcacctcctccggccgccggaggatccccgcgcattccactgttcttgtaagcttctcctctttcatcagcaaattcatgaatccttttagctggagatagtttctgtggtcaaattctggttggcgtcgggcgtgttctgacgaggaaatctccgtttaattctttgtttgtttggtttgatcaccaggcgtcggcgtcgccggtgctggagagcatcctgcagcgccgcctgaagaaggagagggacgccgccgccggcggcggcaaggtccgcagggccgtcgtcctgatccgcggcgtcaccgacgacgccgcggccgccttcgtccgcctcctctacgccggcagcaggtaccgtgccctcgtccattccattcggccattcccctctaggatgggatttctgctggtagtctttgcttttcgagcatccgtttcttgcaaaagatgggcgattagttgaagaattaatggtcttcgaagactaattactcgtattaactcacgagggggaaagaaaaacatgtcacacgtgtaggccacgctgacaagaaactcgatctcttcttctatggtttagttgaaaattatatatttttagtttatttttttattagagggtacgttttttctgttgatcatggtagcagtaattggctactaataattgctacctaaactatgaaaacggtagatacgacgaaatgatgttgaaagtttttaagcgatgataaacagtgggtgaaaatatgcttaatcactattctgtatctgtagcagaacgagcaaaaccttcggagcgaatgctgtaggaaaaaaactgaaaaaaaaaatctggtgtccaaagtccttgctagataggcagtccaatcaaggcaggcccggctaaaccacggatattttcttcatctatcacacagcttacagatccaatgaaccattccaagaatctcgctaagtgattagacagatcgctttggcagcctccgtgataaaatcccctccaagttggccaatttgccgattttttgtgcctcatcaaactgtgcgagtcttgacaaggcaggtcaggtaaggtgacacaacacaaccccacacaaatgacacaaacagagcatggaaacatcgccatctccagctccgagagccgtaaacaaatctcgtggagcagaatccatgccttgcctcggcgcgtcgacttggacggcacagacagagaaaaaaaaagagagaaaaagtagtagtaaagcgaagcaacgataagtactagaccactagagcagtaggagaagtcgagaagaggatgattttggctttctttttccgccgcttggtttggagtttggtgtggtagcgcctgcctagttggaaccctccccttgcaggcgagcaccaagcaggcagccgatctcgtcggcgccacaagaaaaatcgttgctgtcgctggtgcggcttgcagggccgggaccgctcgccgcctcagccatcatctcgtgttggtttttgttgaaaaaaaaaaagaactctctttttgtgtgtggagatgcagaggtagggacctgcccaaactgtcccagtgtcccgatccgtttgaaacgaatgaagactttcgtgcctttctcaacattagtaatagagtaaatttcacaaaagtagaagttttatggttcaagttgcagaaaatcacacacattttgacacttgacacttgacacttaagtacatatatttcggtagtttagtttcataaaaccacactatcgatgaatggattcacccgtgagatgatatggttgttccacccgtgagatgacgtggttgttccatctaagatgaggacgtgacatcatattaatttcgtgcgatggctggtaatagaatgccatgtcctcgtcttaggtgta

SEQ ID NO: 43975 - DNA, 5078 bp, Oryza sativa
ttggctagattagttaccaaaccagagacacgacccattagctgcaggatgaactaccacaacatcttgagtcgaggggtggaagaaaaggatggtgtcatttgcatacaaggacacttgcaagggcatcacgtcgtcaactagtggagaaagcacccctcgttgcaccggcgtggagcagagtgccccaaacgcctccatcacgaggacgaaaagcaggggaaacaatatggatctccctactgcaatccccattgtgagcccgatgcctttttgcgttgtagctgttgatggagattattgttgacgcccttcccagcatgatggcaatgccatccctgcattttttcccccaaaacccaagtgactatcaaatgccttggtgatattgagcttgagcaggatggttggtcactttcgaccaatgtagcagcccgatcgcccttgaacataaatgaagttctcctggatgtgcctcttcttgatgaaagccgattacgctggtccaactagctcacccatttgtgcagccaatctggtagccatgattttagaaaaaatcttcgcaaaactatggataaggctcattgggttgtaattcgagagttgtatcgagtcttctttcttggggaagagtgcaatcaatagatgtaagtgctaggaattcacttgcaacacaagggctagaattgtgagcaggtctcctttgatcaactccgaacacctcttataaaattcattggtgaacccatctggccctgatgctcagtccgttggcatttccaagaccgccttcttcacatcttcagcgaactcaatatctagctttgataggtcaaagtgaggcaagtcaatgccgtctagatcaatgcttgatgaaggagaggaaggcgccccatgatgtcaaggaagaagtcgtgaaccaatctcagcttgttgctttctgttgtcacccattcgccgacgtgacataatattggaattgctttcttgtgttgtcgtgcattgatcttgggttagaagaattgagtgctggtgctactatgcttgaggaaacatagccaagcccgttgactcagcctgattcaatccagcgacgcaagtgctagacaacggcctttaagcgacgtgcggaggaggcgctacgggatgtcctgcgccttgtttagctggatgatgatctagtgcgccgctgccaattgcatcatgcgggcactaattctgtttgatccccaggttcttagcatcgacgccgctgaccgaagcttgaaatggaaggcactaatcgcgttggaagttggaacttggtcgagctgaattccatgcttgctgcacaacctcatcgaagcactccatccgggtccagaaggcctcgaatttgaactttcggtgctggtgcatcggctgatcacaagtcaatagaagcgagcagtgatccggggcttaggagttgagggcttgcaggtgtgcatccttgtatacttcctcgattcctcccaatcagcattcactaccaccttatcgatcttggaaagagtcagtcgttctcgctcgctgctccatgtatagcgccgaccaaaaaggtacagctccctaagctccaaagcattcatgacatccctgaacttgcctatcagccttctactaacattgccattgtttttatcagattccgctgccaaaaggttgaagttcccgacaatacaccaggccccttgcacaaactcttgcccgaccgatagtaccttttccaggaatgacaatttgcctttgcaccaaccgtggcccatacatcctcccccttccccctcccccttagggatggctattttgcccatgggtccgggtaaccgcggatacccgactcgatgggcacgggcatgggtgtaacattttacctatgggcatgcccacccgatgcttgaagatatagtgggcaatagccgggttttgaattttacccgtgagtaacctatgcccgaccagatacatgtacataatatatatatatatatatatatatatatatatatatatattagctattttttgcccatctcttaattctcatccccttcttcttagtccatttggcccattaacagagacacatatactcactcactaaactctaacctaattccccacccccacctctcccgtctacctctctccctagtccggcggcggcgcaacaagcggcggcggcaactcatgcaggcggcaatgagttcactgctgccgctgccgtcgctcacctgactgcatctggtgtttgctgttgctagatctggtgagagagcgcacgccgccaccgctccttgcctcttccattgcactgctgctaccgctccgctcccttctcaccgttgtggcggcggctcagggccacgatggcggcgatggcgtcttagcgtgatgcatacaatggtggctcagggcgacgacattgacgacaatggtgagccagcgacggcaggcggcagcaacggcaggcggaaggcgtgcccactgggtatccaccgggcatacctgtgcccgtcgggcataggtatgggcatagagttttgcccgctaaccctattgggtagagttcgggtgggcaaagttgggtgtcgggtcaggcatggttttgctctacccgtgcccgactcgatccattgccatccctactcccccccttccgcccttaaaaattggtagaacacaagctcagtgaccaagttccttttctgacacgagacaacgaatcgattgcttcgctaggctgtgaagagacaccctcccccttccatcgcaccatcagtcggcaggaaatcgaacacatcaaaaccgatactacaggactacaggacttggcgataaacaccttaccaacaacaactaatttggattctgataattgataatggacacatgggcattttgaaccacttcagcgactagggacctcttccttacctgattgagcccccttacattccacaccaacatacaacacgatgacataagaaatagaagtccatgacgggcacaaacttaatagatgcttaccgagcttctatagcagcatgcgcctgcaaatcacacaaggtagcaagggcctaaacatgcgacggagcgagaggactcttgaatagccctaggtatcaaaggatatcatgttcatccaccttgttctcatccgccatgatgcccaaactcttcattatggatcattgcgccttggtcgtcgtgtgcacttgcttgtcgccgttcttcacttctatacgcccattgtggtgtggtgtgaacaagaccgctagcttgttctaaaccaacgcgcggggctgactaccaagaatgctggagactgcatgacgtccgccattgcttaaacaaccaatggggtgctgccttgtgaagaacacgccgcctttgtagctgatggcggttgggcagaaacggtgacgaggattgctgcagagtgggtagccctagctttatcacttggagccctcgacgacatgtcgttctgggccaccttgcaacctctgtcaccttaggttggcttaggttgagatgctcaaccagcccattagcctggcccgccgatcgatccagatcaaccaccctcctggccctcgcgtcgtgcggggctgcgcgcctagagaaggtcgtaattaggctggagaagcgcttgcttggcccaagcatgttgtcgcctcctgatggtttggaacttctcgtctcctacttggctgtaaaaaagagcaaagcagtggttgtctcaggcggggaagcagctgaggttactggctaggaattcactggctccataaatgcagcattgccatggagatcctgaggaagatcttgaaagcataattttttttagtggtgaagcacgccgaggcgaatgccggacatgataactccttggaagaaaaaggcgccacgtcatcccggtgccatgtcatgcgaaacgatacgcctcccccctccctcgtcatgtcctgcctagcaccggcctagggttggtgccgtcaatctagccaagggaggtgttgtacgtgtgcaagcagggtgtcaggaggtgggggcaccgggtcgaccgtctccaagatgaggaggccgaatgtcaagcacggctttaaggagtgggcgtggcggtgtttacactgatagcgcctaacatgtcaaggtggtcgtcctctggtggttcccaccattccaccatcagttctggacaaccaccattccaccatcagttctgagatgtccagaggcggctccttagggatcagagaatgatttactgcccaggcaagcaccttgaacgtgcatgcatccgctggctcaaagtgctcgataagctagcggttgagcttgttgaggatgtgcttgagggcctctggctcacaggtatgagcaggtaggccctcaattgctagcctgatgacgtatggcatcctggtattccttgtgttggtagagtggctcaaagtgctcgataagctagcggttgagcttgttgaggatgtgcttgagggcctctggctcacaggtatgagcaggtaggccctcaattgctagcctgatgacgtatggcatcctggtactccttgtgttggtagagtggtgccaccggcaaaagacaaccaggtattgtctacctggaagtggctggattgtgtgccgcaccattgtgcagtccccgtaaagttagagggcctcatcaccaactctaacgttagcccacaggatgccacaggaacggcccaacgcgtcaatcacctgttaacggcaaaatttggtaagattctttagtggattcggttaaagaaagagcagtcagtcgacagaaacttatccagaaaagaccgagtttaagaaggaatcgtgaagactacggcatggtgacttaattctatctactccctccgtttcaggttataagatgttttgactttggtcaaagtcaagctgcttcaagtttgactaagtttatagacaaataaagtaatatttacattaccaaattagttttattaaattaataatttaaatatatttttataatgaatttatcttgggtt

SEQ ID NO: 43976 - DNA, 8380 bp, Oryza sativa
  unsure (1)..(8380): unsure at all n locations
tcttataacctgaaacggagggagtattaattaggtaggatgtagtaatttccttttatctttaggaaatgtttatttagtgtccgatcaagacttttatctttccttttatctttagaaaatatatgacgtgttcgatatggactagtatctacccatgggtataaatatgtacacttggggtttttgtaatctatctctcaatcaatagaactttggcgcatcgccaccctttttattttcgtctttctcgatgagttcttgtttcaagttgggttgcatcggcttcaatctccgacaaggggtaagactaattatggttgtttgtattggcggggctagggcctcgacactaattgtgtcggcgtaaacacctatttatcatatatcttagttaatctaagtcgatgtctcaatttacctttataggacagatcttttctagggttttgttggtatcagctaaattgttttatcaatttagattagctaaggtatccaccaccttgaaaattagtctaagacttgattgtttagactttatgtttcttttcatatttagaactgcatcaattggatttgacctactaagtcgtgcttagaatcataaaaactaagctgcctttgattgccaataagggtttcattgcgatttcagtcgatgagttatctggacattgcattggcttacaaggattacatacaagttggttttagccgattgcaacaaaggtttcattgattatcgaatcttatggatttaatttaaccttcggatcaagcaattattctatcatatcattattgactaattggtttctattgaattatatattattttattacattatcatcagttgattatctttatatcattattcattcaagagtcagactctacattggacatatagccgattgctcaaaaccccatcagcatcgactggtatcaacatcggctagtatcactatatcggctcgtcagccgatcggctttttgatatgctgttcttgtcagttgcaggatcaaactgaatggcatgcccgcatctcatcaattttaggacctacactggagctaagcaaatctcccaagccatcgtatgtttgtcgacacggttcgcgtcaacacagattcattatcatcggctggacgcggatttttcatcaacaccaccatggccaaggagatctctcagcgccccatcaagacggatgcctccaaagcctgcttgcacagacgctgctcgatctccaccatcccttgggtccaagagaggacacaaaagccatagggtgggtacatggaaggatcgccaacacctatatcatcgtcgcaatccatcttatgagtgggtacaacagccgtcgtagcagcccccctcttccgcgtgcacgagagagagtggtagccataatgagcgcaaaggacatcgccaccgcagcgtggcaaggatgggagccgtcagctacaggggagcgcttgtgctcttctttgttaaacttgcagaaatgctcaacatggccaaggtaccagcaacgataacatccgatgttccccttgcaatctaccttaagatggcctatccctagacaccggaagcacctcacctggagccaacgcaggatagggcgagctggctacacagaacgagtaaatgcggttgttggccagatggcagcgaacccttctttacaccttgtgttgcaccagatgccaaaccggcttcaatatccacctacgatagggtaggagggcaggcgctgaccggcggggcctgtacaacgtccgcccgggacaaggacgattcaataggggctttatctagccagtgaccgttatagcagttgatcgctgagcggggtgggtggtaggtagacgcttcatctcttatctctctccggctcataagccctagaccataatgttaatagtgtttccccgccgccctttacatttgctttctttggcaaatgaagactttgagagtcaaatgtattttcttgtaattttttttttcttttagtcccttttgatctagcatgcttttagcaccttgaaattctaggtgaactaattatttgtctgattggttagccttattcagtacatatatttgagttcctgtaaaatctaggattttacatgcattataaagttgggtttcccaagtgaaattctttctgggatggtcttaatctgatgttggcgcattcataactaacaataattatgcatgcattggagatctttgtagtgcatctattgttgacctaaatgttagtcatgtcaatctagaagataattatatgctgatttaatccatttgttgatttgatttaacaggccaaatctctaaaagctcgggaagaaaataacaaaagcagcaatggacgtcgatttttggggtttgtttcctctttccaatttagtgtatttaaataacaactgtctcattaagattaaaaaaaaacaactttgtgattaatgttattgtttattaggagtggtaattgagccgtgcaataagaaggagatcttttgtcctgaggataccctgtatcatctaacatcggtatgttctactccctccatctcagaatatagcaacctaggattgtaataagttgggttctaggttgctatattctaggatggagacagagggagtacttgttatctctcatattatcaattttcttaccaggtctcattatttatagtgatgtctcatcttactgttataacttaaatcgcaggtagcccttgatgaggcttacgggctaaaagactccaatgtgaaagtatttgtcgaagttaatgatgagaagtttgcgattgggacgctttcctccaaaaggcatccgcatatcaaggttgacttctgtttcaagaagaactttcaactattccacacctcactaatcagcaaagttgccttttgtggctatcaagtaaagaatttgggaaaattcactgattctgaaggtaaattggtcatctctaatgtttcccctacacttggcttcatgataatcacaattcttgagatgtgatgtttcaggtgatgaatctgatgaggaggttccaccaggtattcgtctataccccaagttagatggtatatgctttgctaatcataataattactttataagccttaagaacgcttaccttttttatagaatactacgctaattcaacttccataaagtgtatgtggcgtgaccatggctaccatagatacaaccatagttcacattagctcaactggaagacatcgcgatcaagtcgcagaagttctggattccaattcggtcacctacaacagtgctgattcccaatgtgtgtatacgagctccgtttttagcccgtgagtactcgatggaaagctcttcgagtcttcttcccaacggaactagtctcatctccaaattccatctcagtcggtcgcaatcacagaaactaggtgttgcatcacctataatgggcctatgggtttataacttcgtctgggaccccggtccaagtagggcccatgtggggtgcgccccaacttgatggaacatgactttagggaccccatggtcatcctcccacctccttaaatagctaggtaccccttcaggttttttcgggttttgtttagattaaagtttagcttttctactttgccgtgtaatcccgtgatttgttagatcgtctgtttgctcgttacggaatcccaaattatcatttatattcaattgctatttgtaatttagattggttttattttgttcttgcttgttttttttttatttgcttgcaggaataaggttaatctataccggcaagatcaacaacccacgaaaaggtgtatcgatcgttaaggcgtaacacaacaacgtctcgtacggttgtagtcaggtcgtaaacgtttctcccatatcgtacgggtgtagatcaaccttgttcccgcaagcaaatcgaagaaacaagcaagagcgagataaaaagcaatgtaaattgcaaataagaattgaatacaaataacaagttagaattccgtaacgatctaacaagtcacgagattatatggcaaagtagcaaagctaaactttaatctaaacaaaacctgaaaaaccctgaagaggtacctagttatttaaagaggtgggaggacgaccatggggtctctagagtcgtgctccaccaggttgggcacatcccacttgggtcgaggccctaaatgaagttacaagcctatacgtccattatagatgacgcaacacctagtttctgtgattgcggtcgaccgagatggaatttggagatgagactagattagttggaaataagactccaagagctttccatcaagtactcatgggccaaaaacggagcttgtatgcacatttggcggccatttgaaatcagcactgttgcaggtgaccgaattggattttagaacttctacggcgatgtcttctagttgagctatgatgtgaactatggttgtatctatggtaaccatggtcacatcagtatgcttgtgtagtttgaagtgcttcgtccatgttacattttatgatagaatctgctagacatgctaatgtgagccggtaagcgaatcttcgaatgatatatttttttatgttaaactttcagataatatgatcaaagaagcacagaaaagtaaacttcctgcaaagtctgctacagttgcatccgccatgcaaaaggcttttgtaaaggaaatagagcactatgagaaatcaaaagctgatgatgacaacaatgaacgataccgtgatatttcagtagttggtgaatctactggtaatgaggtacgtaacagtgacattattaaaaatgagcagtcatgaattgtgttggatatattataatcctgcgatacatttgtatgatatgattgacaaataggattcaagtgatgatgctgattatgaaggtaagagttctgatgaagaagagactactgcaaaggaaggtgagagtactgatgaaaaagagactcctgcaaaggaaggtgagagttctgatgaagaagagactcctgcaaaggtatgtgtagattgatttgggaattggggaatgattggcctcaccactgaccagtacccccacacatgcatatatttatttaacagaattacaagcaggtccctgataaagttgcatattacaccaacactccccctcaagatgggcaaaagatatcgatcatgcccatcttgttacaaaataactcattcacttgggcctaatccctttgttagacaatcagctagttgttcacaagatttagtatactctaggctaagcactccactatcaattttctctttgatgaacaacctatcaatttcgatatgctttatgtgatcatgctgaaccggattgtttgcaatgctgataactgatttattatcacaatggagcaccatagtgccatcccttcaagtatcttaggattctatgagctgcctccaaaagaccagacctaggatcatgcatatatctatttaccacactcactacataagagatatcaggtcttgtatggcacagatatatcaagcgtcctacaagcctccttgtcaactggatcacctgtctgagcacatagttgatgatttttatcaattggtgtagcacttgaacgacatccaagcattcatgtttctgccaatagatcaaggatatatttcccttgggagagaacgattccctttgacgaccgagcaatctcaatcccaaggaagtatcgaagaggtccaagatccttcacctcaaaggtctttccaaacatttccttcaagcacctaatttcttcccccatcatcaccggtgatcactatatcatcagcatacactgccaagatggtaatacatgaacccttatgtgtataaaaaaccgtgtgatctccattgcattgggaatatcccatctcacatagtgcacgcctaaatctatcaaaccatgcacgtgagactgcttcaaaccatataatgatctcttgagtttacatacctttcctaccgtttggttatttccaaatccaaggggaatctccatatagacctcttgtagatcaccataaaggaaagcatttttcacatccagctgatgtagaggccatccaaagttaactgcagaagacaccaaagctctcactatacccatcttggccacaggagcaaatgtttcatcatagtcaatcccataagtttgactataaccttttgcaattgatcttgctttgtatctatccaccttcccttcagagtttgctttactgtaaatactcacttacatcttactgctctttttcctggtggaagtctcacaagttcccatgtcttgttctcctgaagggcatgaagctcctccttcattgcatctttccacctaggatcttgcttggcacatctccagtctttcggaacaggcactgcttgtaatgatgcaatgaaagttttgtatgcaggtgaaatgtgggagtatgagatataatttgcaatgtcatgcttagagctaatatgttcaaagccaagacgtataggaggtttcccagcattacttctagtttccctacgttgtgtaagaggtaattctacntgttcaagtatagggggaacatcaccagacgtttcaatgaggggcaagggagttggaggagagaggcacggggaggattcttggactggatgctcaggttgttcagactcttcaacttgctcccgtgcaaattccctaatttggtccccatcattcttccttgtcatctccacaagatatgcgattaataagatatgcagcagtcatcacttccacaagtatttgggtacattcatctgaaacataagtgaacgtgccacctccaacaaatgtcggttcttcctctcagctacaccattttgaggaggggttccaggacaagtggtttgatgtatgatcccttgatccaagacataagagacaaattcgttgttgatatactcagtcccattatcagttcgaatgattcgaacatttgcatcaaactgatttgaatttatgaaaatcttggaagcatcgaagaacatcattcttgtgcttaagtacataaatccaagtcattcgagtgtaacaatcaatgaaggaaacaaaccacttaaatccactcactaaagtaactggccatggtccccaaacatcataatgtattaatataaagggttcataactacggaggccactcccaacatatggggtccgtgtatgtttgccaaattcgcaagcgtcacagacaagtctacttttgttcactccattaaagagaattggatatagcttacttacgttatcaaatgatggatgtcctaaccggcaatgaagcaaaataatctcctcagcatttcctgcaactgcagccaatcctacttcttcattattgatgtaccacaacccattgcgcctgactccagtcccaatcctcctcccagtccccctctcatagtgatccaaatctgcccataattgttgcaactcactagcatattcttgaacagttcttccctcttgcttcaagttctccaccttgtcttgagcctcaaccatcatcattgcattgtcttcccctgagtacattttgctcaatgtcttccacacagttgatgcattagaaattgtctccaccatcctcgcaatggatggagccactgaggtcattaaccatgttgccaccgtagagttggtggaattccacaccttccagtccacactaagcttgtcatctggttcaatacaagtttcctccaaatagtgttctaccccttttgccctcaacatcaatcttgtccttctagaccagctcaagtaattttggctctcctccaacttaacttcattcggcatttgctctagctttatttcaggtgatgcccctcctattctaggccccatcatcccagtagctatcaagtcttgtagtaggcttttcatctcgcctttagtgaccagcgatgattcctcaacccctttcaatggatccatctcctagagcgatgccaactaacactccttgctgcccgtgttcaccacaatcacggcaactcttattccatcaagttttcagcaagcaaagaacgggaacatatcctcgcttgtgctcttagcaacccaaatcacataactggaccaggcttcttcccgcacctgtcaacaaagaaacagaaataaacttgctctctttcccacaacaagctcacaaatcagtcccaaatccaactcccaaaacagtaccgtcttttcttcctcctagcttgcgcacacagagctcctctcctccaggaagcccacgaacctgagggcctcgcgtgcgcgcagcgggg

SEQ ID NO: 43977 - DNA, 3325 bp, Oryza sativa
tgcctaacgcctgagagaggggtgcaatgagcttgttggcctcaccaccgatcagcacccccacacatacatatctttattcaacagaattacaagtaggtccctcataaagttgcatattacaccaacagtatgagatacttaagtggatgatagtttctgatgcttaatttctcagaaaccttgtaacttttttgttgttgttgtttccttgatctcccagaatactaaagaggaaaatgaaccagtggtaacacccttgaagacatttccacatgagatggcaaagatagaagcaccaattacggacaacaaaactggttggaatttgtttcttttgatttgtttttgttgaactcacaattttttcgtcatgaagattgcaaattcatacttcttgttgatcttgtgtgcaggtactaatactagcaagagaggtagtcatcttcaagttacaaaccctcacccagcaaaacaggcaaagaggacgcccataaagaacgacacgcctaagcgttctgctagctatgtctgcaactcatgcaaaaagtaaattattgttccttttacttaatgatttaccattgaaatattgctatatcctcacataggcacttgctaacttgctcaggactttcaactcctctggtgctctgaaggatcattcaaaggcgaaacaccctgcaaccaattgatacgagataacactagtctgtgttagattgttagtcataggtaactgaatttttttttttcgccgggagagagagagaatatttttgaagcagctatttcctagcctcatctgaaacaatattaggattcgagacgatggtctcttcaacataattttggaacactttatgtgaaaagattctggaacgtagataccacagtttctttatgaatgagtgctgaacggtttcattgttctggggatggaacacattttctttatgaatgagtgctgaacggtttcattgttctggggatggaacacggacataggtatgtgcctcagcgttgcacttctgatcggtggcttgcgttactcattggtcagctccagggactccgatccgttgagttggataatagggcctgaatgcttatgggagttatcttgtagacttgtacactaacgatttcggaatgaaccttgataacaatggggcaggatagtatttccaatgtgaaaatccctgcaggatcccggcgaaaaaaaaacctgcagcagatggcaaataactgtctatgttcttaatttaaattaactactgttacggttaaacatatattgattggatgattaaacgttgaaaaaatacgatgctacagttctttttaccgatgcattctgataaatttggctgccaaatgtacatgttctacacttttcttctatattccagagcgacttcgctatatttttttagtgatgcgatgtccacgggataggattatacgctagtcaacctctctgatctctgcaagtactagtatagcttgcatttaccaacttcttgactagacaactcttgagcccttctttccttgttcatttaggttcccagttcaacacatgctgaaactttcttcccttttctaccttggatttcaatgcctaaatcggataaactagtactaacaatcactggtccagtccaacacggaaggttttcaggaactctgaatctgctgtcacttgccatttgccaccaaatccgttgatcaagtccacatggatgatggatcaactcacactgcatccatcaccgttcccaaaagctttgtaaagctaggcaaagctcctccaagggagccagcctcctatcaacaatcagtcgaccaatcagatagatcctgatggcttctgataacgacagaaaagttcacaagtttatccacagcctcttatcttctttttaagattttgcaggtagggtatagtatttatcaagctaaagcccctgcctttcaggaaaatcagagctcttatccaaaagtcacttgtgtccattgaccactcttttggcttaactaggacacagcctcactttcctgtggttccacacacaaaatggccagattctgccattagctgcagtgtgcatttcatccataaactttattccatccacttatgtatccattcaagccccctgcaaaccacagtccacactccacagtgagttcaacgtctgatccacctgaaggaatccagtaaacagaaagatcctgctactgcctgaagactgagattcgttgtgtcatgtggcaaatgatttgctaagcagttattccagagtcttagttaagtaccttttgcagactgaattaatccagcttaaagttggtcaacaaactccacagattaatcccctacattcccttgcctgcagagtgttcagcacaatacagttatactccctaagccataagaaatccagtgcctcccctccaccacatgtcatgctatcttcagcatgttacccacatgcacctgcttgcaatatctgagacctgagccaccaaggatcccaagtccaatgcatgggagaaacatacagttaggagggaagggtgcaagattcgacaatgcagcaattctcatacctcaaagccattggcctgtgcctgcctcctcctcccaatagtgagtttttcgatctctttttttttttttaatcttgagagatgccccatggtgagagttgggagtagaaaaacaggagcatgatgtactgcagagaaatcaagattggtccatgaaagatagagcatttattccaagcaggcagagaaggttcctccagtttttaaacaccccatgagggcttcctccactcactttcatgtacagctcactttcttggcctccttcctttccagctcggtttgctaactcatggtctcctcctcctactcatcatcatcgtcttcttcttcttgcccaactccatatctctgcatggctccatgcctctccatggcgcctatgtatagcctctcctagtcctatctctcgtctcatcatcgtacacaaacagtagtacatgatgcaggacctgttctcggtgccgtcctgcttctcctccggcgagaagctgccggacatcccgagctccggcacggcggcggcggccgcggcggccaggcagagcgcggtgacgctggtctaccgggcggagatctccggccaccgccggcttgtcaccgtgacgtggtgcaagaacctgctcacgcacggcctgtcggtgtccatcgaagggtcggcgggcaacggcaaggacaagatcggcagggagtacggcgaggccgccgt

SEQ ID NO: 43978 - DNA, 9422 bp, Oryza sativa
cggcaacgccatcgacgtggtgtgggacctgaggagcgcgaggttctccgatgagccgcagccgctgtccgactactacgtcgcggtggtcgccggcgaggaggtcgtcctcctcctcggcaacctcaagaaggacgcgttccggcggacggggtcacggccgtcgctgcaggacgcggtgctggtgtgcaagaaggagcacgtcttcagcaagaagaggttcgtgaccaaggccaggttcagcgacagggggaagctgcacgacatcagcatcgagtgcagcagcagcaacctcaccggcggcacggacgtcgacatggcgatcaagatcgacggctgcgtcagcgtcctcgtcaggcacctccagtggaagttcagaggcaacgagtgcatctccatcaacaagctcaaggtgcaggtgtactgggacgcccatgactggctcttcggcacagggatgaggcatgccttgttcatcttcaagcccgagccgccgtcgccgtcgccgccgggagcgagctctgaattcagcaccgatgaatattcagatttctgcctgtttctgtacgcatggaaggttgaatgagcctacacactttgttactgcgatacgggcggacgtttttttttttttaaccatgctatgaactggtaattcagatcatgtaatggattggaagatagaagaagaagaagagggaagaaattattgatgccattttgtatttcctctcccatggagagggtgttgggcacatggaagattgcattagaggggcacgcacaggatagtcctgggagtaggaacaggctggtcctgatagagaaacatagggggtggtgacaggtaggattcacaatggcactgcctttcccaatcatgcattcatgcttatttatccagagaaactccagctaatggctggtggctggtccctcctatctagtactatgctctgctcctcctctctcatttttctattactcatttactttgaccctagtttcttctcctatcctcaagtaaaggaagagtagattggggtgcaaacccctgatagtacaacacttgtataattcagatgtacttttgttaaaggcaactagtcaaggagtgcatacttttcatcatggttttcggtaacacatttggaccatgtagctttggtaccaccacaattccagttaagatttcaatcatataatgattaaacattacaagtaattgaaaaaagctggaagaaatgagttagcatatgtcatacaggatgcaggaaaaagaaaacagaatcctggaagacaactgagttcataaagttctgttcctgatgtttttttaatcatcatgtcctcattagttgacatccggattgaaaataggaatgccagaaatataccaaggaagtgctcttctcagaatcccaaaaatacaataaaggaagtgctctttcccaatagtttgaccatggaaaaactattttctggtagtaaaaattaaaatatgtaaccatggaaaatatattaatttgaccaaaattgctagttccaatagttttcatatatagtgctcttttcacaataatatataatgaggacaataaataagttatctaaaattatacttcctcaacattgtgacaaatcatgaattctcaacatgtaaatcaaatgaatagtcgaattaatagaagtgaaagcatgctattttgatatgaattagtataagtcaaaacatgctattttgatccaaaaccaaaccattttgctaagaaatatttgttcttcccacggggagtttcatctgaggtctttccaccattcccgtgcaccggtctctgattatctgcaatgcaaaacagttgccaccaaattagcaagagtataccacataccaaagttgaatgttttttttcttttaagaaatttgcattattattttttaaaaaaaggtgtgcgggagggctgcctaaagttgcattggctatgaattgactttggaatttcgcttagtcttagtggtatattagatgtaaaatccccagggttcaatatttgatataatcacgccgaagccatcgcttgtattttcctttcttaagtcatggtcaaaccagcaaagtgtgacctcatcattaactgtgaattgctcaactatttacagacaatctacttgtcaaataatactggaggcgctagaaaaaattacttgaattgggcttcttagcatcttgggatgaccctgatgctgaaactgaatgtttctggtccaggggactgttcccttcacctaatatgaacaacagaatggaattatgtcaggaataacaagaaacaggcaacacgtgttaagtaaaaataaagggacatatacgacgatgacagtaagtcagcattatacttgaatcaaagctatcttagtgatagaatataacccagcaggaggagctatcagatatttcatcctagtcatgaaggttgtaagaagtgaaatgggtattgaagttactacaagaatattttgccctaatagcatgagctgttgcataccaacgctgtttaaatttttaagaagaattgggacaaacagtgaaatttgtctttaacataaatgtacatacatccagttaataaaattgtacagaaggatttcagaatctatttaaatatagtatgaataaaagctcaccttttgtggacggctctctgtagttgttcttcaagtactcgacaaaagaatgatcattgtgatcaagaagcactgaacaagagaacagcaaaagcaagttacgaatggaaattactacatatttttgctacttcttgattctatactcataaataaatatagtatgaatgaagaagactactatattacattgttgaaacaattcgtgcctcatatgctcagaggtaccaaacaagagcagttgcactgcctctgaatctctgtttgagcacatgttggaaagatttttcgtatctaacaggatacctgcaagctgagggggaacccagaaaacatggtcagaacattccactaaattatgcataacagtctcttttatgtatagcaaatgcactaaccagaagtttctttatgtccaggctctgaagtagactataagcatcttcacaataattattggtgaggattgtgcaaactgagcccatctaggggacaaaatcgagcatgcttattaagtaaaagctggaatcatatacattaacctcggcaagagtcttgagaagtaccagtacaactgtacaagtacataacattaccttatcgtttggtttcagaacatcctgccccaccactaccaagctgactcgcttatccatcattagcccctccatgtcaacctaagtcggattatgaaaatcagtatcataaacattttaccattactcacagcgtgcttgatcacggttgttcctttcaaattggagaaacatatgtgttatatgaccataaaacaggagatagtttgaaggaaatgaatggtgtgcttgcatcttgattgttcctttcaaagtggagaacctgacatgttatatgcccataaaactggaaacagtttgaaggaaataggccatcaataagatttactaggtgctattacagatgcccatgtcaaattgatcttacgcagatgttaaatgcatcaaatttcaaaattatgttgcttattgttgctagaattgctttccctttatatgcccatatcagcacatgaagctacaattgcaagaagcctatcaaccacaaaaccccaaatcacagccacatggtgccaatcaaaaaccggaacacccacatgacacgactgcaatgtgattgctgtatattgcccatccttgtcgcctctgcccagaataaacgcccaataactccggggcctagacagttgtccgatttgtcggagacgaatccaacccccacgctaagctaaacggcctgaaagctcacgcaaatcactatcgtgtagtacctcgtcagcgaagagcagagcagaggcgtcgacgccgacgtggtggagcagccaggccgcttgcctgcacctctccatcctgccgcggcgcatgttcaccaccggcaccgccgcctcggcgtcctccttgctcgccagcatccacgcgtagcatatcgccgccgcgattgagctgacacctgcggggagatagaacaggaaatcgcaagtgagcgtgtggtggggtagattcaattggagcaattggggatggatttggtggtaatccttacttttggaggcgtcggagaggacgatcttcgtggacctcgaggatgggcggccgccggagccgagctcagcgacggcggcgcgctggcggcggaggaaggagttgaggcgcgcgacgccatcgtcgaacacgtcgacggcggcgggggaggaggaggaggaggcggaggcgtggcggcggtggtgaggctttgcggcggaggtgggcgaggtggaggcggaggatgcggcgcggcggtaggcggaggaggaggagaaggcgtcaggggcggaggggtagtggaagcgggacttgcggcgggaagacggcgggtttgggggcaaggagtgggcgggggaagccggctccggagccaaccggtcggcgcgcggaggcgaggaggagatggacgcgcgctgcaaaatctcgtcgccgatgcctcccggctgccggtgcctgcaagctcgccggaggaagagagactagtaagcgaatacatagtagaaggaaatcgccacggcgccaccggcagtgagcggcggcagcgggatgccggcggcggcggcgcggggccgccatgggcggcaaaccaaaaaaatgtggtttgcaactgggccgctaatatagctttgttgggccactggcccatctgacgattgggccgctaatacagctcgcctgtgcgcgcgcacgtgcacggacgacgacgtagtgacatcactgacatgcgtaccttcgggcggagcgtgacatcgggtcgcggcggtcgagcgacggcgagggctccgtcccggcggcggcggcggcggcgaacctgggcacctgcctggacggcgagccgacgcccttcctccccggcgacccggccccgaccatcctcctcgcctcctccaaccactcctgcgtctgcttgctcgcgctaccaccgccgccgccgccgctcctcccctgctgctgctgctgcttcttctccgccggcgccgaaggcctcttgccgctgctctgatcgccggtcaagtcgtacgcaccgccgccgctgcgccgtgtgccgacggtgccgaagaaccagtcgttcatgaagtcggccaggtccggcgccccctccacctccatggcaaccaaacctcttgatcgatcctttcacgtacgtatccggccggttggtgtttttgagatgttctaacgtgagtttggctgatcagaaggtggttttgcctttttggtgtggagatgaatggaacaatgagagggagagggacgacagcgtgcagggtgagacggtcgggtcggccattcggccggccgcggccggcggggggcggctgcttgtatcgtagtagcgccgagtggtcgtttcgaggtgctgctgtgttcttaagtcattgttcccaacttcaaacccctcattttcgtacgcacgtttttcaaactactaaatgttatgtttttcttaataaataataggaaaattatttaaaaatcatattgatctttttctgaaattttagataatacttaattaattatgtgttaacacatgtttcgatttacgtgccgggatgatgtcgatgtgacatggcaaaatttgctataggacacccaacttttgtgtaatttgatgatagacatcctaaaaaagtgacacgagtgaaagacgctctaaaattggtaatttgttggatgacattttcagctcaattgaatagataaattatttaaaaataagacaatgacccggtcaaacgtttttttagccgagactagagtgaaaatgaaatatgatgtatgctagtgatgtactttgccactttgggctatggcaaattttgagttgcataatttctaaaagtttactctaacaccatgtttgaagcatgtgaccatagaggcgttcttatcttttttttaagaattcatctctccaattgagctgaaaatgttatctaggaaattactagtttttttaatgtcatcagccgtaacacgttttttcgatgtctgtcagtaaattacataaaattttggtgtcatgtagtaaatttgcccctaagcatctacagcttgcaaattgcaatgaagagacaataggttatcgacagctcgtcaggatttggttggtggtatcatgacaacccgttcattgtagattggggttgagggggtatatccgtctatgttacaacacaaacgaattaattaattagatattaaaatgttaaaaaatgaatttggataagttatataaacaacttttatgtagaatgtatttttaagctccgcccgaaggtatgcatgtcaacgatgttagtaggtggtggtgcaattaaccccattcacaagcacatccactaagtatgttggtccttgggggcttatcggctcaggtgaaggaagtaagaagtgaagggccacgacggtgcttggcgaggaggaaaaggaatgtgctatcggagcggagaacctcaccggagctttgctggagtttgtgtaggaggatcgaatggattctattagcatattttccttggtatatatcaaatttaggttaacgggtctccacacaggctacgccccctagtcgtgcaaggtcaacacaacacgacctgacatctcactagaccatacctgggcttcagcctcaacatatgggctgacacgacacgcctgtgtggtgagccgtgcttaatccgataatgctcagatgtacttagaccccctttgattcaaaggaaattcataggaattttagaggatttcattactataggaatttttcctatatagccctttgaatcaaatgaatggattttatgtaatcctatgaaattcctatggattgcgtaatgctatgcaagttttggaggaattctaacatgaggtaaaacctcttggaaactttcgtttgagtctttatctctcctataattcttgcgtttttcctgcggtccaatcaaacaaccattcctgtgtttttcctgtgttttgcaatcctctgttttacacttacattcctatcaaaatcctgcgtttttcctattcctatgttttctcattcctgcgatccaaagaagcccttaatatttatctaacaatctcaatcctataaaatattaaaataaaaatcttaaaaaggtccagtcccaagggctccgtttggaaagattttcaccgtttgggtaggttggggatgggatgagatgtgcaatcccgggagaatcccggtgaattgagtgctcggctcaattaggaaattaccctcgccattttgacgtagtggcctctgtcgtccgtgagttaccctgacccctcctcgtcagtttgcccgccgcggcgccgccgccgccgccgccgatccccatccatcccgcgagcgagcagggcgccgtcgttcgtcctgctgcatccgccgcatcctggtgagcacctcctccgccaccgccgcctgcgtcgatccccatccatcgcgcgcgcgagcgagctgggtcgccgtcgttcgtactgctgcttccgccgcttccgttacgcacatcctctttctacccacgcactttttctcggatttgcgttaatcctagcttctgttctagaaactgacttaaccttagaaaatagtactaataacagttcaatggttcccaaaaagtttgggggtttaactgaaccccatgtcccatgttagatccgccactgcttcgaggattactaattccgttctatttgggtgtgaatattctcaatggtgaattgtcatgacctcactttgtaaatttctctgttggaatggcagtaaacatgaaccctttaaagaggtcattggaatcatcttctcaggaacatgaagcaggcaaacagaaactgcagaagagagagtgtcaagatttcactcccagaaggttctgcggagttctccttttcacagttactatattatataatcagaaaaagagtgcaatcctgtgacattgctttgtgatgctgaaattggtcagatatcagcttgatgtctatgaggttgcaatgcggagaaacacgattgcgatgcttgacacaggagccgggaagacaatgattgctgtgatgcttatcaaggagttcggaaagataaacagaacaaagaatgctggaaaagtcatcatatttcttgcaccaacagttcaacttgttacacaggttataccagtctgtagactgttcgttttatcctaactgtaatgtaatttatactaacattattttttgccacagcaatgcgaggtgattgaaatccacacagattttgaggtagaacaatactatggtgcaaagggggttgatcaatggacaggtcctagatggcaagagcaaatctcaaaataccaggcaagcatttatttgttgttgttttaaaggctcactgattcatcatatgtgctaaagaaaatactcattccatgctagcagcacttatgatctgcagtcttctgttcactatattatagagtaaatttcacgaaactacagatttttaaccaaattatcgcaaaactacagatttaaggccaagtattagagaactacagatttaatactaaagttatcacaaaacaacatattctagagtataaatctatagcactaccgttacgttagagctataaacattgtagttttgtgcttaaaattggcactaaacctgtagttttgtggtaaatttgctacttaatctttatctttgtgatactctatcttaaatctgtagttctatgagaaattccatgctaaatctgtagttttgtgatataacacctaaactctgtagttttgtgacagtttgatcgaagtatccatagttttgtgaaatttactcaacatcttttgttaagaatatcccatagatgtttttcccctgttctatctacttgttgatgctttcaacacttataataataaaattgcaggtcatggtcatgacaccacaggtgttcctacaagctttacgcaatgctttcttaatcttggacatggttagtctcatgatatttgatgaatgccatcatgcaactggaaaccacccttatacaagaataatgaaggtattgtgaaataccatcttatcatgtttttttttttttgacattagcatttaggtttttcttttttgtgtttgtcatatgttataactcatcactatctcaggagtt

SEQ ID NO: 43979 - DNA, 2273 bp, Oryza sativa
tctccaatttcactttggccatagagttcataaatgccagtatttctggcagatttgatttattcgcatcacttattcttattagatgatttgagttttcatggttttctttgcaggtatctcttctcatttggattgtgaaggtcagttctgtgaattggagaacctgttagatgctaaggtatgttcagtttcctgctttgccacacatattatttgaataagctgggttagattatacaggacatgttagttctgataactacactattctactttgtctattgaagtgcaaggatatatacatacctgaattccaattatttactgattgtggttttcaaccaaatgcaaattgttttactgttgtgttcgttttgagagcttaggtgatatatatttatctgttttacccatgccattttgggatacacctatgaccccttttaaaaatgtgatacggttatctgcgtactttgattctcattaatttttatctgtaacagatctacacagtttcagatagagaagagatagagttttgtgttccttctgcaaaagaaatgtgcaggtactatgactcgaaaccagtttgttttgaagatttgagtgaagaattgggagttttatgttccaaggttttatatctcttttttctcttctatattgatcaaatttgtcatcaaagtttgcagctcagcatttttaatgtttctaagaacacactcttttatgtatgtgcagtatgatgcattgataacagagttgcagaataagcgaagcgacatgtataaagatgctgatgatataacaaaagaatcaaagagacgcctttctaaatctatagcaaaaatttgctactgccttgatgatgttggtcttatttgtgcaagtgaggtatttgttatattcatttgttctagctacttatgttacaggaactgagcttaacttggtgcgaagcgcgtttgcacgcctcacaacctatttaaatccttttcagcctaattttgggttactttcttcttaaccaaaaaaatcccatctcttagtaattcttttttctctctcatactgcaacgttagctttctatgtttgaagagttcttttaccgtcactttgcttcagagttcatgtcttaatatgggtaaataataacttatcattcattctcttaggccacaaaaatctgcattgaaaggggccaggagaaaggttggctgaaggaagtagttgatgccacagatcagcaaactgatgcaaatggatcacgcctatttgcagaaaattcagcgcttcatatgaagttctttgaggaagccttgcatttaattgacaaacgcctccaacaaggtatgactatgtagataaactaataatggactggtaatgtctgtaaacttatttgcaaccttacactgttatgccatgccattagccaatggatctaagcatatatagcactgcaacaccctatatgaacttatggagtatgatgaatctgtttgataggaagtatcatgtaccatctccttgatgaattcctatcctttcatttgatgtctgtgtgtagcatgaagatggtacttcagtcttttggctctcttctcaatatgaaaatgctcagtccttctgtgtattctctaaactatttgctatcttccaggtatcgacatgcttctaaactcagaaagtggatgtgttgaagcagcaaagacgggctatatttccccaaagctctatgaactcatccagatctttcactcttttaggtattatttcttggggaaggtccacttgtttatttttttcaattgtgtgcctttaaactgacgtgacacatttctattcctaacagtaactctcgtcatgctcgatgcctcatttttgttgatcgaaagatcactgctagagtcattgaccggatgattaagaaaattggccaccttgcacatttcacagtttcttttcttactggagggagatcttcggtggatgctctgacacccaaaatgcagaaggatacattggattcatttcgctctggaaaggtaattaagatatgtcaacacttggagaaactgaagcatagttctcatgatataaccttgttttccctttctaaaatgcaggtgaacttactatttactacagatgttgctgaagagggtatccatgtcccagaatgctcttgtgtaatacgatttgatttgccaaggacaacacgtagctatgtgcagtcacgtggacgagcacgccaggaagactctca

SEQ ID NO: 43980 - DNA, 18239 bp, Oryza sativa
cttccgcagaataagtatgttgatctcattttcagttgtctctttttacatgactacacagattgcacctataaatagatctgcaatacctggtttcagtctgtaatcgtttttgtttggagacctccaattcactttcttgccatttctgcttgtgttacaggtgctactccccaaaacctacatttgagttcactcatcatgatgatggatatgtgtgtacattagcattaccaccaagtgctgtgcttcaaattctggtgggcccaaaagcaagaaacatgcacaaagcaaaacagctcgtttgccttgatgcatgtaagaagttgcatgagctaggagcacttgatgaccacctttgtctatctgttgaagatccagttccagaaattgtaagcaaaaataagggtactggtataggtatgtgattgccaagttttataaggagtaaatcgtatcactggtcctctaacttgaactaattgttcaccatctgggttcctgtacttagaaactacatattttagtccataaagtacattaaggtggtcattttaggtccatctgggtaactagcattccttgtggacatgatacactgaggtggatctggcatccttgtgccccccggcccctccccacaacctccaaccctcccaaaaaaaactgtgccacgagtgcaacatcacaaatgctgtttttgtcaactagatgctgcacctaaggtcagctgcatctctgggagcatgagtgaacatcacctgcatgcttcatcatcacctcattaagtttccatctccatgaattgtgttgttacttgtgacatccaccgcaaaatagtacaacaatttaggggagatatctaagggagaagagagagggacggccacacataaaatgccatttcttctggattgtatagttaataatctactttacgcacttttggacctagatttgcattttctacatatatgtacctagattagtcctgtgtacaagtttaaggattcgccatgcaatttactccaagttaagatgccatatgctggctggttctttgtaaccagcgtatgtagtcaagcttatttgtaggactgaactccattatacttcttacaaagaaatagatgtcatggtaatgttctctattaccttcttgaaggtacaaccaaacggaaggagctacatggtacaacaagaattcatgcttggtctggcaattgggtgtcaaagaaaactgcactcaagcttcaaagctacaaaatgaattttgtttgtgaccaagctggtcagatttactctgaatttgttctgttaattgatgcaactttaccggatgaagtcgctactttggagattgacctatatttgcgcgacaagatggtcaaaacttcagtttcttcttgtggacttcttgagtctggatgctcaacaggtatgatgaagttgtcccctacttttgtttttttcccatctaatctgaaaaattccttatcctttttttttgtctcagatggaacaagcaaagttgtttcaagggcttctcttcaatggtttgtttggaaagctgtttactagatcaaaagtacctaatgctccgagggaattcattcttaataaagaggatacatttgtgtggaacactgcgagtgtatatttgcttttaccaacaaatccttcttttgactccaacgtttgtattaattggagtgtcattgatgcggcagctacggcagttaaacttatgagaaggatttattctgagaataaaagagaattacttggaatatttgattctgaccaaaatgttggagatttaattcatttagctaacaagtcgtgtaaggctaacagcctcaaagatatggtagttctagcagttcacactgggaagatatatactgctcttgatattactgaattatctggcgatagcgcttttgatggtgcatctgataagaaagaatgtaaattccggacattcgcagaatatttcaaaaagaagtgtgtatagttttgtgcatgtccatgtgcttgctcaggtataatcttgctttttttgtctaatatattcgtttacaggtatggcatagtacttcgccacccctcacagccactactagttttgaagcctagtcataatcctcacaaccttctttcctcgaagttcagggatgaaggtctgtatctattcttctatatagttagttttgttctaccttgtgtttgtcttccctaactggttacttattagttttttcaagcaagattagtttgaagcatctctatttttttacttcgatgattagtgataaacccatttgttagactggttacttttgcataaactgttttatttttgtaatttgtagccaagttgattatgtcgtatataggctgatctaatatttatgattgctgttgcttttttttaggtaatgttgtggagaatatgagtaatggcacaccagttgtaaataaaacaagcaaccgtgtccacatgcctcctgagttgctgattccccttgatttacctgtggaaattttgagatcattctatttgtttccggctttgatgtatcggattgagtcattaacgttagctagtcaactaagaagtgaaattggatacagcgattctaatatatcaagtttcctggtatagatgcttatacctctctcttctatacatacattttctgtttctttaatatgaaatgatatattggcacatgttctttagattctggaagctattacaacgcttaggtgctctgaggatttctctatggagcgtctagaattattgggagactctgtattgaagtatgcagtgagttgtcatcttttcctgaaatttcctaataaggatgaggggcagctatcatccataaggtgccatatgatttgtaatgccacactttataagcttggaattgaacgcaatgtacaggtaaattcacattatcatttggcagtgtctagagattttgtatttcatggacacactgagctttaattgtctgagctaagttgacaattggtggaatgtaatcaacagggttacgtacgtgatgctgcatttgatcctcgtcgatggctagcaccaggacagctctctattcgtccatctccttgtgaatgccctgtaaaatctgaggttgtaactgacgatattcatatcattgatgacaaggctattgttctaggcaaggcgtgtgacaagggacacagatggatgtgttccaaaaccattgctgattgtgttgaggctattattggggcatattatgcagggggtggtttaagagcagccatggcagttctcaaatggttgggcatcggggctgaaattgaagaagacttgattgtgcaggccatattgagtgcttctgtgcagacttatcttccaaaagacaatgtatttgaaatgcttgaagcaaaactaggctattctttctcggtgaaaggtcttttggtagaggctctgactcacccatcacagcaggagttaggtgcaaaatactgctacgaggtatcgggtgaacataaaactattttgctggtccttcatattgtgtcttaacttacccaacttctctaatgttttttttttaacagcgcctagagttcctcggtgatgcggtcttagacattctgttaacaagatatcttttcaatagtcataaagacactaatgagggggagttgacagacttacgttctgcatcagtcaataatgaaaactttgcacaagttgcagtaaagcacaacttccatcactttctccagcattcttctgggcttctgttagaccaaattactgaatatgtgaataggttggaaggttcatccatggacaaagttgaactgttatcagatggactcccaaaagggcctaaagtacgttctttctttgttttaacatgtgtgtggtttgctcttatcagaataaaatcaagtcaatacgttaggatttcagttcatatgaatgacatttgctttaagttagagcatcttataaatgcatggctatgtatttaatatactttttacaagttatttgcattgcattacctgtgtcctttttagtgtcatcttccagtattgacatacacaatcatctttacaatttatctatattaatatatcatatttcacttgtctattgtgatacaggtccttggtgatattgtagaaagtattgcaggtgcaattcttttagacaccaaacttgatttggatgtagtctggggtatttttgaaccccttctttccccaattgtcacacctgagaatctggagttacctccatacagagagcttatcgaatggtgtggcaaacatgggtattttgtaggaattaactgtagagatcaaggagacacagtagtggctactcttgatgtacagctcaaagaggtgcttcttgtgaggcaaggttttagcaagaaaagaaaagatgcgaaagcgcatgcatcttccttactgctcaaagatctcgaggtgtcctatttttgtgctccactattttggtagtgtatgttgcaatgttcttttaggggataatataagctgacaggtttattcgtttttgcaggaaaaaggactaataatcccaaagaatgcaagcaagacagaacaatttgaaaagcattgtggcagcactaatcccttcaacaatttgcatgtcgatgcaatggatacacagactccaaaaccaaccaaggaaaaaaacgcagctgattcaaggaacatttctgatcccctgcttggtaaaccatgtatgttctcaatcaccagtggttctgtttttgttgttatctctgtgctttcattcatatcaggacctcatatatccacgtctgtagaacgaatcaatttgataaagttcaacaattttatcttgtttcagtgcacgtgattgtgaaaacgagtaaaggaggaccacgcattgcattatatgagttgtgtaaaaagttgcaatggccaatgcctacaatggaatctgagaaagtacaaccaaggtactaagatttcatactagcctgtgaatgcctgtttatttacttatctatgcaacagtgcaaaataacttactaatctttcatggttcagctttagcagcgtgtgctcctcccctggtggttcctctcagaaagctaccccccaagcgttcgctttcgcttcaaccattacattgcatataccaaatgctgatgtgatcagcctcacaggagatggccgtgcagataagaagagctcacaggattctgctgccctgttcttgctctatgagcttcagcggcgaggtactttgcaactccaggaggtgtgaaggaacgacaactgattgcttgccaaccagttgcttggaagttggaataatagaccaaccagttgcttgccaccactcagctttgtacatcttctccagtgttcaccttctgaattatgataagagggtacccaaagaatggagaacagctgacctggttctggtgtgtgtcagttgttatgtgtgtttgtccatatgttatctgcgtagaaactgaataagcccccaaagttgttgctgacgataaacacgcaaatatcatgcccctgtagcctgtaggtgttaaaccaattgttcaaggataaaaagagagaccattttcaaatcatgtttccttgttctattattacataaacataccggactttttttcttataaaaactactccagtaaacatttgatcattcggttactcttgcataaatatgaacagaaaggaaatcgtgattttatggtgatcaaatgtataattggcatttgatcactcgattgctctttgcgtgaatgtgagcagaaaaatggaagtcgtgatgttatggtgatcatcaaatgtataattgacatctgatcagtgatcactcgattactctttgcgtaaatatgaacagaaaatggaaatcgtgattttctgggggatcaaatgtgaaattgggccgaatatggataccatcccagctaaacaggccacgttctcaatttaagcccagacaaagcccaatttcataattttatctgctccaccacttcgtgtccctgatccccttccctcctccaaaatcaaaaccgggaaagccaaccaaccaacggccacagatctcggctaccggaacgaatcgacggcccagattcgtcgcctcaccttccccgccgtccgcttcgcatcccctgcttaaaccctaaaccccgcgtccccgcttcctcctcgatcttagggtttcgcgcggccgcgcctccgattcgtcgtcccaacgaggcagcgatggaattctggggtaagatcccccccctctctctctccaagattctggttgattatatttgtgttgtgttctcggggagattttatttgcaattattttggtgcgaattttgggcgtgtcgtgttcccgtgatgagatgttggtaatgcttcaaacggtgttggggggtgtgcgattttagatggtgttctcgtcaacgagcttctccgcgatcccactttaggctctgttttgtctagtgccgaggaacgggcttatcatcggttttgtgttccgaggttgagaaattcgccatcttgtctgtattataatctgaattttatgatgtactgttaagtatcacccttccttccctgtagaaagccttgtagtttgatgataacttgataagggtctcctatgccattatatgtggggtgatgggatgatcatttagtgggttgtcaaatttcaagtagtgaaaagtttttttttttgacttattgttgatgctagattgtgggagcttttcaagcgctgatttgttatttggcataactctacgttttctcaatgcactatgggctgcattttcaatctccagctatgcaagggaattcgtaaagtgtgatttatgatgggagtttgaatgattgatctgaatcatgcaggtattgaagtgaagccaggaaaggctgtttcatttaacgttgatgatgagtgtgtgattcacatatcacaggtttagcaccctcaaccctcatcttccaaacacacacaacgaacaaaaaaagggagggagagaataaaatttaaatacaacttgtctgattatttataatttgtgttcgttctcaatctcggtccttacataattgatcttttcatgttattgttactttttttaggttgcactgggagaaacaaagaaggcaggaagtgagaatgtagttgtatctgttaaagttgatggcaagaagacagttattggaaatctatcggctaaaaatcatcctcaatttatgtgtgatttgtttattggcaatgactttgagctttcacacagttcaaagactactagtgtcttcctgtgtggttacaagactgacatgcctaacccatatgaatatccttcaacatatgcacttggaattattttcgaatcatatttagattttatttgaaatatcctttgggaaccttgtttccttaaccatgttgtttcttttctcacatccgattctcgtgaagatgagggtaaattcattgactgatatttctgaaataatttctattgtttaagtatccaatatttctattataacataaactaactagtatgtccttatttcagatgaagatgaaaacatgtctgacatctgtgacattatgggtatgcagatttattttctttttattagttgcgcgtttaagatcacacatgcgctttcttgacaatggctgaattaatgctctgggattgctgtatatcactatatttgttaaggtaaacatctgggaaggcctgttgcagaggaaggtaaaaaggataattctgatgatggtatggacttgtcctcatctgatgatgatgatgattctttggactcgtcctcatccgatgatgatgatgtaagtttatgatgaaagtgcatttaccctcataaagttttatgtatagttttatgacgaagaaagtcttatgtatagtttttgtaatattgctcacttttttccccttaaggatgagtcaggtgatgaggatgatggatctgatgagttaccagcagaaatggagtccagtgaagaagaggatgggagtgatgggcaggatgaatcatcttcatcgatggtgtccactgatgaagaggatgaaagtgatgaggaagatgaaattccagagaaagtatgcccgatatctgccactgttcttgatttgtctctaagatgcgatctgactcttgatttgtctctaagatgcgatctgactcttgttttgtgctcggcagcctgagagcagcaagctgacagctgctggatctacactttcttctggtaagaagtcaaagactgcaacacactttggccagaaaacaggttagctctgccggactgacgctatttttattaaccttgcaacacacaggggactcaactttagctaatttttcgcatttactaaaggtgataagaatactcatccagcaaaggaagatggcaagacgccggcaatcagcaaaccaaataaggagactcccgaatcctccggcacccatgcctgcaagtattgcagcaagtatgtatacagcttggcagtttattattatgctgtgataagatgcagtcttatcacaagcattctaacattagatggttcttttctctcacagggcatttagtagtgataaatcactccggtctcatcagaaggcaagacatccagccaagtgaactactggtggcatgtttgactgcagctgcttttgcttcaaagatgatcctctaataggcagttttggccctacaacctggggcatacccaattttgcttgctaaatgtttcttttattttattttttggcgaaaacgttgcttaaaaatccagaaacatccaagttggatgaggttacaagctaggtagtactattaattacaaaacaatgttatttgtgctgtgatggtctgtgtgactattaattacaaaacgatgttatttgtgctgtgatggcctgtgacaatgcggagactagtctgctttcttggttacgaggttttatactctgtcttctatgctctactgtggtttgggtatttgatatttggtcaagttcttcgttttctttccattctgtgcacacgatcgcatgtactccctccatacttgtaacggaagtcgttttaaacagcgacacggttcttgtttctataaaaaatatttattgaaaagtgatatatgtatatttttatgaaaatatttttcaagacaaatatatttgtataacttttatattttcaaactcaacaacttgagatttgttcatgatttatattcccaatgtttgacttaaacaggccctgtgtaattctaaaatttttttccaaaaacatcacagcgaatctttagacacatgtatggagcattaaatataaataaaaagaaaaactaattgcacagtttgtatagaaatcacgagacgaattttttttagcctaattagtccatgattagctataagtgctacagtaacccacatgtgctaatgatggattaattaggctcaaaacatgtgctaatgatgaattaattaggctcaaaagattcgtctcgcggttttcaggcgagttatgaaattagttttttcattcgtataaaaaaaacccttccaacacccggtcaaacgtccgataaaacccctaaaaattttcatttcaccaactaagcagacccttgaacattatcctaaacgtacggagggagtaactcaactctgcgatgaaatcatgatatgctgatttctgcactccaaggcaatgatttgttttattgccacgatcatggactcgtggctaatcacacttaaggaatcgaacggttgagaattttagtacaagttttgtatgtaaatctggacatcccagacttgtctaaaacacagacgaaacggttttttttacagacatacaccaccagtttttgttggtttatcattggtttccacgaaatccaaagataccatacgagcagtttttgatcccggtattgggatcgttaacccagattgtgtccgatatgagcagttttttatcccggtattgggatcgttaaaccagattttgtccgtccaaacacactcaggaaaaaaaaaagagcagatcccagaacaatgaaacgtgcaacatccatacgcattcattaaaaaagcgccatatatctacatgtttcagaaacttggcaagtgctccaaaattgtgcttcatcaaaatatctggatctccagcttcagaattcagttacctatcactaacacacctacacaggattgcccagaaggtatttcagatcacttagttgcagtgtgtttcgccttggaatgagcttccagacccatagaggtgttgaaagtcctgagcaaaataggaagtgcatatgtgaggatatagcagcattactaaggtaaatcattcaaatgaaaagaacaaaaatttacttgttgcatggcttgcaggcataaccagcagaatgctcagacatgtcattattggcagtcctcttctttgcctgttttgctggataaggggtcgcaacgtggacatagccagaggattgcttagccatgtcattgtttacaggtgtcttctttgcctgttttgctggataaggagtcgcgacatggacgtagccacttctcttgccagttcctgcacacaagatctacaagtgagaaatgcaatctctgtgccataaaaaaaacagtgaatttaggggggaaaacaaatcaaaagaaacagtttccgaccagctttgctgtccataattggggttgctagccttgaacaagctcacacctttgaaggagtctcttcttcatccgaactatcaccatcatcatcactagaatcctgtttatcaatcatatcctacaaatatatcgcatgatcataacatatctagcataaagaaaactttgttcgcacacctaccgaagtccaaaaccatgtcatggtttcagtctgaacaagaatcagcatgctgctagttttaatagtgttactgttttacaaacctcatcatcatcatattcatcctcgcctgaagcatcactttcttcatcgctgtcatcatcatcagcttctgatttcccataattctttctttcctctacaatagcctctggtgtaggggatgcagcagcagcagacttaagtgtggcaaacttacttggactgttttgaacttctttgatcttatcatctgaaagtagataacataaaagagtgtatcattcgaagattcgcttaccagcttgtattagcatgtgcatcagattctagcgtaaaaatatataaagtcttataagttcaattaccatgctatcttcttaagtcttataaaataattgttacgattagcaaattatataccatctgaattggggaatagtggaatagccagtggaacctcctcatcagattcatcacctgaaacatcacatcttatgagaatcaggccaagtgcagcggaaacatcagagatgaccaattactactagtaaagaacaaggacacataccttcttcagtaggagagtcagatgtgcatacagccaggcaaaaggttaaggaaaaatattcctactcatgatttatttgaagaaagatcattataaatgcaaaaggatatcttctcgcatccgcagcttggtagccagaaaagaagatgttgtaggtctttgaggtatgcagtaactcaaactccttttcaaacaccagatcaattgacaactgaggacgatgttcaactgaaagtgtgccgagcagaatccttttaccatcaacttcaccaaaaacttgcacgttctcattcagctcaccaggctctaacgctatctgcagtgaaaatgggaacttaaagtaaacaaacttgatccacctccaaatgagcttttaggtacaatttgttaaacaaacctgtgaaatatgataatagaattctcctggtggatcacacatcactgtctctccaggtctgacagcaactcctagaaatgtgaattacattcatgaaagccattagtaaacattggtaaaaatgagcaacacgtgaaattgggaatgacaaacatttgcttctttcttaagctctacaaatatgcccatcacgcttgtgtccaacgcgatcaaaagatctcttcacagttgacacagaggggaaaaaacattagtggcatgccaacgggcagtttgaatgccacacttgtgttcagaataagtacaacgcataatcgaaggcaaatataagtagaagaatgcgcgtatttcagtgataaatatttcatatctacatgggcaagaagaaaccatagtcaatcatgaagacctgaaaaatcaaagattgaccaatcaacatcgaccttgccagtcaacactctccagtaagcttcatgccatgcttaattcattaaaaaaactgaagcactaaatcatccaaccataacatgaaaatacaaactatactaaatccaggaaccaccaaacagaagcagggaatgtattactctccagagcaaggcacagttcattaagacaaactactgccttattactcctagatatcaacttgttcacttgaatccaactcatcaatggaatagccaaatttcctgcagttctgccaagagcctgattaaagttcaagggtatgactgcattttcctacacgaatattgcttctatttctcccccaaatacaccaaaataccaccgcatcctatcaggaagcattgccggtgaaaatatccccagatctccggagcatatggggggaaacccagcatttaaccaagaaaccgaggatcaacaatccaccacaccatttttacccctcaaaatttcccctatcgactaggcgcgaccaaaaaaaattaaagatggcgtcgaatcgggagcgagaaacagtagtagggttcgggggcaagaggaacgcaccccagaatcccatggtcgtctccatgggcggcacgaaggcgatcgcgttccccgtggcctctccctccttccccctcctctcctctcctcgccgtgctcctctgctagggttttagagagggagagagagcagccgcgcggcggagtggaggcggcgtcgctttcgcttcttctcttctgattttcctacatttgcgagggggccgaggcgtcgggtggggtggctggtcgtctccacgctcaatgacaagtgggcccatgggtgttatcccgtccgtccgatcggaagcgagggaatcacatccgtccaaatcctttctatataaaaaaatagggggagaggtttttacgccgttttgcggtgcattgtccggcccagcataccttgcgtgggccggccggcactaaacacgagaaggaataagttcatctgaggtcccttaacttgtcagcgaatctgattttcgtccctcaaccgaaaaaacacagatacaacgggtccctcaactatcaaaaccggtgtagattaggtccctcggcagttttgatggtggttttggctgacgtagcacctacgtggctaatttgaactcagacttcatctgacatggcattgacgtagcgcctacgtggcaatttgatccgaaaaaataataaaacccatgggacccacatatcagtttcacacacatattaataaaaatggtggggcccacgtgggccccacatgtcatcctcacccctcctcttcttcctcctctctccccatctcccctctcttcatctctctctcctctcctttctctccaggcgacggagggaggccgatgagcgcgcgtggaggccgacgagcaggacagcacttcggcggcgaggcgtggacgagcgggcgaagcgggctgggggagcagaggaggagcggcggcgggcgagctcctcgtcctcgcagggcttcatcgtcgaggagaggtcgcaatccatcgtcttcgcagggcgtcgcgcggcgaggtgaccggtcgcaacagtgcctaggagcggcagcacgggaaggggtcgtggcgtggagtagctagaaggaggcgaacggatggtcggcgacgaagtccaccaacttcggcggcggcgagtagtaatcgtcgcacaacgtgaacccgagatcatcgtcggactcctgcccacggcggcggagctagaggttgttgttgttgtagaggtgccttctacagctggtggagcaccttgaagccgtcgtggcaggcgacgtggtggtagctgttggaatatatgtaaacttgtgttttctcctgagtttgttattttcagtcttagatactgtagcgcgtcagttttttcttcagtttcagagtctgttagtttgttgagttttctcagcaccggttggaatcagtagctccgcgccaaccactgcatgaaggagaccacgacggagttctcgtcgaggcggcggaacttgcgctccagcgcgatgtcgtcgatggcttccacccggactagctcggtccacctccacggagcgctcggcgacgccggactccgcctcctcgtcgccggccacgctcgtggactcgtggtccgtccggtcctctccatgtctcggcgtcgaagtggaactcctgcacggcgacgttgaggaggccaccgatgtactgcgcgaacccgtcctggatggccgccttgttttcgatgaaggagaacgtcccgccggtgacctcggcgatggtgtgcatcgccaccgcgtcgtggtccttgccgaagccaaacgtgtggaccggcgggaagcggtcaccactcgccaccgccgcagccgtcggtgcgcacgaaggacgacggcacgagcacgtcgtagttggcgtcgcggccgccacctcctcctgttccggcgccgctgcacaagtcggccagcgacgaccgggagccgccgcgcgtgtggctccagctccgccgccgtgtgccgctgcctctccgtcgcctggagagagaaaggagaggagaggagagagatgaagagaggggagatggggagagtggaggaagaagaggggtgaggatgacatatggggctcacatagaccccaccattctttaattaatttttctgtgaaactgatatgtgggtcccatgtgttttattattttttcggatcgaattgacatgtaggcgccacgtcaatgctacgtcagatgaagaccgagtcaaattagccacgtaggcgccacgtcagacaaaaccaccctcaaaaccgccgagggacctaatctgcaccggttttgatagttgagggaccgttgtatctggtttttcggttgagggatgaaaatcagattcgttggcaagttaagggacctacgatgaacttattccaacacgagaatgctccttctcggtcacacgggggatgggaaaaaattggtcgctcccccctcccccaatcacgtgtacaccagcagcttctctgggcttccaccacatgccccctgtccccacctgctacttatccacacacataatttcattgcaacaaatcacaaacatattttgcaaaccctctattaaaggaatttggtttattttttgttgcaccaaaaatatttcactatattcataatgtttcactatgtataaatctaatgttacagtgaactgaaatatttcattataacaaaaaatccacatattttggaaaccccctattaaaggaattcgttttattttttgttccatcaaaaaatgtttcacctagtgtacagctaaagaaagagccaaaaaaggatctttcgtgtataatcctgcataatctcgaatgttatcaattctggtacgtagaccaaataatacaatgcaagcaaaagtgggtagatttatggagatatggaaaagcatataagttatcacgcttgtatatccatcatttgagtctccaaaccatgccgtttggagaagagcaccaagtggggggagtgtggagtccccgaaagaggagctttctaaaggcaagagaaaagctccgatggagcccttggagctacagggaccaccaacccttcgcagcttagactctcacaatgtttcactatatataggtctaatgttgcagtgaactaaaatattccattgcaacaaaaaaaaccacatattttagaaaccccctattaagggaattcgttttattttttgttccaccgaaaaatgtttcacctagtgtacttataatgtttcactatgtatggatcaaatgttgcagtgaactgaaatattctttcgctatttgctgaaacattgtttttatataaggtgaaacaacacccgattttaacgagtgaaacattttcgatctacttaataaaacaattccgatatacctggtggaacatcatgcaacatttaaaaataattcaataataagctaaaaaaatttcgtcaaaatatatccatgtgtggtcttgttttgaagatttaattgcaacgaatttaatggtacaatcggattatgatttgaataagtaatttaataaaaaatcaatttaaagtaattttgcacgtaaatcgggacatcagcgtcttatttttctccaaaccaatcgggcgcccgacccgtagactcgtccactaaacacgatcgctttttggagttttggtgatctcgatttagaaaactttttcttaaacagaaaaaaatcaaaaaaaaaacgcaaaagaacacctgaatccgaaccaagcaagcactttaggcctattcagattgtagccaaaataaatcttaccaaattagcaagatggcaatattgccaaaattttagcagaatttcttatgtatttatcaaatttagcaacaaactaaacatagatattattttagtaactttaccaaaaatgatatgattgaaaatggcatcaatttgaacagcccctaagcacacgttgagcgcatgttctaaaatcgggattggcttggctactttctcaaattttgttaacacgttttacatatcgctacgatatgttttgtatgaaagttttcttacataaaaaatgattttaaaaataaaatatattttttttaataattaatactcaattaattatatgttaattatatttctcattttgagtgtggctgataaggtcatttttaacctctgcttataacatgggtcactaacacgcacccttaattcgtcagcgagattgcccagtaataatgaaccaatgggagataaaatcattaaacatctatatatcctctcgacaaaaaccacttttgtgcagatcatggcagccatttctgctggatgcatagtacaagttttggtctcagctggagctgggtggcagcgaagaaaggaagccctcttgccaagccatgaaaaattccttggctactactagtagtggtaagtactccagtgtaatactatgaaattgcatgttcagacagccagacatgatggctgctaagttgcttgcctcagtcacaaatcaaatgataccttccttgcctccctttccctccaaaattcccatttcttgcttcttcttcttcttcctcttctccttcaagtgcatggacgctgaattgctcactagaagaagaaagccaagaacctctcacacttccgatccatctccatcctctcctctctctctctctcacttgtgtagctgtgtgacttgctgagacatgggcaaacagccggcgggcggcagcgagccgaggagccgtgcccgtgcgtccggcactgcggcgccgacgacgcgggggccggcgccgcagacgcacgcgccgccgcaggagcgtcgccaagaagagatcgtccatggcgtacggcacgccgtggcgccgggcgacggtggcgccggtaccagcgcccgtccggaccgacgcactcgtttcgtgacccaagtaacggaagtgccgcaatcgccggttcacggcgacgccgtcgccggggaggaagccgccctggcgaggaggccagggaagaagccgtcctacctgcctgcgcggctgagaagggcggaggagggtagccatggccggacgccatggtcggcgcctgctggccacccagcaccgcccgccgccgtgccggaagaaccgcaggagccgcggttaggaccaccaggattaaagccggcgaagatcttagacacccataagagtatcgagcgcaccagcacgatcagagacgaggacgacggcgtcacctacccg

SEQ ID NO: 43981 - DNA, 34316 bp, Oryza sativa
tgctcgtcatcttcctcatctaccacccgcagtcgcccaggatgcgggtgacctccgccaccctgaacgccgggtacgtcgacgagctcggcatcgtcggcggcgcgcgcgcgctcaacgccgacctcaccgtcctcgccgccatctacaaccccaacaccaagctccacgtcgtgctccgctacatgcagctggacctctacttccagggcagcatgatcgggacgcaggcggtgtggccggcgccgctgcacgagggcccccgcggcagcgtgctccggagcgtccacctcgtcgtcagcgaggtcaccatgacgcaggaggacgtgtacgagtggcagaacgcaacgagcaagggcgggcccgtggtgctgcacctcgccggacgcttccgcgcgcggctcatcttcggccggtggttcaagttcaactactgggtctcgccgcagtgcacgctctggctcgacccgccgcccagcggcgcgctgcgtcgcgcgcggtgcagctgaccccgcgcgttcgtccccctgctgctgcgtcaatctgcttaatttctggtcgttttcatcagcctagaagagcaaactacaaactactggtctattatcttcgattagctattttttgattgaattaatttgaattcttctgcaatttttgctgctcgaatgggattatggaaccaaggatagagttaattagagatggcaagcaaagaatatttggctgctctacttgacaaaaatgtgcaagtttttccatgataaacttttgcaaatttaaacgttagtgattaccggtttaaggatcttgggaatcagcaaatgtcagttttgccttggagataaatccaggagccggtgaagccgtgaagtactcgaaacttaggctgaaatgaatagaatctatgtgatcacgatatcggtacattgaagacgcaatgcttcacaaggatggggttgatctgctcaagtgcatgaaacagaaagtctctaacattaggatgactgacaatatcatcttggacaatatttgccaaaaccttctgttacctgatgtgttacagagtgatttctctgctggattaatgagctagttttggaataggtggcaatgaaggaagctctctgttccttttcagaaaaatggaagtaagctcgcttgccaagccagcgaaaaattccttggctaccacctactagtcagtaccactaccactgtataagcaaggataccttccttctctccctttccctccaaaattctcatttcttctccttttccctccaaaattctcgcttcttcctcgtcccataaattcaaggacactgactagctactccgtttcgtgctcctttcacgtacgtgtgtggccttgccgagccatgggcaaccgcccgttggcgccacatgcgggcggcggcggcgagccgagacaccaagacgaatgcttccggcatggcgtcgcgccccgcgacgaagccgtggcagaagcacgcgccgccgcgacggccgtcctatgtgcctttgtggcagagaagggtggaggaggaggaggagaagaagaagcagcgtcacgccgcggcgccaccgcgcgcagccgcgccggaagaacagcagcaggcagagaagacgccggtagtggtgctagccggagaacggccagccaggactatcaccatcccgaagacaaccgtgcgcaccggcggcgcacccgggcgacggcgacggcgcagcacggccgctgacaccgagtctccactatcagatcaaaatgaagaggaagccgctggcgttctgccacatcctgttctacatccacgtattgcttctgatcatcgccgtctgcctggccaccgtcgccgtctccctcgcctaccaccccaagtcaccccggctgagagtgacctccgccaccctgaacgcagcggcgcacatcgacaaagcgcggcgacagcgcgcggcgggcgatcagcgccaacctcaccgtcctcgccgccatctccaaccccaacaccaagatcggcatcgtgctgcgctacgtgcggttcgacctctacttcgaggacagcgtggtcgccgcgcaggcggtgtggccggcgccagtgcaggtggcgcccggcggcagcgtgccccggagagtgcacctggtggtcagcagtgtgtccgtgacgcggcaggacgcggccttgtggcggaacgcgacggccaagggcggcaggccggtggcgctgcggctcgccggccggttccgcacgcagctcaacttcgaccggtggttcttcaggtacagatactgggtcaagccgcagtgcacgctctggctcgacccgccgccgagcggcgcactgcgacgctcgcggtgctgacccttttgctgctcatcgattgcatttcacgggtatattagaacgaattagggatatctggtagaatattggttgctctacttgacaaaatgtgtaaatatgaagtaaaacagagtatttgtatgcatcgaccaatgttccagagtaaatgtggctcggtaaactactgaagaatttcaagttagtcaaatccagtttaagaagtttggttgggatttcggaatcagaagatgtcaattctctgtggagataaatcccaagggttcatgcatgtactcaaaacttgtaagctgaaatgaacgaattttgagtatacctcctaatagatgaaaacaagaatactttgctctacttcagaatttctgcatatgttagaacaacaataatctaaaaatgataattgaatgaaatgctcaaccaccgaaagtacacataaccaatatgaccaaatagccatgcatgccagccaacgtcacaagtagatgcatgatctctgaagcgaccaaaattaaagcatttctatccaacatatgaaagattgacaagatcatcttgtaatatatttgccaaaactttttggtacctgatgtgacaacgggtttttgggtgaagccgatgtcaaaacttccagggatttgcttcattgcttgtcacattcacaggcacaagataccatcctcacatcctttcccttcagaaaattctgaggctcttgcagagttcagtacttgttgcctctgatgtcgttcccaatttcccatcattgatgactgaatccacattgccaccaccgccagcgtgttcgcaaggaaacatcttactggaaatcctgagcagcaactcaacggcagcctcctgctccaagagaatagcagtgagcagagcagcatgaggtggtggtggtgttctgggggctgaaacaggaccggataggcaacctcggcctagtgcagttgcaactcgtttggcagtggccacgcgcagctcaggcttggatggttgctgtggcagaccggtgctgattgatctctgatctcaagctcctgaaaagaaaaggacgagttcatgaaatatttgacccttcgttgcttaggcaaggttcctacaaagttattcctattcagttcttggagccaagataactgaggggatgatacatttcaaatccataccaaatttactgatagagacatgcataaaaatgctataaaaatgtggtttatgatccctgaaaaaaaatccaagtggtactcaaaacaggtaaatgaagtaattacgccgggaggtaaatgaagtaattacaaaaccaatgctcaacgtcactattaaaaaatcagatttaactttctttagcaaattctggtttatctaggctgcatctgtgtaaaaacctaaaactgaccactggacggtatacagataaaacattacaacctaagataatataaattaaacaaccctgacaaccttttttttcctttgttccatagaaggccttactaggaatctaagcaaagtgattaacagaataaacataaaatgtgcatgaagatagataaaaatactcaatttgtttgccgatagccagatatgattaacatcacacatgaaagagcctgtggagaagatatagaggcacttttactaagaatgcataagggtgacgcaatcgagattagtaatttgcagtggaaaagtataatcagaaacgcttcagttcaaatccttggcaaaattctaacctgtatcagagcaattgagaaggtatcatctagcatctctctgaaatccaagctagcttcttcatctctatgatattctttcagtttgctgcattcctatgccttgaacatttttgttgtaattgcatagatctccccatgtgtaagccatcaagcagcctattgtaagtcgcaatgtttggtacatatcctgcatccagcatttcatccaatacagcctccccctctttccttattccctgcctcccaaagccctgcacaatgatgctgtatgtaaagccatcagcctgaaaacctttctctttagcctgcagcctcagcctgtttgcgtccactgtcctcccagcttcacagagcgcctcaaaaatatagttacaagaaatggtatccggaactatctccgcagcaaccatcctccccatcatctggcatgctttgtccagcttcccctccttcatcaggcactccaaaaccgttacaccagcagggacacccaagcaggatacccaattcctttccagtatcaactccaccacttccactgctttctccacattccgaacacggcacagagactcaaccagatccaagcaatcaaacccttccggcaccactccatcgaccaaaaactcgatgaaaacctcggccgccttcagaggctccccaccacggcacaacccattgatcatgatctccatggatgcaaccgatagcccaaatccaagctgaagcatctcgcgtgcaaccttaatgccctccttgcaccttccttctctgaagaacccacgcatcagagtattgaaactcacaccagtcggtgaacagctccaacgtcgcatctcctgaaaccagcgcatcgcagcatcaacgccttcagcgcggcaggagctgttgatgagaatgttgaaggtgtagacatccggatggacgcggtgggtggaggtcatctcgccgtagaagcggacggtgtcttcgtggcggcggaggcgggcgagtgcgtggaggatgatgttgtagaattcggcggggagaggtgaatcagcggcgcggcggagggacgcgagggcgtcagacgcggcggggatgtcgccggaggcggcgaaggcgaggatggccttgcggaatgtggggaggagctcggggcaggcgaagatggagtcgtcggtgcaggggcaggggcggaagaggacgagctcgaggaggcggcggagcgaggggaggcggcgggattccgcgaggcgggaggcgagcagtgacgtgaggcggtggtcggggcggaaggccggggagtcggacgcggccgcgaggaggaggtggaggtcgagcgccgccaggcgcgggtggtgccgcgcgcggcggaggatgcggaggagcgcggccggggtggacgcgtgcaccgaggggagcgccgggagagggctcggcggcgagaggtgggagacggcgagcgggagaatgggcagggaggggtcgagcgggatggacgacgacgacgcggggctctcggcggcttgctcgacatcgatctccggcgagatgaggcgctggtgcttggagatgagagacgggagctttcgcgcgaggcggcgggaggcggccatccgccggccgccggcggcggactgcagaggcggaggcggaggggttggactgttcgcaggaggaagacgaagtggaaaagagcacaaggctttttactgtggaaggcccataaactgaagggagagagcccataagttctcttttgaaagattagcccaaatctgatgggttgaaatcggcccaaatatattaaaccatacttcctccgtcccataaaaaactaacctgcatcctaacactacaaatctagacatacctataatcttaaattcgttgtactagaatatgtcatatccagtactagattcatttttttaagacagagggagtacaagccaacaaggttcatcgtagtaaattattacacatgatctagcaacttggtagatagatacgatatagtataaaaaattgataattgaacgtccaagtgtaattacttggtaagtgggtgtattctaatacaaatacaatttattaattttttggtacaacaacttagcaaagtatatgttgttctggtaaatgagtgttagataatttttttcactgaatcaatatgctctcatatagcaatcttacaaatattaccttataatcttgaactcgaccataagaattaagttccacaaccaatttgcaccaacggtttggattttgttttcttcaccttctcaaatctcaaccgaaatataatatttttatacttagtaaaatttagttgactttcagttattagaataaaaatttaaatatgcttacacaaatttgcattagtataagtacgtaaaattgaatttgtatagaaaaatctcaaaataattatttgtcgcgtcacttctacttattgtatcaaaactggacccaccttgaaagttgttatgacttatacattcaattataaagttcttacgctaaattgcacccatctgccaagttgttgcactatgacgtttatttctcaagttgttgcaccaatttgcactcacctgccaagttgactcaccttgaatacattttactctatttgtcgtcaaatttaaacgaagaaatttgatatatgtaaatatagtataatcataatgtaattacattgtaacttgcatgtaactataatctaatttgtatataactttcaaaattctctaggtaacatgctattagtgtgaaacggaggtcatgggacctaatcttctcacataggcgccaactgtgattcttttcttcctcgcttgcacaaattctaaagcaaatctaatgtttaaaactttacgaagttgcatacgagttatattatagttacttaccagttacaatgtaattaattacattacgattgtattatatttacatctgtcaaaattttagaagaaaatttatcgacaaatgtataacaaaatctctggtttaatccaatttctcgcccaaacaaaatccgggtgaggatcgtctaccataatgtcattactattatagttactggtatgcgagttccaacctactattgccctatacattagtgcctgtaatgttagtgtcattccgataaaatgtgaaaaaaaaaactcatgagtcatgacctcgtataatcctcagttcctcaccggaaaagaaaattggaaatttgacagctacgcctgtcgattgtgataagtcataagtttaacgtagacacagactcagaacattctaatgatagtgacatatatgcatacagtttatacatggaccagccgactaggtaaactctcctcctcatttgagaggcttcacggcaattcacttcgccatcaatatcaggacagggtcgtcatacaagtacatacaaccaaccgaaatctgacctttgctacgcgaacacatctggacgtctggttgctggtcatagagtcatatactccgcctagatggctactcactccgtaaaaaaaaaaaagacaaaccttggtttccatatccaacgtttgaccgtccgtcttatttaaaaaaattatgaaaaaaattaaaaagataagttacgcataaagtattaatcatattttatcatctaacaacaataaaaatactaattattaaaaaatttcatataagatggacagtcaaacattggtacgaaaacctacggtttatttttttttttttacggagggagttgaaagcaccaggcggcagccagccacgcacgcgtcgcttcgcggggaagttggcttcctgtttggcggtcttggcctcgcgcgtcgcacgcacgcacgcaaacacagcaaactaatccaaacccgagagacacgagtggtagagtagtagacggcgcgtcgtccctggcaagtttgaaaaggtctttttctcgatatatatacgtatatactccctcgggttctatattaattaatattttggacaatgttaaggttaaacttttataactttaattatcaataactttaaaaatatttagtttaaaaaactataaatttgtcttttaaaacactataataaaaatatacatgcatttatttattgtatatattataataaaaaaataaggttaaaggtatatcttgtaaagcgtgtcattgtctaaagcgttaattaaaataaaaccggaggaagtatgccatcactccgtatgacatattgacacgtacgtttcgtccatctttgttcaaatgctatttttgttaaagccttgagacgagtactaggcaaatcagccaatctagaaactgtatttctggtagctaagccatcgagaaaaggatggcgcttttacgtacccattttcctttgtggaatgggtttcgcgttttgcaactcgtaagctaggctgtgtttagatcagtgcaaagtttgaattttggttgaaattagagatgatgtgactgaaaagttgtgtgtgtatgacaagttgatgtgatggaaaggactgaagtttggatccaaactttggatctaaacacaaccctagtattgccgtttgccgaacttttagtactccaacaaaataattaccatagtggacaatttgcaaattaggatggttcggcctaatttcttcctcgtcttcgtcttcaccccgcgcttccttctcctactaaccatttgacccctagtcctgcaacctggcaattagtcagcattaattaaccgatagagcaaggcagctaatgtgattagcaaaatgggccgtataaattaaggactgacgagatgtgtttggtgttacttaatccggtccagcacgtaatcctggggttcaaatccaattaacgtcaacaccaaaaaagcagcaataaaatacttccggctgcgccaacccggtgaagatgacgattcaggtgtatatcgatcagtatatatatgaatatatgatgatcaatttcgttcgaaatgaccgattggtttcccagctggctgctaaccttgattagcaggcaaacccttttggtttcttctgagttaagtatatatcatcatgttaatatatatcatatcgccactagctagcgtacaaatacattgcgaattcacatatattgatatatatagccagtggatagcttgtcgatatcattcattattgtagaactaccactttgtgttttataattaatgaggtgtatatcaaggaaaatgccaaccactttaccggtttattactaacacgacttgataaatccgttgtcgttgaagactgcataacacatatagtcttcaacgaaatctggccggtggtggtggaggtggtgcaagcgggcagtcccgcgaatctacttatttattttcctttagagtggactagtgtgttgtaggtaaagtcaattatatattcttcacttgcaaagtatcaaatgggatgtagcccaatggatggttaatctcaagtagtttttgtttaatttagagtattgagcaaattattacgtacagtgctggctatcgactttattatacggataaactatatttttaaaacataaacataatacataactttttaaaataagtggtttaagtaatgcagtagaagaaaatttttttaaagcacggaacgagtatccggtgattgaataaggtaaaaagaaaaggccttaagtgtgatataatggctggagaattttttggataacatgcatatatagccgatgcacctgtaaaaataaaactaagttagtgtatcgtagccttaagaaactctttatttaaggcccattcaacgattcaaatgacatcaaactaaacatttaagcataccttatctatcgtaatttagtccactgcacttggtacatattttaatttagtacaatcggccaacttgccatggaacgttgaagtaatcattatattaggcggttaattatttgcttggaccaatagttagtggtagcatgtggccatttgcaataacttgaagaagttcttgagattaggttcttaaatatgtttttttataataatggacaggttcttaaatatgtaattcctcaacatatatgaccactcaaatgcgtttattgacacttactgaaacgtgtattacaattgatgtgtaatgtgatccaattgtattggctcgtcagcaaggcaatctaagcaattcactacatacacatattacatgtgtgtatatatttataaatcttaaatgacatattagctaagaatatctttgtgcatatcctagtgcagttgtgacattctaattcaattaggatgcggcctatgtagcacatgagtgacatgtgcacttgattagtactacattgcttgctagttgagaaaaagtggaaccaacgagtcgctccaaccataccacttatgggttaattcttatacacagagaacgaaagtgtaagcagggtactatgtataagtgggtccgtctatcggatggtttgagctacacggttctataggatggacggttacaacaactgaaatattcatttcattatttaaaaaaatgctacatctatcaattaggttgtgaagtggtattggcacggaatttttattaaaaaaacttctataactatcaattaggttgtgaagtggtatatgcacaaaattgagtgatagatttagcttttttgtgcggggttttgaatgaattatctccccaaggcttcaacaaggtacctcatgtgtatcaaatacataacatcataaggtaaatttacagaccatgtcttggggttctaaagaaatgatgccaaatcaaatatattataacatcatgccaagaacatcttaaatataaaaaaaaatggcggatgaggaatttgtacaaaccatgacattgactaattataaccataaaaagcctacatacggagtctatctaaaatataacaagactgcaattgtttctgaataaattattgctcactactttttattgagatatttgaggaaaacgtaacaaagttgacaactttatcaataaccgcgatcccacaaacaatatgacatatatttatatgaagtcattctttttcgattacatccactgaattaccacgaccacactttctaaaacatcttaaatgatgtgatttttttattaaaaaacttcatcattatttcttagaaaaccttttagaatcattttattaactttctaatatttgtatttgattatttgtacccttgaataatagtcataaactcagtttcatccaacatccattaatatttttaatagactatgagggaagttacagttttccaataaaaccatgtgctacattgcaataatctgaaagcaaattttcacttcaacactgtgttagaaagtttgtggcactagaggtattatgatctattcaaagattttctctctttaattataccgaaagtgtgtccaacaaattattatttttttaaggtgtctttcaatattgacacgtttttatgatgtataccagtaaaatatacagattttaaatgcaccatagcaaaatttatctaatctaaaatactatatctagagtcacaacatattctaatagtttagccaaaacaattgtagtaaaacgttactcactccgttctaaaatataagtatttttggacttcggtatagtcttcgatatgctactttgaccaacaatatctgtaaaaataagattttttttaaaaaaataaaaagagttgcatattatgatagtttttttaataataaatctagtaatattttttttattaatagttaaagttaaaaatggttgactaaacactacataaaaatcattatattttaggatggagggagtatgaattttacggttttttacgcgtagtagtgattagaagactacaaacattccattcaagcccgagcaacctctattaacacttttcctagctaatctattaagatcacggttacctctgcggcccgcccacctggtgataaaatgtgtacaatgtcagcatcacatggctcccacaaaagtcatttgccttttaatgagtgcccatggtatgtccaattccccatcattggattcccagtccaataaatccaacacttcaagttttcaactgccaccaaaaaaaattcctaacatgcccccctgttcttttcaattttttcttgatttttgtcctagattatttgctttacggttttttaaaaaaatttcttcataaaatttcttcgcggcaatgtataggccactttttataagttgtttgtgaattttattttttataaaatactaatttaccatgttaataaaatataaataatatgttctagcaatccactcaaaaaatttcaaacaggccctgaaacagattcccaatgctattgtacgttaaacgcggtgaagttaaacctgggtgaagttttcccgcacgtgaggagtttgacgaggaaaaactccaactccaatccaaatgcggtgtggaccgtgtggtgattggatcgaacacgcgttgtatatataccggagtaaatccaaactactgtctttccttccttgcacagttgcacccgtgaggccgtggcactgcagaagcagccaaaccaccaccagctcacgcctcccaagtcccaagcggcgacgcaacgcgaaggaaggagccccgaagcctcgccgcgcctctcccgaaaaataaaccgcaaaggcggcgccgcgagcggttgcgttgcgtactcaccttggtcgtcgtcgtcgttcccccgccgcctccgcgtcgcgcacgaggagatatacgccccccgcgtcgcgggcttggttgatcgatcgatcggttggttggttggttttgttggatttttttccttggtcgatctagttgagatgggagggggccagtcgaggagcccgcgggacgggagcggccacgggaggtacggccactcgccgtcgttccagcagcagtggggcggtggcggtggcggcggcggcggcggcggcggtgggtatccctatgggcaggatgcgcatggaggaggctactacggcgcgccggcgccgcaagggggatacgcggcgccgtacccggcttatcagcagccgccgccgccgatgccgtccccagcggcgacgcagccgccggcccgggcggggggcgcgtccaagccgcgcctcgaccgccgctactcgcggatcgccgacgactaccactccgtggatcaggtatctgcccgagcatcatatcctgcggttctgtagattcgtgtggaatttggatattcgatcctgcttttcggagcatcggatttggttgattcgaacccgctcgtgtaggcctttctcccttaatcgcggttttttgtttttccatcttaggattgttagcgaatcgctcgttaccgatttgcacttcatagttggtcaatctgtagctgtagccacttgaaacttcagattaggatgatctgtagtggtggatcgaattgatgtttgtgcaaaaatcagaaggagacgactcgttaagcctgctggtcaactgccaatcactgttgatgaagaattaaaaaaaaatgtttgttgtgaggttgggcattattggcggctccagctttcggccaaccatcattattggttgtagttggtctcttttgcttggtcttctcaattctcaaagatcttatgagtacgcaaattagcattaatcaattgagtctggcctctgtacttcctgaatgctccttgcctcaatgtccaaaatgcggcaattggaggatgtttatttttattggtgggataaactggtccaccagtttaatgtttcacacttccaattttctgcttacattactaactccatgtctaagttttctgaatgttttttttttattttttgcgtagcacattacgctattgttcacaattagttgtttatcggtaaaagttgtttcatatgttgtatttaaacttttctaacatttctgtattctggcctcataaccattagtataagaatcaggcacataagcaaacaatccagtttctattgtgttgctattattcccatgaattggtttgctcaggattaatattaattgcaggttactgatgcactagctcaagcaggacttgagtcttcgaatcttattgttggcattgatttcacaaagagcaatgaatggttaggttagtactaacaaatcgttgtttggtttattttcttatcagtcttttgtgttgcattgccccttgatgcttatggtttgttttcatttacaggaaaattttccttccatggacgcagtttacatcacattagcaatgcacctaatccgtatgaacaagcaatctcgatcattggacagacactgtcgaaatttgatgaagataacttgattccctgttttggatttggagatggtagcgattctattcattagctgaccatttctcgcactatattataatttgtccaatcataattcaactgggtgtgttttttcagcaacaacacatgaccaagacgtcttctgtttttatcctgatttgagaccttgcaatggattctcagaagctctaagccggtacagggaacttgttccacacttgcgcttagctggtaagctgatgttgcccagtgatgcctcttatgctggttctatactgttaattcatacttggaatgttgttttttgaacaggaccaacatcctttgcaccaatcattgagatggcaatgaccatcgtggaacaaagtggcgggcagtaccatgttctgttgataattgctgatgggcaggtactgtgtaaaacacacaaagggaaatattttttttgttaaataaaacattcatgctgaaattttgttttccccatatgaatcgttgttttcagttcactattttaaagctttgaatgacaaaacatgtttttcatatatggagtttcacgtgctgggatcggtggactgttgaatttgaggattagaaatggcatgttctatgtccacttgtgttccatctgaagcatgttgtaatgtcatttgatactctgtcctacatgatccttagtcgagcaattttttatttgaggttattcttagtttgaagcttgttctacatgttggaccaacctaacgactagacattcattttctttataccttattagctgtcatattatcacaggttacaaggagtgtagacactgcatctgggcagctgagttcacaagagcaaaagactgttgatgctattgtgagagctaggttcgtacttcataagttccttttttacattgttttgatatgctcataccgcctgtaactcccatgcattttgactcctgtttttgtggcgattactttatatgttcacatagtttgcgttgcctctgtcatggatgttgctgatgttttgctttctggttttcgtctgcagtgaattgccgttgtctattgtgctagtaggagttggtgatggcccttgggacatgatgaaagagtttgacgacaacattccttctcgtgcttttgacaattttcaagtaagtcactgagaaccctaatgaacccatgtaggcatgtttgtatatggtagatgaaatttttgttactccttactgaggatctattatctgtgtagtttgtgaatttttcggagatcatgaacaaaaacatgccccaatcaaggaaagaggcagcatttgcactttcagccttgatggagatacctcagcaatacaaagcaactgttgaattaggaattttagggtacgcccctaacacgttattactctaatgctttgatctgttgaattattgattcattctgtggtattctgactaaaattaatattgatgtggcatcagtcgtcgctctttcaagtcgcctgaaagggttcctctccctccccctggtggaagccatgatgcttactcgtatggatcaaaaagctttagtaaaccaagtacctacccacagagtagtacatcatcatcgtcatatcctcactatgaaactgcacagagttcgagccctgctgtaccttcttctacttatgacaatcaggtataccttcgcgtgcggtgacaacatgctatctgttgcttgtttcttaaggcaggcatttgcataattttgtgtcttaaataattctttttctcctgtaggtttgcccaatctgccttgtgaaccccaaagacatggcgtttggctgcggacaccaggtgagacattcaccctcttgctagattcagtgttttcttgcttcttgggggtgtcattttctgcttttgtgggcttgttgaaacgtcagcgtcagcatccttttctaacaaagtatataattttgcagacctgctgtgattgtgggcagagcctcgaatcgtgcccaatatgtcgcagtccaatctccacaagaataaagctatactagcaatggcagtttggatcatttgcgaatgggtggcatactggagaccaccttgtgtcacattgggcgatggattgtattggatgcttcaagtgcaatccatgcaaagcctttgaacggcttgcagacaagcccgttaagtactgggtttgcatcgacaaggatcgcaaggccagcaatccactgctccaagattgtggagcaggggatgtctcaagtattgaaacccactaggaatgatccgaactccagtgcaagaagtgggttgataaaatattctaacgaattgaagaaaagaaagaaaaggagaaatcctgatggatcgaacaggagtctgtctgattagtcgaacatttgtacatatcgcgatgttggtttcgtcaccgtggccgacataagttttagaggattcgttttccagtgccgtcttcatgcaagatttgtttgtttattcatgcgtttttgtaaagatttgcagttttcgtatatgattgaaagtgactttttttggtgccattttttctagtgaatttgtcccctgcttttgttctgatgccggcatacctgcaaattgcctcaactatgttacactggtatcatgccgtcctcggtaaaaataatatcgtgttcggcgtcaagtgtaataggttggcatagcttaacattggttaggtccaatgtgttcgtcaaagatgatataatccttacggaagaatgcaaagctgtaaacccgctaatcacagcgctgcgcttgcaatctcatccttaatggaagaatgcaaagctctaaacccggctgatcacagcacactgcacttgcaaatggtaatcgacggtgcaaatggtaatctccggcgtcgattgattacatgtccgcgaagaaatggtagacgctggcgttgtggacgatgagacggacggcggcggcggtggtgacgacgctgaggacggaggaggcgacgatgatgccccagtgccaaatcctgttccatctccctgcttcatccttccctttgatctgcacatcaccattccatccatccatccatccatcatgatcttgatagaattatagtgctatcaatttctcaacagaaatgtgtcgtcataccttgaggacgaccatgctggggaacatgaaggtgagagggaagaggacgaaggagccgaagaggttgacgaagtcgcccatgaaggggaagagcgcggtgacgaaggcgttggctccgaacacgagccccctcgccagcagccgcctcccgaggttgtaccgcgagaacatcccttcgtccagcctctgcatctgcgtgtccagcgcctcgtgtatcggcaccgtgaacagctgcgccacccgcacgcacgcacgcattaatccacggcaaattaaacgccctaccctaaagagctaaaattcaacttagttactctacaattttgttattagcatatttttcaaaccgttaaacaatattttttgtgaaaatatttttttaaaaaatgctttaaaaattaaataaatattttttaaatttttttagtgaataatactcaaccaatcttacacctttttcgttctacatcattatggcttcttttcatattatttgtcgaattgttaatatggattatttgctccacgtttctaaaatgtatcaatccgcttaaagcttaattaatttgttctaggctgagctctcacgccatcaacggggaggaggagaagaatgtggtatatgatatatgtacgtgctgcgagacgatgctctggaggaaggcggtggcgttgatgaggacggtggcccagctgggcccgctgagctggtcggggaggtactccgacacggcggcgccgtacgcccagtagccggccacgctgatcccgtagtacaccgccgccccggccgtgtactgcagcagcagcgcccgccgcatgttggacaccaccggcttccgcagcgtcgactgtatctccggcagcagcccggaggtgttgcacacgaggatggccgcgatggcgccgaacgcgccgaacaccttctctgcctgcgtcccgtggacattgtagtccttctgcttgttcgatttccctaaatgcgaaaccaaaaaaaacatataaatcctgttcgatcgatcagatgctgcatgaacatgtatgatcaaatcaaagattaatactccgatgttctctgctgagagtattattaggggtaaattagtaatttactaataccatgattaataatagtaataactataattaatttatgttactgtagtttagtcactgctaatgacaattatatctctccgcacatatttttcttagataataatatctcttcatgtttctattactaactaataaggtgataatgtaaatatgaaccatttgatcaaataagattaactgtttagattgttttctactattatagagcaccgcaacagagaatacttgagacatgtagtactatactgtagtgattagtgattaccgtctttgattaggatgacaatgagggcgacgtcgtaggcgacggtcagtgcggcggacgtggccagccagttcctcatggcggaaatggtcggcacgaagtaggcgaaggcgaagtagacgaatccggttgcagcgatgaaccactggagcctcgccggtgagtggctgctgctgaactccgcatgtatcgcctgcaggttgcagtgaaaaaaaaatgaataactaaatcggctaactaaactgcgagcttacaattggtcatagatagacagctaatcggatattcgatacaattaacagcaaattttgtaccttgagtgctcttccgcctagcagaatgaagcccatgtttccgagtatcagggtgatgaactgcaggaaccaagtgatgtagtacattttcctcccttcacaaaacaaacaaaaccgtgtaaattaacaaggttcgtcagctgcattttcagcctccagctaacttaatcatctattcatctcactaattaatcaacccaatttctctgacatgaaacgcaccgaagacgaagcccatgaggtccctgtagcggatgaacctctggccgtcgatgacatggaggccggcgaggagccaattggcgtaccaggaggcggcgccgatgaacagcaggcaggcgatgccccacccccaacccagcggcgccatcatcaggttggagaagctcagcacgtaggcgcagttgaaccccaccaccagcagcacccctacctgctgccatgaatctgcatgcacatgtgtacatgtccaacgattaaactaaaaccgatcaataattaacaattcaatatatgtgtcaagaatgcgtggatcctgatgcttcttgttgctataaatcgaacggataagatcaagaattgctggtttgttcatcgatcaccatggatatgcttgcacctgtgtctatttgatgagcagtggctgcagtggtgtagctgccgctgccggccttgtcttgttggcctgcagctgctgcctcggcgtcgagcgatgaagcagccatttcatatgcaatcaaactgatacatacacactctctcacacacgcacacttcatacatatatatatagaaggggatcaatggaaagcatgaatgatcagccgaatttggtagtgatggagagacatgcaaattaaagaaattaaaaaggtggaaggaaacatgagctgaattcgacggcattgtagctcggtcgcatatgcacccgtggctcgcactagctgtagccgctgtgccgctctctctctctaaaagaaagaagcattagctgccgttgtgacgtcgtctgctgttgtgaacaaatataaggacttctatcacttaaatttattccaaactaaaatatataagaatttctatgaaatacttaatttgtcccatattaattacggcatgagttagtttaatagctggctatcacagtacattcaccaatttaaacagaggcataaacggattttttgtttgcttcttgcatgattgccttaaccggatggatgaagggtggttaggtggttgttctcatatgctgtaccggagtttcggtcggcgtcagggcctcacaggaatagcggctttttcctgggcgtcaggcgatcgaaaacggccggaaaaccaatactgtcgtgtgaggtagctaggctgttacatgaggatgatgtgacgctacgtggtgtgtggccgactgagttttccttttccttttgtgcggattaataaacagactacagtctggtgatatacgtatacagtacagtatacgtagtagcagggtagtagcaggcaagtaggtttgctgtcgcaacagtgtgtcaactttgccattattaagggcgtccgtatatagtttcttttttgaaacccgttggagtattagataggagaaaaaacgtactgtatagtttcaccgcgaggtaatagcaacacgcatcaaagaaaagcgggttagcaaagcaagattcgtgcaatgtatagttattttctcgtggcactatgtggtccatgattgataatatataattttaaaaagtcgtacaatgtgaaaaaagtaaacggttttttctctcttcagttgtactaaacaaaaaattgaactcaggcctcttacgatctctcgtttttcctcttcagttgtaaacaattaaaaataatattattactaatttaaagcattggatcacaagagaagaacgattattttagctttttcgtataacccatgccgcccaatatatacggccggctggtaggaaaaagattttcttaattagtacctacaaaacacacattgtggattcttttagtagcatcatagtctttaaaatttgtatcgaaatgtaagtattcctagagttttgtctatcccatcaaccatctttatttatctttttactattgatcttaaatcatctatgcactcctaacaatctctcatttaatgaggaagcatcatagtctttactactcaatattaatagtgtttatattaataatcaaatttcattaaaattataaagatttggttgagtcgctgattgcttcaaaccaaacaaggtagacctgaagtagttcacaatatactagtctttgtactcgcgcattcacgcgactatggccatcctactataaatagtgtaagaaaatctattaataatattatattatttgagaacatgtaaaaaaatataaaatatatatagaaataattttcacgcatttgctacacacgtgagcatgctttttcatgcctttttttttctttatgttgatccaatcgctagaattttttaggttatgtggattatcatcatttcattttaggtgattttaactatcctgttaggagtggtgaatatgttctttagagaaaatagtgacgctcgttacccatttttatagtaaaattccacttactccacttactctcatagtaaaatttataaattacccattttaaatattaaaattcaatcaaatccaaataaaacagtgacatataaaattaaattaagatgaatttgaattttatgtaatattatagtaaattttattctatgttcagtaaagcacgtatatttagctcataattatatgaaatgaatagaactaaaacctgtatatagctgtatactcctactgtatcaatgagattgtccgcagacactaatatatggaatcagactcccgtatcagccactgctattacattggaagtactgtagaggaggtgtgtccttccgcatgttatgcatactgtcagttgagctatgaatatgatgtcttgaaatttcaaaatgtcaaggttttttggaacaaaaattatgaatacttacctaggggtgctttcataaataattttattttataggcgtgatattgagaaagaggcatgagtaagaagccacgaggcggtcgcaggcgcagctagctagagcggtgagctgttccatctctcatcctctcttttattcatcctctcaattcatttccttcgatcatctccattctccagcagcagctagctagctaggtgcatcatctgactccggcggcacctgcgtcgctgtctcttgctagtcgccagttttctgatgaggacatcccaatcatgactataccaagttcaactactgctacacatgatcaagtaatggaaggactgattacgcaaagtcgtgcgcagaaactacaacaacaggtgaactcactccttgctacatttgatgcatctatagatgagaatgttatactacctaaatgttctactttggttgcgcttaggattatgcaacaagaggaagctgaatcggaccatgaagatcaaaccgctacagtgaaaaacggaccagttcaacttcaaaacagaccagtttaagaaatcgtcataacttttgattctcaaaagctatgaaggtgaatgagcatttttttttggaaagcttattgagtctagtttcacacccaacaaaccgctcgtccattggatttcccactaaagagttatggccagattagtggacactgctccgaaggccaatagtctgccatgacatttaactttccatgcaaaactgtatcaatctataatatttcgtagtgcattatgcacatggtgtgaaagcttattaagttagctttccaacgcaactgaccccatgtcatttggactttccaataaggagtaacgacctttttttactgaaggctactcataagccaaacagacgcgcgagtcttctcggaaattcacttgttgaggcctttgggctagtctatgtccttctttcaagacttttcatacctatctaggagggttgttcctagtataaatattccttatgtgctttcagaaacaacttttgatgatttgataacctgaatgtttttttcagccaagctgcttgagtgtcttacacccctttgttcttgcgagttctttttggacttgtgaggaagatctctctgaggtcccctagttcgtgcaccacggcttctagtttggctgcaccgtattgtgtggattagttccgaattgtggttttgcggttgttcggagatcgagtcgaagttctcacggtttcggtgtctctctccccgtcgcttggtcgcatccaaccttagcagttataaagctagttacccactgtttctacacaagttatccttggttttcaacctactgtcgtgaagatcgggccacccttcgcgagtgtgttcacatcattttctctctggattttctttctttcatgtggatcttttttttttctttctcctaaaagcaccatggctgtagctcagatttgctggcatcgatatcaggatatatccgcgtgaggcagagcaaagcctgtgaggatcttcttcctctgcttttccttccatttccgcctatctctcacgctccgcctatctatctagctatcgggaggcgggaaccgtagtggatgcaatggtggaggaggtggtggaggcagactcagtggcatgatgaggaagatcaagccgcctccgccgcacttcaccggcctatcattgaagtcatcttgctcttgaagagtagcgcctggatcaggttctgagagtgaccatggaggatttttttttcctttgccgctcattttgttttccttcctgttcatgatcatgccatttgcccgtttcgcctcaaagcctcgtgaagaatttatgcagatttttttctctcatctaatggctacgatcgtctctctctattttgtccttttctgaatcggacgggtatacttggtgttgcttccgtggcccaaccatgttgcgtcttgggattagcttttcaattagagagattttccttaaagagtaaatttcaagtagctgtagatattttgaaaaaaaaatcacaaaactatatatagttaaatttactataaatatcacaaagttacatatacagcatatcctttatcataaaattacatattataactgctccatcctaacattgttattctaatggaggcttaaaatctgtattttttttaataaatctaagatttaaaatatgtaggtttatgataaaactgatggtatatatgtgattttgtgatattataactaaaatctatcaacctgattgttttgcttacagctaaataagccgcaaaacaccatataagcaataaataataatttatatgtacaacttttatatttatattacatacagttaaaaaaacaattgctaaaattaaagtacaatgaaccaaccctccccccaccctaccaccaccacaaaaaaatgaactcagcatgtaagttttaaaatggtttatacgctgaaattcaagctccgaaatctttgtgataaatttagcactgaatgtgtggttttgtgatcaatttagcactaaatatatggttttgtgataaattttgcagggaaattgagttagataggcaaatatagcatgttctggctgtatccctgtaacacaacggaactatttcgttatccatgtcaaatcttcctaatgcgcaagggacggcaaaggaaaatcgataacataataacttttttttatgaacgaaacattgataccatagccggggaagatccctgtttgtgcagtagaatatgctttaaagccacaccgtatcttccgatatctcaccctctcattccaatccatccattatcttggtgcaaatcatatcatgtttccttttggaaaagcaaagtcaagaagaacggacgacgataactttaaagcttcctttgagctgccagaatggatgaggcgatttgattgatgcatgcaatttgacacaaacgttcgtcaatgatcgccggtttcgtgaaatttcaacaatgcaatgagccaatgatgcgttgaacctgattcatgtattcttgaccttctatcaaatagtagcacctcttacagttgaagattgatgaagccacataaggtttcttgtgctgaacactcatttgctagttttcttgtcccaattatctccaccacgcgttcgaaaaccttatctggaaacttgcggaagcgctcactgacactgagttcaagcttctcatcagtggtcatagatctccaaatatgcaacaattcaacaaactggaataccacacttgaaaacatcactgtgtgctagaaattaactgtactcattggtttggacgctataaaaatatataacgtaaataaaatcttgacggccaacatagatcagtatatatttcattcgaatgccccatatgctacctgcacttggatgcaatacatccagcatgtcatcaatacctcgtgctattttatcaagctgaaaacagaaacatgtcttgaatcctggaagtcttctaatatattttgtgatatttctggtgaaggaacactatcttttttttaaaaaaaaacaaagggaactctatttcacgtacacagttggcataccttctccaacaacttagcagaaaatttcttaggctttcaaaggtgaagggcttctgtcatttacagcttctcccaaaatcaaaatcactctcaagcactcaaaattcttttatcgaaattttaaaaagtgtagttacaaaaatttaaaataaactacgaaccagattccgtagctactaatcagcttttttataatcttaaactctttaaacaagaccttagggcctgtggctcctctcttcaggtctggaggccgacctctatggtctgtttgcctgagtattgtcacaagggttttgattccttagtcctcctcgtctcctagtagctgtagaaggatcggaactctatgttagattactctctctctctctcgccagtttcggtggttctcgagtccattctaaaaaaacacctatgctcagctgctggcgccgcgtcttttggggacttgttgggagtgcagtggggctccgcctcccctctctcttgtatagaagtagcgtccagttttaactcagtttttttttctttatccttattcccggacaatgaccctctatggttgattgtggtgtataattgaactctctttctaatatcttctttctataaagttattgtccactaaacacctaaagctcaatatgcaaacatagtatttattagcactcctataaaatctacatgcaagcatgccatataaacccattatgcacacaaactcaacgtgcaagcacatattaattatatctacaatttatttcattctaaaacaaaacattcacatgctaaatcattattctcaaattatttttataatatttcaatccaaatcatttcatcatttctccattatctgatatatataccgcagcaaagcgtggggcatcatctaatatattaatattaatttgcaatcttctacgcatttgcaaaaaaaaattcctgccagcgtgatggcccggtgcgtcgattggttttcgcccacgtcgctgaagtgaaggcctagctgtttgggatgcattgtggcgggttggcatcgtctgccttcagggtgatacggcaaactttgccgttgctttatttggagcatccatacgtgaccaacagatagattccatccccccccatatcttacaagtaactaacatcgtacggcacctatttcggtaacaaatgaattcagaaaatcagcaccaataacaaacatgctattgttatctccatgttctccttttaatttctacagacttaaactaagaatccagcggttggtcacgtatggatgctctacatgaagcagatgcaaagtttgccgtatcaccccgaaggaatgccaaccccatggtagcgtcacttctcttcccgcctcatatgcagctggcccgcattaatccaacggctaatgatggctttcaactctcatgtcaaaaaaactttgcaaaaacacccttactcttactctgatctccacaatttccagcgatcctgtaattttccaaaaacacccttgtctaaatcgcgtattactccccacgaatccgtctctcctgagccaaccaccgccgaatgccgcatctcccgacatccggctcccgcgaactcatcccccctttccacggtttccgtcgatcgaaaccctaaccctagggtatagagaggatgaggccctcggcggcggcgggcggcggcggcggcggcggcgggaggcggaaagcggcggcggcggcggccgcggcgagccgggagtggctggtcgtgccggcgtcggggcaggcgcgggtggaggaggccgggaagcacgcggtgatggcgcggacggggctgccggcgcgcgacctgcgggtgctggacccgctgctgtcgtacccttccacgatcctgggtcgcgagcgcgccatcgtcgtcaacctggagcgcgtcaaggccgtgatcaccgccgccgaggtgctgctcccgaactccaaggaccccgccttcgcgagctttgtctgcgacctgcaggcccgcgtcctcgcctcgtcctccgaccaggtccaacatctcctcctccctccctccctgttgctaatttatatgaagaatcgtggtatgaggtccgagattatggtggattgaactgccttgtacgggttctaatcattttgcccttttgcagttttgcctatagactgtatgttttaggagttgtatggtatggtagcagtggttcgagtggataagaattactgtatatcggcagcataccttgtggaattatatattttttaattgtagtttatcagaattgcaatcaggctggccctactcatcttgactcttcttgagtacatttgcgagatcacatgtagatgcttgttaatttctgttgtgttccctcaatgaactttgcgtagtagccattgtttatctctccccccccccccccccctcttcctcaaacactgatagtagccattgtgaggtaatcgtaaccaagacaaagtttattagcaggtgcagatagatatggagaaatggtccaggataatgcataggcagaacaatagatgatggtttacttctatgtgctgaccgtgttaggggttatatcactaaatgtcttttcttctttatcaggctgcagaatttactgatatggaaggcgaatcatctgcagttacttcaccatttcctgctctgacttcaaccacaccaaatgaattggagatgactaacaagaattccaatgtggtaggcggaatgactcacagcaacagtatgcccacattgactgctgcaaaagatggaaataccaaagttttacccttcgaattccgagcacttgaagtgtgccttgagtcagcctgtagaagcctagaagaggaagtaagtgctttcccttatgcaatcacctgtatgtaaagtttggtgaagttttagaatgcatatatggaactgaattaataaaaagctttgatacatttttcggttgtttggtaactaagtggtcattgtttttacatagaagattagataatttatcttcacatgtgctggttaagtggttattaacttgaggccaagcccttaggagagacatatagaaatttgatgaagcatggttcttcaaattcgctgtgaaagaggtgttctgaaccttagttatggagaaactcatgcatcttatgaaaccagacaacctgtaaaacatagcctacttgatgtttatagtgtctgacctttttcctccttcagacgtcgactctggagcaagaggcgtatccggcacttgatgagctgacttcaaagataagcacactaaatcttgagcgagttaggcaaattaagagccgcctggttgcaatctctggtcgtgtgcagaaggtaggaaattgtaccttttcaatcacacttcatgtcacctacctgtaggttctttcgttcttacctatgttaaatcttatttatgttgctctcatggtttggagataaacactgagtgtgtatctgatgtttatgccatcaaacatatttttttgatcaagtgcaactgctaaatgtgtgaacttcctaattggtcaggtgttattaaacatgatttttttttttccttctgctggctgcaacactacttgtttaaccttcatatagttgtgtgaagtacttcccccacaccacttacacccaaaggctaaatacaacaaccgcagcccacaacaatcgcatgcatgtgcatgcacacacaagcatcggtcttttgttgtcctccatagtttcctctcaagcttgcttgcctttcttctgaatattatttccttcaacattctctgaatgcattccacccttgttaaaatatttatttcttataggtgagggatgaacttgagcatttgttggatgatgaaatggacatggctgaaatgtatttgacagaaaagcttactcgacaagaaataagtgagacttcatctagagttgaggttgatgacccatctcaactggaggtggataggtaagtcatgagagcacaacatgtctacattttccttgaaagaataaaacaggatgtatttgtgtctcttccacccataatcagccattgttgtctctgtgtatgtataattttatatctgtgtagggatgaagattatagaagtgaggcagatgtaagcaatggtacctttattggctataagccacacattgaagaactggagatgcttttggaggcctactttgttcaaattgatggcacacttaataagctatctcatgtaatgactttgcctttccctgttccttgtattgctccaaagtgttcttacaacctattatttgttgtcagcaagtatattaccaacgaatctacaattttataatgttttatgcatgttatgttgggctgctaggaaggttgtgcgttgcgtttcatggatccattggcatttgctctgtttttttcctgatttcatgggaggttctttacaatgatttattttgattctcctatatgagcatcgcatgcaactgtgggaaactggtccagggagttgtgcagttgagggtttataaaccaaattcatgttgttttatgtgcagttgagatttgacgtttcttctctatgcttgcagctgagagagtatgttgatgatacagaagattatatcaacatcatgttggatgacaagcaaaatcaacttctacagatgggggtcatgctctccactgcaactgttgtcattactgctggagtggccgttgttggtctttttgggatgaatatcggtatatcgctttatgctgatcctacaaatgaggaggagaaacgagcatcaaacatgaaattttgggaaaccactttgggaaccattgctggctgcacggttatgtacatagtagccatgggttgggggaagagaagtggactgctgcaataatgagggtgccacgatgaatcacacaagttgacgattgctagcctggtcagacaaagctctataaacaagaagacaacatagggctcgactgtatacctccttgaacatatataactgttgctctgatggcttgcatgtgcaaggaacagagatgaaaaggaagcgatctttttagcaactctgcgcggcgatgcatgatgtaactgagagatgtataacaatgtaactcggtttttgatatttcggatggttgcacgattgcttgtctgcaagccgtcgtactaatagtttgtgctgttgtcgtatgtatctgtaagcttcttggaagctgtaaatgaactattacatcatattcataaggaagtactaagagcatgtcttatctgaagggttagtatgagctgtaaatgaacatgttattcatagggaaatactaagaactgtgaatgaaacatgtcttatggtcagggacttagtgcttctgtgcttgcactctgatcgttgcttagtacagtacgtactcgtcaacaggtgcataagttagagataaatgatgtctttttggacgaagataatatccatttaatacggaaaagctaacaggtgtgatttgtgtttcttctctatttttaaatttcgatttgataatggcacagttttcgggtcttcggacaaactcacaacatcatgtcttaggtttattttatgggatgaagagagtataagattattttgagagagagagggacatagagaaaaatccctcgtttctcatgcatatttttcccaaaatgctaaacggtgtgttttatgaaaaattatcctaaaaatcatattaaaatatttttcaagtttaaaataattaatatttaattaatcatataccgatcgtttacatatattttcgatattttcttctcctctcacacgcagaactagcttgatcggttggtcccaccagttaacgaggcccatttaaaaatctagcgaagttgttctcggcccgctcagcccaagagagtttgtacggccgtctcctattggtgaagtctgtgtgtatctctttctcccccttccccttgtcccgaagacgccgccgttgccaaatcccaaatccgccgcggagcgaaagggtgggagatcggaggagaagaaggaagatggtgaaggtggcgacctacttcgccatgaccttcggcgcgttcctcttctggcagtccatggacagggtccacgtctggatcgccctccaccaggacgagaaggtaacactagctcctgccctaatctatctttccccactaaattcatcagtttggcatgttagatctaggcgttgcctgtgtgtgattggtccgcgtgggtgttaggctgtgctgggggttgccggatccgtcctgacctgatgaaccgcggattatttggagttggtttgttctagttttagggttcagatttgatgctttggctttctgcagtgttggtggctgtgctgcactgtcgtggcttacattttttttaaaaaaaaatgaatacatctgaaatgaaacatggagagttgtggtaatcgaggaaacaatggttgcatctcgcatcttaaggcacaccaggcacacaagaaaatcaatttatgcactagggaatcacagcgtagcagaaacgcctgtgaacccaatatgattatgttgtgtggattaattgctgcagcctgcaaactcctgactgttgtgcaagttaatactcagtgccgaatgctgtacaccctgtggttacagaggggttcatattaagcgtaaattgcccaaggcaactagtaacctgtttgacacattagatatggttatattcatttaattatgctgggctcctcctaaggtagtaaggttgaatcacccaaggttggcttataacctatgtacgaagtctaggatcagtattctgttttgttgatttcttcatttgttgcatttgtctcacattaagggtaattgctcatgaacaacttgctatctatttgcaaaaaatagcacatcagttgttttttatgtactccaccagcactgtgatgctgcgattgatcatcggtctatcaaaattgtcttgggcgtcaggattgttaccaaactccttagaaataggaaattctgtacaggtagaattcgactttgtatgcatgttcacattcttttggctcctcgtttgctagattgctcttgagacaagtgaacattaggtgcctaactactgtcagaattttttaaatgctagattgagacaagcgaacaagttttggtgttctgtactcctatgtgctcttgagacaagtttctacctgtccacccatatacacacccaccaccgaaaccacagcgactgaaagttggaagtccgtgtgcaaattgatgtgttttgtgcatgtactgtgtttgttggaatatgctgaaagtggttttgttcttgcagaaagagaggatggaaagggaacaggagataaagagaatgcaagctgagctaatggcccaagcaaaggagagtgaatcatgattatcatttggcaatggttttagtagttgctttgtcaaatttcttccttggaatgtactttccaagtgataatgcttggctgatgtattctccacagctccaataaacaagagatcttataactttttgtcaaatgcaagcggctaagctcatgatgagttatttgcagtttgtattatacaaaagagcaaaacatgcagctccatttccatggtttggcgtgatgtttagtatcgatttcatagatgtttcagctggtcagtctttttggtgaaacaaatgtctaatgtttagaacaagatgcgcatcttttggttgcctttctgcattattattgttctaacaaactatatgtatttcttaaaaaccaaatatttgcatcgtctttttttcagctcgctgtgcccctttttgaactgttttcttttgagttcgtcttctttctttcgtcactgcatcatgtataaattgtgtgctttctgttactcgagttacccaacttacaaaagtgaagtaaagaaacgacaaacgattgaggcctgatctaatgtttgtttatcaaggtttgttgaaaaccagcttggatccttcatgtttatggtttgagccactaagtaatgtcggtttgaggcactaatgtcttgcatattgtgttcagaaagccacatgttgtgttgaaggctttcaggttgagcttccaagggaagggcataaaaagtctatcaatgtaatcatccaggtatgaaactgtaatgatcatatacctcactattaaaagtttatttacgatataggcaattt

SEQ ID NO: 43982 - DNA, 1136 bp, Oryza sativa
ccgacctccgtgcacccctccgtgcagatgtggctcaggcagtccatcgcctcgctcagctccacgtagaccccttgctccgccctcttcctcctccacttcctccgccgctgcaccattcaatcacaccggagaaaaaaaaaatcaaccaccatgaattctagtagtagtaaaaaaaatactaaaacaaaaatcatgcgattttatcagtctatttcagagattattggtcaattaagggcctgttcactttaatgcaaaagaaaaaaacattaccaaaattttggcatagttgtcaaaattttggtaattggcaggatttcttatatagttatcaaaatttgacagcaaactaaatgtagccacaattttgacaactttaccaaaatttggtaagattgaaaatgacatcaaagtaaacaggtcctaattaggttcttgtcaaaatcaaaatcattcgaccataacaaaaacgtttaggatcgggaaacttcgagacggtaagccgttcgaagtccattcaacgtggttggacagaccaaccggaccgacctagcctcccccagatacaagaaatttctcattcaatccaccaaccaaccacaaaacgcaaagcacgtctcgacataaaatgtgtgcacgagtgcgacacggtggcccccggctattccagggacttaaggctcgaaagatcccagtaaaacacgctcaaaatcatgttcccctagtgcacgacccactgtgcaaatcctcccatgcatttcggtgtcaatggaaccgtgtgtcacagagccatttacaaaagcgcccaacatggataccccacaccacatcgagtgcacaattcaaagtttgaattttttttgtgtgaaattcctgtaaaattctaccatgttgatgaacagcgataatgatgtataccaggtcggcgtcgtggaggcgctggaggatgtcgagctcgagccaggggtcgttctcctggaggaatcgccacgcctcggtcttctccacggccttgaactccttggcgagcagcctggtgcagcgcaggtgcaactgcagcgcgtcgcacagcgccgccagctgcatcgtgtccaccaccgactccgccgtgagccgggacccgatcgccccct

SEQ ID NO: 43983 - DNA, 811 bp, Oryza sativa
tttcacacaaaagcctgtaacgcttcagagagtcgcactctcaccatctgtttattggcttatcagttttatcttcaaattaaattttagagttttttattatcgtttttgcttttaacattgtatttgaaaccacaaattatacagatatactttcgccgtgtttagtttcaaaatatttcttcaaacttccaactttttcattacatcaaaacttttctacacacataaacttccaacttttctgtcacatcgttccaatttcaaccaaactttcaattttagcgtgaactaaacatagcctttgtattttaacattgtaaaagttttactatgtagaattcttttattcgtccatgtggataagccgaagccaaacgatcagagcctgcctatgcctatccactcgaaaaagcctttttctgttgagcaattctacggtacctgggaaagtaccttgagtaccaaaaatttagtgtaaaatttggtatctcataatacctatctaggttattatgtacagtagaaaaaatggtatatcatggtacctccttaaggacagtaaaattactataatctattgttggtaccaccaactccaaaaattcctgcaggataataccaaatcacactgtactactacggctgaaacaagccgatcgactgcaaacaaaaaagctggagaaaggaagcagctgcgaaacagaatgcaacgcgtgtgtctgttgtgtccttgagtttctgcgcaaatgtgcttgtcgtttgcacgtagcagtacgaaggaaaaagtaagaataacccgtcaaactat

SEQ ID NO: 43984 - DNA, 863 bp, Oryza sativa
agaataggcttcaccatggccacagcttcctgggatcacacgagaatacatgttattgcttcatttttttcacaagagaacacatgttattacttgcatttcatataggagattttgagaaattaaaaatacatttcagataggagatttggagattgaaaaaacatgtcattagtactttattactggcttcagacttcagagttcagaaacatgcatttcagagaggagatttggataaattaaaatgattcagagatcagaaacatgcatttcagaaagatatttggagaaattaaaatgattcagagttcagaaacatgcatttcagaaagagatttggagaaattaaaatgattcagagttcagaaacatgcatttcagagaggagatttggagaaattaaaattagtgtgtacctcgttggtcaccacgtcccagaggccatcactagcaaggatgaggaactcgagagagctgtcgaccacctcctcctgtacagatcaaataagcagataaatgtcgaatttcgatttgcaacagtacataacgtaatatggtcgtatcctgaaatcgttcatggcctctatgcatatactttctttatgagctgcatgaattatgaatttgagattggaagaaacttgaggaccttgatctctggatcagcaaccacatattgcttcaggagtttgtcaccaaatgctcgagagacagcaagaacaccacccacgcgccatgttcctacaaaatttccgccaacagaattttagcatttttatagattaaggacttggtgttcaatgtcgaaaaaaagggtaaatgtagcatcagcacaatgaatagatcaagagttgaaatac

SEQ ID NO: 43985 - DNA, 724 bp, Oryza sativa
aactggaggcaatgggtggattttgccgacatgtgggcgtttattttccttggacaagatcagtgctttccacggtagcagatctagatccacaggtataatgcatttgcatatggtcacaacaatgtcaggtctttatgaaacacgcgcctctgcaagactgcaacatacagccttcacaaacgtacaacctgcgtttaatttcggccttaagccacagaatgttaacgattctatctaccaactgtaactgcatatagccacattcatgactgataagataatttcagataaaagtagtagatgaaatttgagctatttaatcatgtattaagttaaaaaagttgaaatatcttatagtatatgaaatggaagtagtataggagtccgcataacattgtgataggaatagacaaaggtaaaattgctcaagacttcaaacctactcccaaaataagcaaacgtaaaataagatggaaaataacctagtataaagaatctggatatggctatatcttatcatattttaggtgttctttattttggaaaaaaaaagttttgggctcatttgaattgcaggaacgaaaaaaaataaagcaatagaaaaaacatatggttctgacagaaatgcaagtgtaaaactataattataaaatacaaaaaaaaacatatgaataactattaaaattacataaatttgagaagagattaagacttaaaggaa

SEQ ID NO: 43986 - DNA, 1396 bp, Oryza sativa
gggcgaattcgagctcggtaccctaattcagatcagaacaattgcagttttaattcctttgtaataaagcttagttcttgagcatctgtttttcttcttttcccccatctgctcttccctccagatggtctacaccaggactggcaaccgcacgacaggcgagggcagcaacggcgaagaacgcgctgatggtgtgcaccccaacagtgattctggcaatggtccgccaccacttcccgagaatccgacccttgcccaagttatggcacatcaaactcagatgatggcagccatgatgcagcagatgcagcagcagcaccagcagatgcaccagaggatgatgcagcacgccgaacagcagcaccagcagtttggtccccctccccctcagtccaagttgccagaatttctacgcgtcaggccacccaccttctccagcaccaccaaccccatggaggcgaatgactggctccatgcaatagagaagaagctgaatctcctgcagtgcaatgatcaggagaaggtcgcttttgccacacaccagcttcagggtcctgcgtcagcttggtgggacaaccacatggccacccgcccaccgggtactgaagtcacatgggcagagttctgccgtagcttcaggaaggcacaggtgccagacggggtcgtggcacaaaagaaaagggaattccgggcgctccatcagggcaacaggactgtgacagagtacctccacgagttcaatcgcctcgcgcgatatgcaccagagaatgtccgcaccgacgccgagaagcagaaaaagttcatggcgggtttggatgatgagctgaccaaccaactgatatctggggactacgctgactttgagaggctggtcgacaaggcaatccgtcaggaggaccaacgcaacaagatggacaggaagaggaaggccgctcagttcagggcacatcagggaagtcaccagaggccgcgcttcactcccgggcagcagggtggacctaccaccatgatcgtccgccagcaccgcccgttcaaccctagcaacttccaccagggcaccagtggcagtcaaaactaccatggaagtcagcccaaccgcggtacagctccacgcccaccaatggcaccggcacagtcaggccagcccgcgcaagccaagaaggagacgggagcaaaaccagtgtcacgtcctgataaattcatcccgaaataaaaatcatcttctaaaaggaataatagaattaattaaaattcgaaaagaaattggcaaacactaaaatacgtacaagaaaaattcaaatgtgacccggagaatttttgttaaattctccttggtctaaaaggagccctcaaattttagtggaattttcagagcacaaataataattaggaagaa

SEQ ID NO: 43987 - DNA, 1237 bp, Oryza sativa
  unsure (1)..(1237): unsure at all n locations
aaaaaaaaaattgtattcccaagaaaagtcagatgtgttggggaacctccaaaaagtttggatggtgctaagagttgctcaggtaaccgctcaggaggaaataaggtgattatttcccagactcatcaagcagatcgagacctgctctcgaaaaaagagatactcatcactgcaactgaatatcccaacggagagatttcactggacagaaacataagtgaaaacaaaggatttttaaggtctaaaactgtaaagccagtaactcatcaaggaaaacgatgaatccagaggaaatttgcatcggctcagactacttttaaaatctgcaaggtgggtaaataacccaccgttcagacgagcgaaccatgttcttcctcatcgccggcgtccatcctcagatcaccaaaccaaaccaaaccaaacagctaaaaaaacgaaagagaacagcaaaacaaacacgaagaagcacatcgcagaccaaaccaaacgaacgccgcagatcgatctgtggtgttcgtgaaggctgacgagagtcgagaatgtggatgatagcggcggccgcaggtggaatgtggatggaaaccctagctggggtgttgcaaacttatagagcgacccttccggaaaagcccctagatgtagggtttattactgtacatgccatcctacataggcctccggcccagcccaacctcgccactctcggcccagttcgcttgcattttgcagtggaaaagttcagtttaggtccttaagtatcgagtttcagtcacatccctcaactatgaagcacattcaacctctagaacctacgttcctcggtagtttttgatgacggctgatgtggcgtgttgatccagttgtgtcctacgtggcgcctatcttgtacttacaattaggggaaaaaaatgaaaccccatgtcactgacattcccttcttcccgcgttgtgttcgctccttgaaacaacgagtcacatcctcatcgactgtgtgttcgttcgacaggtttggcaccatgtgctgtcttcacttggctggcctgacctcgctccttcccgcggttgcacgctttaggtttggtggccgacttctaggaattgcctgctgaagcatcttcgtaagggcttcgacttcctagtcctcttggtttcttggcaactatggaaggagcagaactcattnnnnnnnnnnnnnnnnnnnnnnnnnnnnnnnnnnnnnnnnnnnnnnnnnnnnnnn

SEQ ID NO: 43988 - DNA, 825 bp, Oryza sativa
cttccctttcccaggttgcttcctcttccgaatgatgactccactgaacacggcaaaaccgggtaaccttgtttctggttctcctttcgctggtatcaagtatgcgaaccggcttctcaacataagttaggtcctcctggatatcaatgtgttccgaatccgcctgttcttcaggtacccttaaacacttctttaattgggacacgtggaacacgtcatggatgccgatcatgttggatggaagttctagctgataagcaacttctccccttcgttccaagattttgtatggtcccacgaagcgtggtgccaacttgcctttcgtctgaaaacgatgtactccccggagcggagtgacacgaagatacatgtaatctcctgcctcaaaagtgagctcccttcgacggttatccgcgtagctcttctgtcgagactgggcaatcctcaacctttccctgatgattctgactttctcttctgcttccgctaatacttctgttccgaacagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaacatatcttccaagatttgattgactcgctcggtctgaccatcagtttgcgggtgataggccgtgctgaagtttaaacgggtccccaattcttcctgcagtttctgccaaaactttgaggtgaactgactacctcggtcggatacta

SEQ ID NO: 43989 - DNA, 789 bp, Oryza sativa
  unsure (1)..(789): unsure at all n locations
nnnnnnnnnnnnnnnnnnnnnnnnnnnnnnnnnnnnnnnnnnnnnnnnnnnnnnnnaacttaagaaaaattccacatgtcaagtccgattattatttgcattactttcttagggttttctcctgatttcacctgcattttcttggggtcatttgaaaattacgattttggctagggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaacacggcaaaaccgggtaaccttgtttctggttctcctttcgctggtatcaagtatgcgaaccggcttctcaacataagttaggtcctcctggatatcaatgtgttccgaatccgcctgttcttcaggtacccttaaacacttctttaattgggacacgtggaacacgtcatggatgccgatcatgttggatggaagttctagctgataagcaacttctccccttcgttccaagattttgtatggtcccacgaagcgtggtgccaacttgcctttcgtctgaaaacgatgtactccccggagcggagtgacacgaagatacatgtaatctcctgcctcaaaagtgagctcccttcgacgggtattcgcgtagctcttctgtcgagactgggcaatcctcaacctttccctgatgattctgactttctcttctgcttccgctaatacttctggtcccgaaca

SEQ ID NO: 43990 - DNA, 9142 bp, Oryza sativa
aaccatttttaatggattctacacaatttccttgatttactgagacttgaatgggattaaacggagctcggatgaattagttatgaattttagaagattcactgtgtttattactataacaaaaatccttaaataatttattgcgcaataaattccagggctgacgtcagcacgggggtgcggcgccgacatgcggggcccaccggtcagcggcccgggagagagagaaaggggtggcggcgcgcgggcccactgtcagcggcacgggaggtggaaggggcggcggcgccacgtggcggccgaaccgacggccccgatctacccaagggtagatcggacggcggcgggagctcgcggtcggggcgcgcgggcgcggcgcaagccgaaccggcgaccatggcgccggcggcgcggcgctcacgcggcggcagcgcgcatgcggcagcggcgcaaggcgacggccgacggcgaccgaccggcggcggagagcggcggctagaggaggagcggcggctacacagctaggcggcggtgcggcggttaaacggtgcgggagagagagagaaaacgaggaggagggtctcaccgacaacggtcgacgacggcgggcgtcggaggacgatgacgacggcgggacgagctccggagcctcctaacgaacaaaaggagaggggttagagagggagggaagggcgcgagagggcgagggcgccggccgaaggcggcggccatggcgtcactcaccggcgcacgacggggttgggtctccggcggcgaacctcagcggaggaggggtggacgaggtagatctcgaccgcgcgaagctaacggcgacgacggcgcaaggcggcggcgagcctagcggcggctagcggcggccgaagtagcaaaaacggcggcggcgggtggttgcacggcgcgggagcgatggggagctcgggagaggtcggcgcaatggggaaaaagtgagagggagtgccggcgatgcttaaatagggggagagagggccggacgtggccgggagcggcgggaatcgccggccgacgcgggggagtggggaggagagagaggcgggattcggttttcgaatcccggccatctcgggcgcgggcgcgagcgggagagagaggggaatgggcgcggagggcgcggcgcacgcgcgaacgtggccgacgtggcccgggggaggcggaggcgtgggcgcggcggccgttacgggtgcggcggcgcgagcgggagaggcgggaggtgggagacgggtccgacaggtgggtccccctgtcggcgaccccaggagggagggaggcgggcggccggctgccgggctgggcctcggcctgcggccggcccaacagagaggggggggggaaaagaaaggagaaatgggccgacggcccatttgacaaaaaggaggaaaaaagaaaaagaaaaaggaaaaaggattttccctggaataaaatattgcttgctcaattttaattggttaaaattatttctagagctctgaaaattccactaaaaatcctgttaatgaattttgacatgtagaacttaagaaaaattccacatgtcaagtccgattattatttgcattactttcttagggttttctcctgatttcacctgcattttcttggggtcatttgaaaattacgattttggctagggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaacacggcaaaaccgggtaaccttgtttctggttctcctttcgctggtatcaagtatgcgaaccggcttctcaacataagttaggtcctcctggatatcaatgtgttccgaatccgcctgttcttcaggtacccttaaacacttctttaattgggacacgtggaacacgtcatggatgccgatcatgttggatggaagttctagctgataagcaacttctccccttcgttccaagattttgtatggtcccacgaagcgtggtgccaacttgcctttcgtctgaaaacgatgtactccccggagcggagtgacacgaagatacacgtaatctcctgcctcaaaagtgagctcccttcgacggttatccgcgtagctcttctgtcgagactgggcaatcctcaacctttccctgatgattctgactttctcttctgcttccgctaatacttctgttccgaacagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaacatatcttccaagatttgattgactcgctcggtctgaccatcagtttgcgggtgataggccgtgctgaagtttaaacgggtccccaattcttcctgcagtttctgccaaaactttgaggtgaactgactacctcggtcggatactatcttcctgggtaccccatgcaaacacatgatccttgcgaggtacaattctgccaatctctttcccgtataggtggtatgtactggtataaagtgagcaaccttagtgagtcgatccacgactacccagattgaatcatgtcccgatgatgtccggggcagtcccgttataaagtccattccgatctcctcccatttccattccgggatttgaagaggttggagtaaacctgctggtctttggtgctctgctttcactcattggcaaacatcgcagagtgcgacgaattcagctatttcccttctcatgctgacccaccaaaatttttctttaaggtcttggtacattttggtgctgcctgggtgaatggagtactgggtctgatgagcctcggtgagtatcagatccttcagttctttgtcgtcaggtacacacaatctttctcccatccagattgtgccatgctcatcttcgtggaaatcccgagcctttccgactctcatgttctttttcagttctgctatttccggatcatttacttgagcggctctaacttgatccacgagcgtaggccgtgcctccagagcggctacaaacccgtgttcaacaattcccatgttgagatgttcaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcgaaggtttagatccggttgggtgaagatgtatttcagactcttatggtccgtatatacttcgcagcggttgccaatcagatagtgcctccagatcttcaaagcatgaaccactgctgccaattccaagtcatgagttggataatttccttcgtgtggacgcaactgccgcgaggcatacgcaaccactctgccctcttgcattaggacacatccaagtccgtgacgggatgcatcgcaatagacttggaagtctttcatctggtcgggcaggatcaaaaccggtgcggatactaatttcttcttgagctcctcaaaactcttatcgcactcagctgtccatttaaacttctcatctttcttaagcaactgagtcatgggtcgggcgattctggagaaattttcgatgaatcggcggtaataacctgccagtcctagaaaactccgaatctgcgacacggtcttaggtggggtccatttggtaactgactccacgttcgatgggtcgactgccacaccctgagctgtaatgacatgacccagaaattttacttccgtcaaccagaagtcacacttgctgaacttggcgtatagctggtgctccttcaacttttcgagtaccagacggagatgttgctcatgttcttcctcggattttgagtagataagtatgtcgtcgatgaataccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatcctcttcccggattctcagctggtggtagcctgatcgcaggtctatcttagaaaatactttagctcctttcagttgatcaaataaatcgtcgattcgcggcaaaggatatttattcttgattgtgacctcgttgagtgcgcgataatcaacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccattctgtatggtctcttatagattggagcggttcccggtgccaagtcaatccggaattcaatctctctcttgggtggcatggtagtgaggtcttcggggaacacttctggatactcgcagactatgggtatatcttccaattttctcaagttcttctctacggtatccactgggatttccgtctcaatctgattcaacgagacccctttctttggtgagactagagatttgtacaccactgtttctcccttctcgttggtcaaggtgactgtgcgactcgcacaatcgatgactcccttaaacttggtcagccaatccatcccaagaatgacatctaggtctttggattcgagaagaatgaggttggctagaaatggtgatctttggatttctattagcactgaggggctaaaactgactgaggttgaactatttcccggggtatgaaccctcattggtgtgctaagctcttctttccttaacccatacctccccacaaatttctttgaaatgaaagaatgcgttgcaccagaatcaaaaagtactgttgcagggattgagttaacagggaacgtacccagtacgacctccggtgctgtttgtgcctcctccgcagatgcgtggttgacacgagcctggataaaccttggcccggcacgcctgggcttcgggcatttgtcagcgaagtggccaagctcgccacaattgaagcaggaccctggttttgctcccgtctccttcttggcttgcgcgggctggcctgactgtgccggtgccattggtgggcgtggagctgtaccgcggttgggctgacttccatggtagttttgactgccactggtgccctggtggaagttgctagggttgaacgggcggtgctggcggacgatcatggtggtaggtccaccctgctgcccgggagtgaagcgcggcctctggtgacttccctgatgtgccctgaactgagcggccttcctcttcctgtccatcttgttgcgttggtcctcctgacggattgccttgtcgaccagcctctcaaagtcagcgtagtccccagatatcagttggttggtcagctcatcatccaaacccgccatgaacttctcctgcttctcggcgtcggtgcggacatcctctggtgcatatcgcgcgaggcgattgaactcgtggaggtactctgtcacagtcctgttgccctgatggagcgcccggaattccctcttcttttgtgccacgaccccgtctggcacctgtgccttcctgaagctacggcagaactctgcccatgtgacttcagtacccggtgggcgggtggccatgtggttgtcccaccaagctgacgcaggaccctgaagctggtgtgtggcaaaagcgaccttctcctgatcattgcactgcaggagattcagcttcttctctattgcatggagccagtcattcgcctccatggggttggtggtgctggagaaggtgggtggcctgacgcgtagaaattctggcaacttggactgagggggagggggaccaaactgctggtgctgctgttcggcgtgctgcatcatcctctggtgcatctgctggtgctgctgctgcatctgctgcatcatggctgccatcatctgagtttgatgtgccataacttgggcaagggtcggattctcgggaagtggtggcggaccattgccagaatcactgttggggtgcacaccatcagcgcgttcttcgccgttgctgccctcgcctgtcgtgcggttgccagtcctggtgtagaccatctggagggaagagcagatgggggaaaagaagaaaaacagatgctcaagaactaagctttattacaaaggaattaaaactgcaattgttctgatctgaattaaaaacacttaaaagaacaagcaaacatccttattaagacagccatatcataggcacatgatatcgaccgtcaactgaccccaaacaagcaacctaaacacacaaactaacaaccagaagctagaccatcgataaactaatgggaaaacgagcctaatgctcggaacggctcctgcggtcggtggagtcgaaggcgtcctcctgctcgtcacccggtccctctgagcgactcctggagcctgacagatcagtctcgccgctgccactgggagtagcagacaaccaacctccggtaccactggctgaacctctggcggctgatgctggagcgaaggagagagtgaacgcgggagctggaactggagctgcaggaactgcgggcggaactgaaggtgctgcgggagctgctgctggaggtgggttcctgggcgcaagctggatgcgcacaggtgcagtcgtcgtcttgcggggcatggtgcggatccggactcctcctggcgctggaagaccctttagctgagcgttctccttcttcaggcgcgctatctcgtccttcagggcgacgatcctcatgagcttcccatcgttcaaggccttggtcgccttgtgcaggtccgagtgcatcctgtccaatcccctcatcacagcacacatgtgaccaaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggccgcctcctgacaggcgtgatctgctgtgcctccagatgcctcgaccgccatgttagcgaggcaagtccccacgtagccatggacctccaagcggacacggtgaggaagctcgccactgagcggcggaatcgtcgtgtactccggcgcgttgaggtagcccaccaccagtgtcatacgtgccaactctgccacgaaatcgatcatgccttctccgcggtggttgggtgggtgaccggccatctagagaagacaaaggagtaggatcaatgcatgctcaaatccaaatttaaataaagcaataaaagactcaaataagagaatcgaatagaagcgaaattttatgcatagatcattttgcatgagagcgaataaataagacagactcatataacgacaaagtaatgagaaattagatacatattaataataacaaacgaagcataaacaccttgcaacccatgttatagagctaggacctaatgcatttcacccatcaaaccccaactgactgacgaataaatcccaataattttactaaaaccctagactgactcgttttgaaaaaccccacttaaacgagcgaccaagatttttcccttgaaccacaagaacagatcccaattttcccggaacaaatccaattgcaaagagcatatgcaatgaaaaggattcagagggctcttaggtttagagggctcttaggtttccatttggcttgtcctacggtcaaggtcggctctgataccaacttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaaatgcagcggaaaacaaaaggaactggagctaagccttgactaaactgcagcgggaacaccactccacaggcatcctcgacggcacggacgaagcctactcctcggggaaaccttcatctgacacatacccgtcctctggggttgggaaaaagtagagcaagactgagtactacccactgtactcagcaagtcataccggaataggggtatgatgcagggaattaacaaagaagagctagagtggttcatttgcataaatactggcatttataaacaggaattgaatgcgaaaacggttgtaataattaagcagtattaaacatccgctgtccaacgctaacccacgttgcgacaggcccaaccatccacctaaactatccaaattcatcagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggctgtgacaggaccattcgcataacccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgattcattttaattaaccaacaccagagcggtggtactaatccaacattaccattagaaccaacagtctaaacattaatatgattttccccattgtgaactagttgaactaagcatggctaagcaattcaggcatgcaagcttgaatcatgttataaccccaagctaacaaaggagcatggtatcaaaatag

SEQ ID NO: 43991 - DNA, 1627 bp, Oryza sativa
  unsure (1)..(1627): unsure at all n locations
gtagccatgaacctccaagcggacacggtgaggaagctcgccactgagcggcgaaatcgtcgtgtactccggcgcgttgaggtagcccaccaccagtgtcatacgtgccaattctgccacgaaatcgatcatgccttctccgcggtggttgggtgggtgaccggccatctagagaagacaaaggagtaggatcaatgcatgctcaaatccaaatttaaataaagcaataaaagactcaaataagagaatcgaatagaagcgaaattttatgcatagatcattttgcatgagagcgaataaataagacagactcatataacgacaaagtaatgagaaattagatacatattaataataacaaacgaagcataaacaccttgcaacccatgttatagagctaggacctaatgcatttcacccatcaaaccccaactgactgacgaataaatcccaataattttactaaaaccctagactgactcgttttgaaaaaccccacttaaacgagcgaccaagatttttcccttgaaccacaagaacagatcccaattttcccggaacaaatccaattgcaaagagcatatgcaatgaaaaggattcagagggctcttaggtttagagggctcttaggtttccatttggcttgtcctacggtcaaggtcggctctgataccaacttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaaatgcagcggaaaacaaaaggaactggagctaagccttgactaaactgcagcgggaacaccactccacaggcatcctcgacggcacggacgaagcctactcctcggggaaaccttcatctgacacatacccgtcctctggggttgggaaaaagtagagcaagactgagtactacccactgtactcagcaagtcataccggaataggggtatgatgcagggaattaacaaagaagagctagagtggttcatttgcataaatactggcatttataaacaggaattgaatgcgaaaacggttgtaataattaagcagtattaaacatccgctgtccaacgctaacccacgttgcgacaggcccaaccatccacctaaactatccaaattcatcagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggctgtgacaggaccattcgcataacccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagnnnnnnnnnnnnnnnnnnnnnnnnnnnnnnnnnnnnnnnnn

SEQ ID NO: 43992 - DNA, 807 bp, Oryza sativa
gtacgactaccaaaacccaaccacgcacctcgagcccagcctaaaccattttgggggttttaaaagaggggggggtgtgtgtccaattccaacataagccaaccattccatggtgtccaaatgatatgagaattcccgaagtctaaagttataaaaccacctaatgttgcctaattaatcagcgaagcatctacctaaatttatactagtggaaccatgaatataatgtccactagttagggttttgtttattctagggtgaacaaggtattaatatcaataacaataataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcgctttcccaaacgccggcttcaacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaacccatttattgcgtcagccgagggagagggcgcgcggaccgggtccacgggagtggggcccacgcgtcagcctactcggtccacggtggac

SEQ ID NO: 43993 - DNA, 826 bp, Oryza sativa
  unsure (1)..(826): unsure at all n locations
nnnnnnnnnnnnnnnnnnnnnnnnnnnnnnnnnnnnnnnnnnnnnnnnnnnnnnnatgtttaatactgcttaattattacaaccgttttcgcattcaattcctgtttataaatgccagtatttatgcaaatgaaccactctagctcttctttgttaattccctgcatcatacccctattccggtatgacttgctgagtacagtgggtagtactcagtcttgctctactttttcccaaccccagaggacaggtatgtgtcagatgaaggtttccccgaggagtaggcttcgtccgtgccgtcgaggatgcctgtggagtggtgttcccgctgcagtttagtcaaggcttagctccagttccttttgttttccgctgcattttttgtaagacttttatgatgtttgtaagacgtggatctgaatgtcaacattgtcgtttgtgtaccccggctggtcctggacggggattttaatgcacattctgcttggaattctattcgggaatttctgggcgtgacagatcctcagcctccttcgcggtccgctcacggtcctgctgctcacgccgtagccattcttgttcttgtgcttgatgctcctcctccagtcggcgacgttcttcggtctcccgggcttggcgttgctcctccgtctcattattggccatgaaaaagccaaagtagagaggggtgtagttgtcatctaggctttccgtcgaagtcgtccaaatcgtcgaagtcgttgtagcgagaactaaattcgtcgtactccacaatgtcagtaggacgtgagtcgaccgtgggagaactgtttagtcattcagctga

SEQ ID NO: 43994 - DNA, 3433 bp, Oryza sativa
  unsure (1)..(3433): unsure at all n locations
nnnnnnnnnnnnnnnnnnnnnnnnnnnnnnnnnnnnnnnnnnnnnnnnnnnnnnnnnnnnnnnnnnnnnncatgaggaaagaataaggaatcatatacatgctactacttcacaaggaattctttgttagggaaggacagttttgacaaaattgatcaaattacaattgtacttcttcttttactgccaggcaagtaccaattccaattgtgcctgtaatgtctaaaaaaaaatgcaaaccttgctatcatgattaagaaggagaacagaaggcatttcagggtaaaggagccagtactacctttgttaacaaagaagatagatgcatgaatgaatgattaattaagctgcagaccacacatgggctacctcaatactgggggcacaaagatccccatcacccatatccacatgctttgcactgccctgcacagtaattaaacagttacaagctagatgcaacagctgttttacttagtagcactaagcacgaagcaaacacttccattaccaggtaccactagctctttctcagtagtaatctactgcataattgagtgctgacactctcaattctcagaaaaaagaatctctgggaccccaaaaatgtgggtccctgactccctgttacaagcttgcaagcaaaaacagaattatttatgtcggaatagggagattgttatcatagcacagtggactgaagcagcactttggcatgagaaatgcagcttttagattctttgctgtgttattttaaacgagctgacctgataaaccctctgattgcaattggaccgttgagcacatttcagcttaacacagccgcgccgcttgggcccacaagagtatcaccaggtgggccccatttgttcttggaattttcaggggatggcaatgaatgggccccaggacccacagaatgaaacagatgttagcaacaccagtgctccactagtactaataatttccagtctcccagttcacaaacaatgggatgaagatgcagcatagattttcagtcacatgtgctgaagaagataacataattaactaacaaggcatattaataatgtatgataagacttaagtagtatcatctactnnnnnnnnnnnnnnnnnnnnnnnnnnnnnnnnnnnnnnnnnagtcgccacccttagctttatcgtcttcttagtctgtttgcgtgctagtttttgtgtttaggtttgttgcttgtgggttagtcggcggtcgatatcatgtgtgagtggtatgacagcctttattaggagttgtgtgcctctttttcagtgttttaatcaagattaagataatggcacttaatcttataagaaagattagtttccgagccgtctgttttcttcctttctcttatttctacctatcctcctccagatggtgaagacaaggaatgatccccgtgactccaacgacgccagtggcagcgaagagcagaccgatggagctcatgtcagtggtgcatctggcagcagatcatctccaccgcccgataacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaacagaagagagagttccgtgcgctccagcaaggaaccatgtcagttacagagtacctgcacgagttcaaccgccttgcgcgctacgctcctgaggacgtgcgctccgataccgagaagcaggagaagtttttgtttgggctcgatgatgaattggccaaccagctaatctccggagtctatgaggactttgagaagcttgtggacaaggctatccgccaggaagagcaacgcaacaaaatgtaccgaaaaagaaaggcagctcagatcagttttcctcaagggaacaatcagaagcctcgcttcatgacgggacagctaggtgggccttccaccctgatcgtctgtcagcaccgtccctattacccgagtaacttcgacaacgactacaacggtggcagtcacaacaacagtaagcagcacaaccacaactcgactccacccccactaatggcaccagctcagtcaggtccgccagctgtgtcagctcagtcagaacaacccaagaagggggctgtaggaaagccaggaccctgcttcaactgtggcaagcacggccactttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagttccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaatt

SEQ ID NO: 43995 - DNA, 6533 bp, Oryza sativa
  unsure (1)..(6533): unsure at all n locations
nnnnnnnnnnnnnnnnnnnnnnnnnnnnnnnnnnnnnnnnnnnnnnnnnnnnnnnnnnnnnnnaaacagtggagaaaagttccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcaacatcttcgtctggtacttgagaaattgaaggagcaccagttatatgccaagtttagcaagtgtgacttctggttatcggaggtcaaatttctgggtcacgtcatttctgctcaaggcgtggtagtggacccatcaaatgtggaatcagttacaaagtggaccccaccaaagacagtttctcagatccggagttttcttggacttgcgggctattaccgtcggttcatcgaaaatttctctaagattgccaggcccatgacacagttgctaaagaaagatgaaaaattcaaatggtcagctgagtgcaaccaaagttttgaagaactcaagaagaagttagtctctgcaccagttctaattctgccagatcagacaaaagacttccaggtctactgtgatgcatctcgccaaggattgggatgtgtgttgatgcaagaaggcagagtggttgcatatgcttcgcgacagttgcgtccacatgaggccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagctgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcccggcctacgtgtcacgtcctgataaattcatcccgaaataaaaatcattctctaaaaggaataatagaattaattaaaattcgaaaagaaattagcaaacactaaaatacgtacaagaaaaattcaaatgtagcccggagaatttttgttaaattctccttggtctaaaaagagccctcaaattttagtggaattttcagagcacaaataataattgagaagaaataaacaaagttgaaaaggtttataaaaagaaaaatctctaaaagtcttcttttccccccccttcctctcttgggccggctcggcccaactctccctccctctctctcctctccccgcggcccatcggcctcctccccgcgcgcgcgccgctgacaggcgggcccgcccgccgccctcgctgacgggtggggcccacctgtcatcgccttcctcccgccgctcccgccgctcgcccgtgccctagcgccgccgccgccacggattccgccgcatcccgccgtccccgcgcgacataatgaggggggaatcattccccgcgatcccctctcccgtttccccctcttttccctctctctctccctcggattcgtccgatttgaattccgcaatcgtcgccggcgtcttcaatggagccgagatctccgcgcccgtttcctccctctccggccgcgctctccccctctcggcgctatatatttgctccccgtgcctccctcctccgtttccgccgttcgccgcttgctctcgccgtcggattcgtgctcgcgacgtccacctctctctccgccgtcgccgccgacctccggtacgccgccgacgtcgctccgggctccctcccgactcggcgtcacctccgtcggcttcgccgcgtcgtcgtcgaccccgtccgctccttcgtttcgcccgccgaccgccggagcaccgtcgccctcgtcatcccgaaccgcgccgccgcgttcctccgctccgttcgtcgtctccgccgtcctcgtgtctcggggtgagccgtggaccgtccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaacccggtttttaattgaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgttcctgcctgttgtatggagtttattagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttgatttaaattattgcattatcgctttgtttaaattcccgcgttatcactgttttatttagccatgcctatttacctttgttatgacattattattgctattgttattattaccttgttcaccctagaataaacaaaaccccaactagtgggtactctattcatggttccactagtataaatttaggtggatgctttgctgaataattaggcaacattaggtggtttcataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtagtcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgaggggtcacggccttgtttaataatactgtgtagctctaggatcgtctttacaaaatggctttgggcaactaagtgacttttaaatgctgtttactgcaaaacctaacccctattattatccccttgtacccccccttgcattaatcatgcatccccggcgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacactacgctcgtggatcaagtcagagcagctcaagtaaatgatcctgaaatagctgagctgaaaaagaatatgagggttggaaaagctcgagatttccatgaggatgagaatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggtcagcatgagaagagagatagccgaattcgtcgcactctgcgatgtttgtcagcaagtcaaagcagaacatcagaggcccgcaggactgctacaaccccttcagatcccggaatggaaatgggaagaaatcggaatggatttcataacaggtttgcccagaacatcgtcggggcacgattcaatctgggtggtcgtggatcgactcaccaaagttgctcattttattccagtacacactacctatactgggaaaaggttggcagagctttatctttcaagaatcatgtgtttgcatggggtacctaagaagattgtatctgatcgaggaagccaattcacttcaaaattctggcagaaactgcaagaagaattggggactcgtttgaatttcagcacggcttatcatccgcaaacagatggtcagaccgagcgagtaaatcaaatcttggaagatatgttgagagcctgtgcgcttgactttggcggagcctgggataaaagtctgtcttatgcggaattctcttacaacaacagttatcaggccagtttgcaaatggcaccgtttgaagcattgtatggccggaagtgtcgtacgccactcttctgggatcaaacaggtgagcgccaactgtttgggacagaagtgttaactgaagcagaggagaaagttaggaccgtcagggaaagactgcgaatcgcccagtctcggcaaaagagttatgctgataaccgccgaagagagcttacttttgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagctagagctcccatctaatatggttggtatccacgatgtgtttcatgtatctcaattgaagaagtgtttgagggtacctgaggaacaagctagctcagagcacattgacatccaagaagatttgacctacgtggagaagccagttcgtatccttgagaccagtgagagaaggaccagaagcaaggtgatcaggttttgcaaagttcaatggagccaccactcagaggaagaggccacctgggaaagagaagatgaattgaaggccgcccatccgcacctcttcgccagctcttccgaatctcggggtcgagattccgtttaaggggggtaggtttgtcacgccctgaagtacccctcccttgctctaaattcataaaataaatcgtccgaagaaattgtttaatttaacctagagagaaaccctaaagtaataaatgcaaataataatcggaatcggcatgtggaatttttcttggattctgcatgtcaaaatacgctaacaggatttttagtggaattttcagagccttggaaataattttaaccaattaaaataagcaaagtgcaatattaaatccctggaaaa

SEQ ID NO: 43996 - DNA, 2294 bp, Oryza sativa
  unsure (1)..(2294): unsure at all n locations
aatgcattatcgctttatttaaattcccgcgttatcactgttttatttagccatgcctatttacctttgttatgaccttattattattgttattgatattaataccttgttcaccctagaataaacaaaaccctaactagtggacattatattcatggttccactagtataaatttaggtagatgcttcgctgattaattaggcaacattaggtggttttataactttagacttcgggaattctcatatcatttggacaccatggaatggttggcttatgttggaattggacacacacctccccctcttttcaaaacccccaaaatggtttaggctgggctcgaggtgcgtggttgggttttgttagtcgtacctcgggtactataaggattaagcttgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgcgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgcgtagctctaggatcgtctttataaaatggctttgggcaactaagtaacttttaaatgctgttcactgcaaaacttaacccctatattattaccccttgtacccccccttgcattaattatgcatctgccggtgtggcttgctgagtactgtggttgtactcattcttgctcaatctttcccctcttcagtaagagaagctttgaagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattgatacactagcgttcgggaaaaggcaattttcccggtcgcgacaccagggtcctgcttcaactgtggcgagcttggccacttcgctgacaaatgcccgaagcccaggcgtgccgggccaaggtttatccaggctcgtgtcaaccacgcatctgcggaggaggcacaaacagcaccggaggtcgtactgggtacgttccctgttaactcaatccctgcaacagtactttttgattctggtgcaacgcattctttcatttcaaagaaatttgtggggaggtatgggttaaggaaagaagagcttagcacaccaatgagggttcataccccgggaaatagttcaacctcagtcagttttagcccctcagtgctaatagaaatccaaagatcaccatttctagccaacctcattcttctcgaatccaaagacctagatgtcattcttgggatggattggctgaccaagtttaagggagtcatcgattgtgcgagtcgcacagtcaccttgaccaacgagaagggagaaacagtggtgtacaaatctctagtctcaccaaagaaaggggtctcgttgaatcagattgagacggaaatcccagtggataccgtagagaagaacttgagaaaattggaagatatacccatagtctgcgagtatccagaagtgttccccgaagacctcactaccatgccacccaagagagagattgaattccggattgacttggcaccgggaaccgctccaatctataagagaccatacagaatggcggccaacgaattagcannnnnnnnnnnnnnnnnnnnnnnnnnnnnnnnnnnnnnnnnnnnnnnnnnnnnnnnnnnnnnnnnnn

SEQ ID NO: 43997 - DNA, 2245 bp, Oryza sativa
ttctccctcccctccccgaagtccatcccacctcccctctcctcccgggcgccgacaggtggggcccacctgtcggtcgtccctaacctcccgccgccgctccccaagccggcaaccgccgagccgccccgcgctccctgccgacccggaccacgttgcccactcccccgctcgccccacactccccgcgcccacgccccactcccgctcaccccgcgcccgcaagatggccgggattcaaatttgaatcccgcctctctctctcttctcctccacctcctccactactccggcgaaattgcgccgttcccggccacgactcgccgccccccctcctatttaagcacgcccgcaccttcctctctctttttcctttctcggccgagccctcccgagccctccatcactcccgcaccgctacacccgccgccgccgccttttccactcctccggtcgccgctcgccgccgctagagccgtcgccgcaccgcgccgtcgacgccgccgggttcgcaagcttgtgcgccaccccgtccgccgtttccccggtcaatcccgccgccggagcttgctcctcctcgcgcgccggtgagtacccccatggccgccgccttcgaccggcgaatccactcgccgttaaccacccctctccctctaatccctcccatcttgttccctagaggtcccggagatcgttcgcccgtcgccgtcgtcctcccgtcgctcgtcgtcgtcgttcgccgtcgtctccactcgcgccggccaacctcggtgaaaaactccccctcctccccctttccctctcttccgtgtgcgtcgccgtcctccgcgcgcgcatcgtcgtcttcggccgccgccgccgcttttcgcgccgtctgccgtcgccgtccgcgccgccggttgccgtcgccggcgaccgcgcgtgccgccgtcgctcgccatgcttggcctgccggctttgaggccgagccgagccaccagccgcgcccctcccgccttgtgccactgccagtggggcccacgtgccggcgcccctccctctctctcttgagccgccgctcggtggggcccgcttgccagccacccctctctctccttgagtcactgacccgcgggtcccgcatgtcggcgccgccccaccccttgctgacgtcagccctggggcaatattgcgcaataattaattaaggactttttctttattagtaaaaacacagtgaatcttctaaaattcataactaattcatccgagctccgattaagtccattcaagtctcagtaaattcataaaaatgtgtagaatccattaaaaatggctttgttatctgtttcagtagtcttatagcatgttttgcttgtgtgctttgtttgtcgcgtagatttcgcccgtttcgtcgattcgcggtttctcgaagacgttgctgtggcctcatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggatcacattaaagcatagactttgattattggcaatagctttggattagtgccaccgcaatggtgttggttaattaaaatacacttcatggtgggctgtgggtgcatggttttgctagacgtgcccatggcgattaaggaccggttcgcgggatgccctggaagaatttatcgtacttaccacaagccagcgtgggcaacggctgggcttgagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttag

SEQ ID NO: 43998 - DNA, 5956 bp, Oryza sativa
  unsure (1)..(5956): unsure at all n locations
gcccgcggttatgggcggtcgaccagattcaccgtgattagtttcaccctagttagcttttggaactggttagttcaggtggtggtttgggcctgtggcaacgtggtgtaacgttggacagtgattggttaatatggattaattactacaactgttttactgctttcaactactgctttgaaatgccggctttatgcaaaagaacctttagcctccccttggatatatcttgcatcatacctcctcttccggtgtgacttgctgagtacagtgggtagtactcagtcttgctctcttttcccccacaccagagttgaagtccttctcagttgaagatgtctcggagaggttggtttcgtcgctgccgtcaaggtttgcctgtggaatggagtcgcccgctgcaggagtcaagtcttcaggcttagctcgcttgtatcttttccgctgcatttgtaatcttttatatttttgtaaggcgtgggtctgtatgtcaacaattgtcgtttgtgtaccctggctggtcctggacaggggtttaatacacattcagcttagaaattctggttcgtgaatttctgggcgtgacaggagataacttgtgccgatctcgtgtagtttgaattttcctcaaaactaggtcaccgactaaaaaggcacgagatcgaacattgcgattatgatagcgccgcaacccttgtaaatatcgagccgaccgaatcaaagctgcttcgcgggcttcttccaatcggtgcaagtcatccactcggtcttcttcgtagcgttcttcacggaaattacgaaagcgcaaagactcaaattcgacttcactcggcaacattgcctctgccccatagacaaggaaaaaaggtgactggcctgtggcccgactgggtgtagttcgcaaagaccaaagtaccgatggcagttgttgcacccatttgccggcatagggttttagccggtcaaagacacgcgctttaatcccttgaagtatcatgccattagctcgctccacctgtccattgctcatggggtgtgccactgaggcgtagcaaatcttaattccaaagtcctcacaaaagtctttaaaaactccgccagtgaattgtgtgccattatcagtgattatccgattgggcactccaaatctatgcacaatgttgatgaagaagtctcgagcattatctgctgtgattgtgacaaccggtttagcttcaatccacttggaaaatttatcaatggccacaaagagatgcgtgtaaccgccgactgcctttttaaacgggccaaccatgtcgagcccccaaaccgcaaacggccaagacagcgggatagtttgcaactcttgagctggtaagtgaatttgtctggcgaaaaattggcaaccttcacatgtgcgcacaattttgtcggcgtcggacactgcagtaggccagaaaaaaccctgccggtaagctttgccgacaatggtgcgtgcagcagcatggtttccgcatatcccagaatgtatgtctttcagcaattgtctcccttcctctaaagatacgcagcgttgcagaattcctgaagggcttttcttgtataactcagattcatgcataacataaagtttgctctgccttgaaatccgctcggcttcatctttgtcttgagggagttcttgagaagtcaaaaatcgtatgaggggttctcgccagtcggtttcaaccatagcgacgtcatgagtgcccgcaacttgagtggtatctttgtgaggtactgtcggcgtataaaggtgttcaacgaaaacatcagagggcgccacctcgcgcttggatccaaagttggcaagtctatcggcggcttcattattatgtcgaagaacatgactgagctcgagtccatcgaacttatcttccaatttgcgtacctcttgtcgatacgccatcatgttgtcgtcaaggcaggaccactctttcataacttggtggacaaccagctgtgaatcgcctcgaactattagacgctttatccctagggaaattgcaatccgcagtccatgaaggagggcctcatactcggcgacgttgtgggacgccgaaaaatgtatccaaagcacgtagctcaatctttctccagttggggaaatcaaaaccactcctgctccagtgcccgaaagtcgtttggatccgtcaaaatgcatggtccagtgctccatgttctccgcgggggtatcctcctggcactcggtccattcggcgacaaaatcagctaacgcttgggacttgattgaaatccggggcttgaatgatatgtccaaagacatcaactccaaagcccacttagcaatacgtccgtttgcttcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaataaatcggccgctggactttttggacatggccttcttcctcgcgctcaacgaccaagactgtgctcacaacctgggaggtggctgatacgtatagcaacaacggctcctgcgggtgtgatgaggctaagactggtggctcggtgagaagtttcttgaaatcttcgaaggccttttgtgcttcgggtccccactggaagttatctgttttcttcagcagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatgcccctatgagacaccataaaaccaagcagcttccctgacggtactccgaaggtgcatttttcagggttcaatttcatcctgaaagcacggatgctcacgaaggtttcttctagatccgagatcaaatcatccttttgcttggtcttgacgactacatcatccacataggcttcaacgttgcggccgatctgcgttgagaagcatctttggatcatacgttgataagttgctcctgcgttttttagtccgaacggcatggtgacatagcaataagctccaaagggcgtgatgaatgaagtcttcaagcagtcagattccttcagtcggatctgatgataccccgagtagcaatccagaaaactgagaagctcacagccggcggttgagtcaactacctggtcaatgcgaggcaacccaaaaggatctttgggacaagacttgttgaggtcggtataatcaacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactttttgaagtcttggtagcaggtatttctccttcgctcgccgtggctgcagccagtcggatatcctctcgggcagacgccatctcgcgggtttgagccatgtcgcaactctccttgtcgcatgtgacggcttgcttgatgtcactccgtagggatagcactcctcggggaccaggcatcttcatcatcatgtaagtgtagtgcgggacggccatgaacttggctaacgccgggcgtccgagtatggcatggtatgctgtctcgaaatcggcgacttcaaagctgatattctctgtgcgaaagttttcccgagtgccgaaagtgaccgggagggtgatctggccgagtggagttgcggataatcctggaattactccgtgaaaaggcgcattgcttggttttaactcggagcgaggaatctgcatatcatccaaggttttggcgaagaggatattgagtgcactgccaccgtcgatgagggttctgcgaagcttgacattacggaccactgggtctagtaccagggggtaccgccccgggtggaccactcggtcaggatgatccgagcggtcaaacttaattgcgatttctgaccatcgaagatactggggcgtgtcgggttgaacagcattgatctctcgttcagtcaacttctgcttccgtttagactcataagctaaggggccgccgaagatatggttgagctccttgcggtggtcttgaaatcctgccggggcgtcgccgtcgtctttcttcctcgacgtgctttgttcttcgtcagagttcttccgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtccttatgattgttacttccaccacctcccgtagccggcgtacccttgttttgcttccaactggggcccgactgctttgatgcggtgacggcgtcttcagctttggcgtactcgttggctttttcaaacataagcttgactgtcctgggaggcttacgcccaaacttgccgactagttcttcgtggcgaattcctttggtgaacgcggcgatgatgacgtcgtcggtgatgtcggagatcttgttacgttgttcagaaaatcgccggatgtaatctcgaagggattctccggacttctgaatgacgttgtagagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgctgtctcctcctgctgcgcggatcgcgagaccgtagacggtaagccacgattcggggttagtggtgccgtcgtacttctctattccagtcggcttgaagccggctggccaatccactcgacgcaggtcgtcggtgaaggctgctactccgtcaaggtcgtcgtcgtggcggtccggcgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcgccggtgatgctgaggcttggatgacggtagtcatgagatcggaagtggggaactcggctgccagtcggcgtgtggacgctttcggagttaactgggaccgaagccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgctgacgtcgatcctgtcacaccccgaagttttcctccctagccaaaatcgtaattttcaaatgaccccaagaaaatgcaggtgaaatcaggagaaaannnnnnnnnnnnnnnnnnnnnnnnnnnnnnnnnnnnnnnnnnnnnnnnnn

SEQ ID NO: 43999 - DNA, 763 bp, Oryza sativa
tcgtagtcgtgacggtccgtcgagtaatggtagcctcgagctgctcggcgctgtatgattgtgtcgcgaagatcgatgggccgccgacgaggtggtgagcaagaccgttccactcggcgctccctatgaaggtcggaaggtgagtgaacagaccgctcgtcgtgacccctgctcctgcggttggatcctgcgccggtgatgctgaggcttggatgacggtagtcatgagatcgaaagtggggaactcggctgccagtcggcgtgtgaacgctttcggagttaactgggaccgaagccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgctgacgtcgatcctgtcacaccccgaagttttcctccctagccaaaatcgtaattttcaaatgaccccaagaaaatgcaggtgaaatcaggagaaaaccctaagaaagtaatgcaaataataatcggacttgacatgtggaatttttcttaagttctacatgtcaaaattcattaacaggatttttagtggaattttcagagctctagaaataattttaaccaattaaaattgagcaagcaatattttattccagggaaaatcctttttcct

SEQ ID NO: 44000 - DNA, 1478 bp, Oryza sativa
aaagcactaccgtacttccacatgtctaatgggtaaggcttagtttgtggctcagtctagtcttaaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggcaggattgggtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagccgagcaatgtacccaagtcagtgttataattcttaaaatttgctcaacaactaaaatgtggaatggttggcctgggttggcttgggacgagctggaacccaggtcgggttgccagttcggtccgaatcatcgtaggccttgggttaaggcaggttcctgagggttcacggccttgtttaataatattgtgtagctctaggatcgtctttataaaataactttgggcaactaagtgacttttaaatgctgtttactgcaaaacctaacccctattattatccccttgtactctccttgcattaatcatgcatctgccggtgtggcttgctaggaactgtggttgtactcattcttgctgaatttttccctcttcagtaagagaactttggagaaaatgtcttaggtggagtcctagcttataccccagttgagcgcctgtgaagatggagccgtaggcccgctagtccgcttctgtttatttttgattgtcaggcctttaagtgcctttgtaataatgtaaatattatcgatataataaagatgtgtcttttatatcatgtttgtgtggtgtacccgggcttttcctgggacggggattaatacactagcgttcgggaaaaggcaattttcccggtcgcgacacccgggccgctgaccggtgggccccgcatgtcggcgccgcacccccgtgctgacgtcagccctggaatttattgcgcaataaattatttaaggatttttgttatagtaataaacacagtgaatcttctaaaattcataactaattcatccgagctccgtttaatcccattcaagtctcagtaaatcaaggaaattgtgtagaatccattaaaaatggttttgttctctgtttcagtagtcttatagcctgtttgcaatgtttgctttgtatgtcgttagattccgattcctccgacgttccggtgtacttcgagatagtcgccgaggtccctccagcagcagagcaaggcaagtcatgcttgtcacttgatcatattgatcctatattgcaaatgtcctaatgttt

SEQ ID NO: 44001 - DNA, 6135 bp, Oryza sativa
  unsure (1)..(6135): unsure at all n locations
nnnnnnnnnnnnnnnnnnnnnnnnnnnnnnnnnnnnnnnnnnnnnnnnnnnnnnnnnnnnnnnnnaataaatagatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagtttagtagtgtaaaagcccttttcttttccgttggtcgtgtagacgctgcagcttcggaagatccgctcttcgtggaagccgaagccgtcatttgggaaagcgagcaaggcaagtcacatcatccttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagaataaataaaaccccaactagtgggtactctattcatggttccactagtataaatttaggtagatgcttcgctgattaattaggcaacattaggtggttttataactttagacttgggatattctcatatcatttggacactatggaatggttggcttatgttggaattggacacacacctctcttcctctttcaaaacccctaaaacctgttttcggtggggtttgggtgcatgccagttatgggaagtagcaccccggccactataaggattaagctcgggcctctgttgcaaagcactaccgtacttccacatgtctaatgggtaaggcttagtttgtggctcagtctagtcttaaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggcaggattgggtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagccgagcaatgtacccaagtcagtgttataattcttaaaatttgctcaacaactaaaatgtggaatggttggcctgggttggcttgggacgagctggaacccaggtcgggttgccagttcggtccgaatcatcgtaggccttgggttaaggcaggttcgtgagggttcacggccttgtttaataatattgtgtagctctaggatcgtctttataaaataactttgggcaactaagtgacttttaaatgctgtttactgcaaaacctaacccctattattatccccttgtactctccttgcattaatcatgcatctgccggtgtggcttgctgggtactgtggttgtactcattcttgctcaatctttcccctcttcagtaagagaagctttggagaagatgtcttaggtggagtcctagcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctcttttcttcttcccctaatgctatttgcaaaaggtttacccttttcttccttcttcaaatttcaactagtactagatggtcagctttgcgaagaagaagatgtcgtcagttgtttgccgaagctccggaaggctgcaggatccgctagcgaagcgaaggaagcagtgaagccagctgtgaagcaggagtgaagatcttggagaacccgtcgcagaacctaagccaccctctagtgtttcgtttgtcgtatgtttccttgcttgtgtgtgtagcgcgtggtttgcatcggtgggtggtgatgtaaccatgctaggttgtttgcttaatcaacttgcagaataagcaaaacaaacaacacatcaacaaaaagagttagttcctttaaggtcctgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaatcggaacaacccagcaggggcaaccaacgttcaagtatctacagtccagcaacagtgcaagttatcagaatttctcaaaacggggcctccaacctttgccattgccgtcgatcctatggaagccagtgattggttgcgcacaatcgagaagaagctagggttgattcagtgcaccgaccaggagcgggttggcttcgcaactcatcagctggttggaccggcttcagagtggtgggatagctacgaaacatcacggccagaaggacatgccatcacctggaacgagttttcatctgtattcaagagatcacatgttcccgcaggaatgatcacactaagaaaacgagagtttcgctacctgaagcaaggagatttgaccgtcacagagtacctgcacgagttctatcgtttggctcactatgcaccagaagacgtggaaacggatgaagacaaacaagagaagtttctccaggggttaaaagatgagctcgcagtgcaactactcctagaggattatgaagattttgagaaacttgtggacaaagccatgcaactcgaaagtgagcataatcggatgacgaactgcaagagaaggattgtcaacatcccagtaattccaggtggtaaccaaagacagcgcactgagccacttcagatcaccggatcttctgttgtgcatcaagagttcctgccccaagaagatgaacgcaatgcagacaacaacactagcaatactaatgatgatgataccaccaacaaccatggttcttgccccattagtgaccactcgaacaaagcgtgcaatgtcagtagcattcaccaagatgtcaacgatagtatcaatgttggaacccagaatgacaaccttagcaattttgactctgggaaggactccaatggtgatagcaataatggtaccactgatgccaatgttagcaaggattcccaaccaccaattccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgccatacctgtgaggcctcatgttaattctaacccatagtagatacaatgtaccgatgttaagcaccttccctttttgtttaaagcagtgcctcgtattcatgtaatatgggagaaatttgtaataaaaacaagctctaagaggattcttttggaagatgcggatatgtgatcatgtgtataattgtttactgacaaaggagacctagggtctcgtgccagaggaactacattctaacctcgagctaatcaccaacctgaggatggaaaagaaaatcaagtgattaaccaaagagacatttgtttggactaagagtttcagatgtgtctttttcggatcaaaggcaatgacagtcagtatagcttttggcgaaacacttcaaggtttcactgaaaggcagcaagccaaaggacctcatcatccccagaagcgtccgcaatccacattaaagaataccccctgttagagataagccgaaagaagattgataaaagagattggcaaagatgttctctagcatgaaagaagtaggccgaaaggtgattgataaacagaaacatgctctgcatcgctcaaggaagacccctaattgtaattgccccacaacagccaccttgtcattaagtaagcaagatgacctaggtaaaagtgtttctatgaaggcaaggggtgaagtcttcaactcggtatcagatgctacacggagtgaaaagtgcaagccccggttaccaggcgacgccatgtcttgggagatgatccaatgggaaagaacacatcaaggctgaaggtgcacaggaatacgttgaatgctaaatgatgacaacatgaagagaatagcggaaagtaaactgaacataaagaaagtgaatctgcgttgcttgttcgtgggagctattcccagttatgaatcaggtgatacgttcgaagatagtctacagaggtcagacaacgaagcttcagatttggcaggataacgatcaaacaataagaagtccagcagtaaagccatttggggagacgccaaagcatgtcaagtgggagaagttggttcggttgagaaacataattcaaaggcaaagttatcgaccctcgcatcgaatagcagaagtagctagcacccggagaccaggaaagctaatatgaggcagtttgtggcaagttagaagtaaatgacaagcctgatatccttatgacgacaagctggtatcacaagcatggtatcctagtaatgtcgagctgatctcgacgcatgacatgaagtgggtaacttgtatgaggttgactccaaagatgtgaactatgcaaagttctggaactgaagccccatcttcaagtgccgcaacccagtcgaagtcagctaaaggttcaaccagggacaagtcaggtgaagagaagattccatccgcaataggagatcgagccaagcagtcccgagtggagaagttttgctaggcaagtttgttataaaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttcaaaaaggaataatagaattaattaaaattcgaaaagaaattggcaaacactaaaacacgtacaagaaaaattcaaatgtgacccggagaatttttgttaaattctccttggtctaaaaggagccctcaaattttagtggaattttcagagcacaaataataagtgaaaagaaataaacaaagttaaaaaggttttataaaaagaaaaccctaaaagaagtcttttccccctcctcctcccttcttgggccggctcggcccattccctccctctctctctctctccccccccggcccatcggctccccgcgcgcgcgcgcgccgctgacaggcgggcccgcccgccactctcgctgacgggtggggcccacctgtcatctccctcctcccgccgcgccgccgcccgcccgtgccctagcgccgccgccgccgcggattgcgccgcatcccgccgtccccgcgcgcattaaagagaggggaatcactccccgcgtttccctctcccgattccccctcttttccctctctctctccctcggattcgtccggattcatcccgcgaagttcgccggcgtcttcaatggcgcccgagatctccgcgcgcggtttcctctctccccggccgcgctctccccctcccgttgctataaaatcgatccccgtgcttcgctcttccgtttccgccgctcgccgatcgctctcgccgacggtttcgtgcccgcgccgggctcctctctctccgccgtagccgtcga

SEQ ID NO: 44002 - DNA, 790 bp, Oryza sativa
  unsure (1)..(790): unsure at all n locations
ttccgctccgcccgcagttctagtcgtagtcgttgtcccggggtgagccgaggaccgccgttcgccttcccccttcccctcctctctgtcgggtgccgctcccccgcgccggtggtcgccggcggtgaccatcggggcgcgggcgcgtccccctcccttcggccgcgccggcgaggccgccttcgggcgcgccccgcggctgccaggtggggcccggccgtcagccgcccgcgcccgcgggtgcggctgacgcgtgggacccacggcgccgaccgccgccagccgcgtgcgcccggtccaccgtggaccgtggggctgacgcgtgggccccacttcccgtggacccggtccgcgcgcccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagtttagtagtgtaaaagcccttttcttttccgttggtcgtgtagacgctgcagcttcggaagatccgctcttcgtggaagccgaagccgtcatttgggaaagcgagcaaggcaagtcacatcatccttgaacatattgaatcccagtttgtaaaattattttgatttaannnnnnnnnnnnnnnnnnnnnnnnnnnnnnnnnnnnnnnnnnnnnnnnnnnnnnnnnnnnn

SEQ ID NO: 44003 - DNA, 1538 bp, Oryza sativa
gaacggaaatattggcgtgagcaccttgttgaaatgtcggaagcactggtaaactgagatatttttcaggagtttcctgcagctccatgcaaggcagcaggaagaacatgagggtgaacacccaaaacctggcattccaggttctgttgttctgcatgcggcagttccacaaagaatgttcaggtactgccggcttatcccagcagatatgccatcagattaccactggtttattctgatgcctcaacagaaagctcgctgaacctggtatagcctacctgtatgtaccacatatatccttgctaggagtacttggaaatattggcacaagtacaacggtactcggtagtacctatccttacaaaaagtggtacattttgatcagagagtgacgctcagtatcagtattgagatcataaaacatgttgatcagtgtgggactttcagtatcagtattgagattagtacacgtcgaacacagcgtgacgctcggtatcagcagagagataactaagcttgacaaatgacaacatgtaattgtcacaggagcttaagacgtttcatacttgagcaacaaagcgatcaaaacaccagcacatcctgcatccagccgctaagtacacaggcaagataatatcaagcacgtaacagatgcagccagtaataatctcacaagagccaacaatagactccgatattacgcattgacacataaaacacattaaggttttgatagataaaaagatctccagcaggagtgtgacaccacatagtctgtaaggaccgtctgggtttattgaccaacattacagataagcaagcgcacaggacacacgaacaaactcgaagcactcataactcgtaggaaaagcacacgacgatacgaactggaaatattcatggcgaacgaatactcaaaagacgataaggcgaagtaggcgatgattggggacgaggttggacgcgtcactcttcctcggattcagaatccgcgctctggagccactccacgaatggtttggcattcttcaccacctgggactccttgccagcagcaacagattcattgtaccactgagttatcacttcttcatccaggatgtccccatcatacagggccttgagaacaatcggcacctccttcacagcttcagggctagacttggcaccgaaggccaccagggcttgcagcaggaccatctgggaggcttcatcaggtacagcagccgcgaggaatttcttcttcttcacaacctccttggcaaatcctttgccgaggccgccaaagagtgcatcaaaaagagcattcatagcatcctggggtggcagggctgaggaagtcatcagacccttgagctgaacagcagtagcacccttgctcaagttatccttcatctccttgaccagatcatcataaggactgcttttagcctcttcaaccacatgttttgcactttcgttggaggcacccttcttgtgtgaggcctcgtgcttcttcttcttctcaggttcttcagtggacagcatcaccatctcag

SEQ ID NO: 44004 - DNA, 24730 bp, Oryza sativa
  unsure (1)..(24730): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttggtcgccaaggctacgaattaacgttattgccgtactacttaattactaaaagatgatcgagggaaacagcgtcgatctgcaatgattaactctcaagagtcaagagtcaagtcaactaatcatctctattcgtacctctatgtcggtttggctactgtgggctaagcccatgatgcttggcctaaccccagcatctgtatttggaattcttttttgggagtacctatacatctttcgaaagatttctatggtcgtatcacacagatttttaatctttggattaaaatccgatagatataataaaaagcaaaaagcaattaagaaacaccataatggacactaaattaccatatcctcaagaaaaagaccaaatccaatacaaaatttaaaatttacatgcgtagattcaaaaattacagtgcaacttacaaaagttacagtgtaagttttataaattacactgtaacttataagaaaatgcactgtaaatttgagtgagaaaatcgagtgagagataagaaaaaaaatctttcgagtgagatatagcaaaattgttcttttttttactaaccataagaaaagatcatacgatattcagtgatttggcatatgaagaaatcaacaaaaataactacaaatggtagcgtgaaaagtgtactacctgctaatgctatggttcaaagacgaggttagatgcatatggccatccaaatacttgaaaataaaaccgacggccatcacccatctaaacctatcccactcaaccaaactcattaatcattatggaggtatactaagcatcgtatggagtaatcaacccgatcttttcattatcacctctgtcttaaaaagaccctttttcttttcatatttcagccaaatcaatacaaacctaaacaaatcataataccctccataactccacgtaataactaatataatgtttgataaataagatatggattttcatccctcgaggggatgtccctccttgacaacatagattaatataaaatatttcactcgaacaatatgtaagaccaaattcaacttctacaagttgcaacaaaaagaacaaactaaactgaaaatagttatcgtacattcatagctatatttgttataacttgtagaaattgaattttaacttgtatttttgtggattgatatatttcgtactaatctatcttactattttttttaaaaaaaaagtttatatatgcacgaaacaagaggatatcccctcaagggatgaaatcactttccctgataaacatgctaatgaaattcaaggtaaattctgtatcttaatcaagtaagaacggggctaggtcggttccgtagcaagtgtcccgagctccttatatatacatagcctcgacatggccatggcaattcgagttccattcgaacacgaagccatctatctagcttgcaaacacacatgggggcgcctctgaagctgacctgggcctcgctcggctcgctgttcgccaccgccgttctggtgcgcacggcggcgcgcgacttcctcccgccggaggcgcacggcctgctccgcgcgctgctgtcgcgcgccgccgccgccctcgtgacgccgtgcgacgccatcatcgtccacgagaccgacgccaacggcgtgcccaacgagctgtacgaggcggcgcagctctacctcggcgcgcgctgcctcgccacggcgcccgcgatgcacctccacaaggcgcacggcgcggcggccgccgtggcgtcgctgccgggctcccacgccacgcgcgacgccttccgcggcgtccgcgtgctgtggacgtcgcagctcgacgggaacgcgagctcgtcgttcgggggaagcttctcctcctcctcctcccgccggtgggcgccgcccccgatcgacggctggcaacggtgcctgcggctcgagttccggcgacgcgaccgcgacgtcgtgcgcgacgcgtacatccccttcgttctcgaggaggcggcggcgctgcgggcaaagttgcgggagaggaagctctacaccaacaacggcggtggtggcggctgttactacggcgacggcggcgccatggacgatcaccagatgctctggaaggcgcacaagttctcgcacccgtccacgttcgactcgctcgccatcgacccggcgctgcgcgacgacatccgagcggacctgctccggttcgtgcgcagccgcgagcactacgcgcgcgccggccgcgcgtggaagcgcgggtacctgctccatggcccgcccggcaccggcaagaccagcctcgtcgccgccatcgccaacctcctcgagttcgacatctacgacctggagctcaccacagtgacctccaactacgacctccggaggctgctggcctcgacgcggcccaagtcggtcatcgtcgtcgaggacgtcgactgctccctcggactgttcgaccggacgcgcgcgccggcgccgccgtcgtcccaagacgacgccgacgccgacgccgacgagcagcgcaaccgtgcgatgctgcaacacgcgctaacccttctgccgccggcggtcgaggcggccatgcggcgggagacgatcagcctctccggcgtgctcaacttcgtcgacggcctctggtcgtcgtgcgtcggcgagaggctggtggtgttcaccaccaaccacacggacaggctcgacccggcgctgctccggcccggccgcatggaccgcaaggtcgagctcggctactgcaaggccccggcgctgcgtgtgctggccaagaactacctcggcgacgacgacgacgccgacgaccacgacgagatcatgggtgaggcggggaggctgctcgatgaggtgcaggtgacgccggcggacgtcgccgaggtgttcatgggatgcgacggcgacgacggagcccacgtcgcgctgcagaagctcgtggacgagctcaacgctaggaaaggaaaaatgaatgggcctaaatgactttatgggcttcataagctttaagcccaactcgttctgtttcagtatgcattttcctattgttttcgtattattgaatactacttaaaagtcaacggcgtcatacattaaaatatgaaggtactatttagcaagaaatccaaaagttgagtttggcacgcttcggtcaagtcttttactggtcggatgggtggattaatctttttccaaattttctaccagttgatgatgacatgacatcaaagattgctacaagttctttgccattggctaaagcagaaaagatgcatgtggtggttcttcgtatatgcaccctgagtaataatatgcaattcatgtaggatccaccaatacatgtttaactttttttaaaaaaaatatctctcaggtcataaatattttactttaacacaaaatattatcaattttttgaaattttgaccatcaatagtttattaagttcttagttgttaaacaaatggcatatatgtaggtaggttttcacttttcagtactatcgtaatatcgtgaagtcattcaattttataatttcttttttacaatgcaaagttgatgatcaatgctataaaagtttgacaaatgatcccattgttttgcttatgcttataaaccaaaatttaaattttttaaacttgattttaagcttgcatttctgcagttctttttatcatggtttattttatggcactcgtcttttaccgctaagaataacgttttacccataaataatgtttttactaataagtaatatgaataagtataaggataactagaccacaagtcttgttctaaatgttaattatttatttatacccgagaaagagagtgtgtgtattatggtcaggacggcatctcactgaccttaaaataggttaaatatcatattttctttaccgtggggagtattgttgatgaggactaaggttctgaatcttccgttaggtactagataggttaattgtggagacttgatgttgatgattcaaaagctccgatcagaatgaccgaaccccgtgcaatcactacaccacccctctgttagttatcacccgagccgaaacatggttgatctcgccaaaaagactatattccgtaagcgaatcgagaacacaagtaagagagtagaagatgcaatttgaatatattgcgaatttaagatggagctcataagttggtgttccacagaccaaactagcagcaaaactgcaaaatccaaccctaatttgatgacggtaactgattaaatagattctagggtcgacctagggttgttatagctagggcgcacacccccttgggcttagcccacgagtcacgacacaattacaaagcccaaagttcaaatcggacttggactggatgaggtacatggcttgttttgtagattaccaatagattagaaggaattttgatgtgtgatcagaactatatgaaagtagattccataagctttccaataaataatcatgggctccgagattccttctagatcattggctaggtccgtttgaaattaatgctattaggagacttgaatccgaatccaaaatgtgcataatttcctctcttctatagactaaaagtgatatggtgatgtatgagcagtctttaggaaaatcttagtttggtccccgaccaatttatttgatcatccaagcacttcgtgagcccgctctcatttccttcacccatgctaatatttcttcaaacgagaagatataaaacttatggtgcagtaatatttgttcaaacgtataataagtaaacctatatagaatctatgcatctttagcttgttgaagtgtaacataaacatggttatatctgagccagtgttgttcttgtcaattgttttcgcattgttccgaaaacgacagctttgtccttgtaaacaagaagtaaggttaaagttatgtacacgtagaaagatagatcatatcaccaaatgccgagccagtttcaagaattcgagtcacctatgacctatggaagtcgtaaagtgtattagtggcctgactcatctcgaaatattggataaggtaagcctgtgctctgatttttcggctcctctagcttagtttaaccctaccgttagtcaaaagctccatacatgacttgttaacctactcttattttgcccattgctgttacttcttttatgtcgagaatgctaatccgcaaccagttgtgcgcgtcttccccggatgattggacacgtgtcgcgtgcgaagagggaagcggcggacggcacgcagagtagaattaaaaactctacctaattctattgtagttttacaaaaataccttttgaacttttaatatgaaaaacaatcaaatataaatgaatagccacatataaaatcaaattgagatgcgcgcaagtaattgcagaaatttaaccttgtgctaatgactactgtgaatttgcgttatcaacagcagccagccagtacggacggccaatgttcgttgccatcaaacgtccacgtcgacgtatatccggagatcaaaacaaaagcagaggagacgacatggtgcaacttctcataaaacgcaaagaaaattgctgaaaaattcagaaagccacacaccattgcaaaatgcagcaaatcctcaaatcctccatccatggcgcaaccatgacacgatcacaaccgacctaattaatacctaactcgaaaccaaatcaccatgaaaattattaattatatattgatcatgatgctgttcaagttcaagcaatccgcaatggcggctcgtctgctttttactctgtcgtcatggccgcctcctctgtgacaggcaccgccggcgcgtccctcctccgccgcagctcgtcggcgagcttcctcagcgcggcggtggcgcccgcgccgtcgcagcccatgaacacctcggcgatgtcggcgggcgtgatgagcaccccggctgcgaggaggccctcggcgtcggccatgaggccgctcaccgtgtccggatcgtcggcggcgtcctcgcatccttcgtcgccgacgccgacgccgaggtagttcttggcgagcacgcggagcgcgggcggcgagcagtagccgagctcgatcttgcggtccatgcggccggggcggagcagcgccgggtcgagccgctccgggtggttggtggtgaacaccatgaggcgctcgccgacgcaggatgaccagaggccgtcgacgaagttgagcacgccggagaggctgatggattcccgccccatcgccgccatggccgccgcagcggccgggagatgatcgagagctgcgccgcgttctcgtcgtcgctcgccttgttcttgcggtcggagaggtcgagggagcagtcgatgtcctcgacgacgacgaccgacttgggcgtggtggagacgagcaggcggcggaggtgggagttggtgggcacggtggtgagctccaggtcgtagacgtcgaactcgaggaggttggcgatggcggcgacgaggctggtcttgccggtgccgggcgggccgtggagcaggtacccgcgcttccacgcgcggccgacgcgcgcgtagtgctcgcgccgcgccgcgaagcgcagcaggtcggcgcggatgtcgtcgcgcagcgccgggtcgacggcgagcgtgtcgaacgtggaagggtgggagaaggcgtgcgacgtccagaggcggtggtggtcgtcgccgggggcggcggcgcggttggtgtagagccgccgctccctcgacctgagccgcatcttggtggcctcgtcgatgacgtgctggatgtagtggccgtggatgagctcccgatgctggcgcgggaactgcagctcgagtctgcgcggctcgccgccgccgccacctcggccataagggttgtaagggttgaacactccgccgccgccgccgccggcggaggcgccgcgctcgacggggcgagcggtccacttgacgaggacgccgcggaagacgtcgtgggtggtgtgggcgtcggggagggaggcgacggggcggggagcttggtggggcttgtggaggcggacggtgggggcggtggcgaggcagcgggcgccgaggtagagctgggaggcgtcgtagaggtcgttggcgccgccgctggcgccgtcggcctcgtcgatgaggatggtgccgacgtggggacggaaggcggcggcgaggcgggtgaggaggcggcggaggaagatctcggcctcgggcgggaggaagtcgcgcatggcggtccggaacaccatgatggtggcgaggagcgagcccaccgagcgccagtccagcaccatctccatggcggcgacgagacgacgacgacgacgacctctcgctcgctactcgagtgtggaagtggaggtggagtggaggtggaggttcaggtggtgggggttttatgcgtgcgcgcggcgcggcggggtgtagtcgatcggagcgatcgatcgagtcaagtgaacatgattagtacacaacatgctagattgagctcctgtacctttaaatacacggtgtttttatcattaacatgtgagtccagacatcgtcggatccacgtgtcagtgataaaagtcacgtgacttcgacggtagaggatcttgatcccaacatgctaccccatacttccgcattccgaatgaaaaataaatcaatataagatgtaacttattttatatgaatttagatataactttgttaaaattcatatgttacatcgtgtacaatgtttgcttttcatgcgctggagagagtaccgtggatgaggcagttgatgctgacggaatgcgtccaataatggagctcaccttgtgactttgcgagtaatgtgtatggatatctccaaaattcactgaagagaaatagaggatgctattgctcctgtcctaaggaccagttcggataaatggatgtcggatatatattatctaattttgtgataatactcgagagttaacaataaattaattattgtaaattggaaaaagtacaaattaccccctgaactatcgcggtcgatcgaattacccccctgaatctgaaaccagacattgttcaccctgaacttttaatatcggacgaattatccccccttagacccaatccagagcgattttttcctacatagcgtacgcgtgtcaatccagtcaacattttcttttaaaaaattggtgggacccacctgtcatttctccccttcacctctctctgcgcagaggggcgggcggcggacgacggcaacgtaagacgaggagggccatggatgaggatggacgccgccaccatcgccagaccacgttgttgcatgttgctgccgcgcttcttgacgccgctgccatggatgaggttgccgcggcggtgcatggggcggtgctcaagtgggcgcaggtgcagcaggagcgacggtggcgcgaggatccgccgcccctgatcctcgggagcgacgtcggcgcgtggatctagaggccttcatcatctggagcgcctgggggagcgggaggcgtctttctcctccgccaccgtcaagtccatcatcgactagtcgctctccaccccctcgttgtccccctccaccatcgccgccgcggcttccaccccgacagcacgcacagcgcggcgtgggaatggaaggtggncggtggcgcgcggggtcgaaaggacggagggcgccggtgggtaacaagccgacgncggcttggttgcgcgcgggcgggcgtcggcacganccggctagcgccatcactcgcccgagagcgtcgtcgtcttcgagcttctgccacgtggcgctgttgtcgtgtggtctaagcctccaagggcctcgtgccaccgcgtgtagaggccatcacctcctcctcctcctcctcctcgagccaccatgttgccgtgtgacattcccttgttgtgctcagcccctgtgtcgccgcgggccgccaccgccaccgccaccgccaccgcgggcccctcctccttctcgtcgccactgcaatcggcactgcctccacctgtctgcccccgcccgtcccctcacgccgccggccacctcccgtccctgcgccgccatgcctattttgtgcccgagagagagaggaaatggggtatgacatgtgggtcccactatttttaaaaaagaaaatcctgactacattgccacgggtatgccacataggacaaaaccgctctggattggatcgagggggtaatatgtccggcattaaaagttcagagtgagcaatgtctggttttctagtttaggggggtaattcggtcgactgcgatagttcgagggtaattcgtactttttccttgtaaatttaaaatttattgcggaaaatgcttagaaacttataggacatttaaaaaattcacactatttaaaagctcggaaaacgcgccacccatggtcttcattcattggatgcattgctctttatttggtgtttgcagctagtgcaacttaacccgagtcgaagagggtgtttggagggactacaacctaaaatccaagttagtgaggagttcagagagagaaaataatttctttttaactctagcatatttccgtaactgttacataaaagacagacgcatatggaccatactcacacagccacaagcggatctcacaccaagcacacctagtagcggagccaataagatctttgaggctgaacaaaatttaatataactaatatttactataaaaatttcatcatcaatttacttatcttaactaattaaaagattagtatttttccaatcgtcaccaaaattagtattagtatttttcgtccgtatgtgcaattttttccacttgtccgtgtacgatctcctcccaaaattttggttcgtcagtacatgcgagatcgagagaccgcatcgtacatgcgagatcgagagaccgcatcgctcctgtctcgtacgttcgtagaagcccagaactaatgcacggaaacgaaagaaactgaatcagaaatccaacaacaataaagcaaaaccatcccaaaaattaaatcaccggggccaaaaaaaaaaggaaaaaattgcaaaaaaaaatcaagtattggccggcttggcgaggcaatggggaggaggagacgcagcccagtgcgcacggtccaccccctcaccacgcacctccaaatccatggacccgtgtgagcgtgggggcgaagagacgacggatccatgcgggaagggaagaggtcgctggatccacccctcccatcgccgccgatggcggatccgcacgagaggagggcggagagatgacgggatccgtgcgggaggggaagaggtcgccggatccgcccctcctgtcgccgccgatggctgatccgcgcgagagggagacgaagagacgacgggatccaggcgtcggtggtggatccgcacgagcagcatcaatggcttggaaccgttgcatgaggaggccttgtcgtcacccccagtcagccactgcgcttcttcatcttctcgctgtcgcgcttctccatcttttgccgcatcaaggagaggaggcgccgctggccgctgctgcagccggtaggcggaagaaggcgccgctactacagggaggaggcgcaagggctgagtatgggaggatgtgagggcgcacgctggtggaggcgctggatgcctggatgacgacgtgcgatgtgaatggggaacgaccgaacgagtgaggagggagagagacaaagagactgggattgagaagagcctagagctctttgagcagaagacctcttggagctggcaacctcctcggtaatgaggtacgagcttcagttttttcattaaaaaaaactatgaccggtcaaagttcctttctttattgtgatattgattttcgctgaaaaaaagtttttttagatacacgtaagagtacttcacaactaatgatgatttttctttattacttatattgttgacatcaaaatcacttaaagtttcagtaaatacaaaatatttgtttgagacaaaaaaatatcgattgaaaaaaagtaaaaagtttccacgagataagccaaattagagtattcgcgctatcatccacatgtcacatgacctgtctccacgcgagtccacgtataattttgagttgacagatcgagaaagcatgcatgactactagagactatgagtaaatatgcaaaactattttcaatctgcgacactgctacatgatatattttcttggacgccacccacttttgtttccatgcggtccgtaagtagaaccgcatggaaaaagagggggacaggtgccgggctgtcgcccgcacgggaaaatacattatcccgcgtgggcgacttaagccaaccgcacacgaattttcaatagcacgggcccaccgcttttaaccgcgcccgcacacatctcctcctccgcccgctcctctcctcccacctccctctttcccactccactcatctcctcctctcctcccactctcctcttttcccctctctcccggccggccggcggtgcgacagcatgcggcggcgcgcggcccctccctccccctccctcaactgcgggtgggaagaagggctgcgagagcaggtggcagcgggcgaccatggcggcccctcccctctctccccttgcggatcctgcggaggggcggcggatccggcggcgcgcaccccctcccctccttccccttgcagatccggcggaggggggcggcggatccggcggcgcgcaacccctcccctccctccccttgcagatctggcggaggggaggcatgggggcccagtggagcggcggcatgcgtcagcggccggtgtggaggtgaggcaacggcgtcggcgaccggcggatctatctctccccctcctctctttgttatttgtgattctttgttatttgtgagatgcgttcttggagttcatttgctgctgtgagatgtgttcttgtgatgtgagagttcatttgttgatgtgagatgtgttcttgtgatgtgaaatcattgtgtgtcgatgtgcgactacagatctggtgccagtgaccagaagggaggttgtcctctgcatcggctacgatgatgatgacctcgccctcgtcgacatcacctaccccaagcgtgacgtggacaacatgcagtggttccgggaaatcacactgctataccgtggccaccgccactccgcacccttcgtcctcggcctcatcgtgctctgtggccatgcgccgcgcaacaactggtgcccataggggcgagaagggcgtgcgcggccatcctcgggacctcggcaccctgatccgctacgtcgcgatctacatcagcggctcccatgccttgtgtaccagcccgactgcaaccagtccgagtataccgtcagcgtgcttcctttccatgaggacggcggaaggatggcgcggctcctcacattcctgcgcaacaggcgcgtcacggtggcctgcgtcggtgcgcacgaggtgatggagaagctcacagaggagtgggaattggacgtggcatggccggcggagttgacggatctgttttcgttcacgtgttcggcaaggtgtccggggtaggcggcaaggtggccggggtggacgcggtgaggctgcccaaggagctggaaccggataaggaggagataaaggagagcaaacatgggggtctaggggaatttttgacaatttctcttttctcaatagccggaaattattattttaatgagcatggtgtcactagcataagggtggaaacaagccgaaccaagcctagctcgtctcggcttgcagtggctcgcaacaaactaggcttggcttagctcggctcagtcagggaaacaagctaaaacttgagctcgactcggctcgttttctggctcgagccagctcgagctgtcttgcaagccttcctgttgaaacacctcttcatatatattttgtaattattaaaaaatcaaaaataaatcattaacatgtaaaatttaaataagtttatatattcaattcttcaaaatcttaatgataaatttcaatttgacaaataataacgccacaaaaagtaaaataatcgatataaatacatgatggcctaggctcgcaagtcaaagcaagcggctcgcgagctagctcggcttggctcatttcagcaatgagctgcaaaggaggcttgggcttggcttatttggcttacgagctgagccaagccaaccaagctcgaccaagcccgagttgagctcacgagcccgagctttttttccacccctgcactagcaaatatccaacttttacatcccaaaaagttaatctgtgtagtgtcccacagctaattaaagccgtgaagtcacgatgtcctgtagcaaaatttgcctatttggttttgttacacagaggatgagttaatttctccatatcttcacaattttcagctcatgttttatgaagggagcaatatttttcaactccacacattttcttcacatatcaacgcacgggtatattcctatagttctctcatttttttaaggcttatctgcttagaaatatatatcccgcaaatataaagaagattaattgtcaagaacaacacgactcgactttgatcaaacttcaaccacccactatcatctgttatccgtgcaacgcacgggcgttgcacgggcattatgctagttaatattaaaatttaatggagttttcgccggcgagcccggactaaccgggcggtggctctgctacttggcacactcacaaacccatgatgagtgagttccctaacacacactcaaagaagagactgatagcaaatctctggttccactcacgactccaccatcaccaccggtgctttcttcttatgttgcgaagcaatatccttttcttttttcctttacagttgaatgcaagtcctttacggtcactcgcatatgcacgtcatgcatgacccgaggctgcacaagagaatgtttgtatgatttccaattttccacaatggcaaaccgatcctgctaaagctgaaagagataagtggagaggcagagggcggcttgtattttgatctcgctgaagctgaagcctgaagggatcaaacgacggaatctcgatgacttgacctactccatccgtcccaaaaaaagacaaaccctagtttccgtgaacagcgtttgaccgtccgtcttatttaaaaattatgaaaaaaattaaaaagacaagtcacgcataaaatattaatcatgttttatcatctagcaacaatgaaaatacgaattataaaaaaatttcatataagacggacagtcaaaattggacacggaaacccatggtttgcctttttttggacagaggtagtacttctcaaaagcgaaagccaccttttttgtgtgcatttcgtactaggaaaaagtacgaattacccctcgaactattgcggtcgtctgaattatccccctgaaatacaaaaccggacattcttcacccgtaactatgcaaaccggatgaattaccccctcgacccaatccacggtggttttggtctacgtggcagtccagtcagcgttttttaattaaaaaattatgggacccgcatgtcatacacttcttactctctctctattctctctcaatcttttctctctcgcacggcggggacgagcgcggggacgggcggtcggcgtgtgcggtcggcgaggcgaggcgagcgcggcggcacggacggtgcggacgtcggcgcggaggcggaggcggcgctgatggcggaggagcgtggcggcggagctgtgtggcggcggaggagcggaggcggcggagtcagttgtggcagaggcaaaggcaaggtttgtggtgagagcgtgcagcggcgtggttagcgctttggcacagcagcagggaggaaggcacgcgcaagtgcatgcatgagcaagaagaggagggaaggaggcggcggaggaaacggcggctgcgacccgccggtgaccgatgcgctatccatggacagcggcctccgcgaggtgtccctctccgtggtcttctccgtctggtgcctcctcctccttcgctcccagtgtcatggatcgatcaatgtcatgtcaccctggcgtttgattgatctcttctttgtagatttctacgacgatgtcgaggacggaatgcgtgaaaactactgcaaggtaatgccgctggaggcctacattttcccgactgagtataacgcctccgcggccgcgccgacgtgccagccatcgttgcacccgccggagccgtagcaagaaaccgaccaccggagcctggagccgttcaacaacacaaccggcagcaaatcgtccacggacgcggcgctcgatgagctcgacgagttccggagccggatcctgcagggcaaggccgcgaacggccgcatccccgacggcgcggcggcccaccggctcgagccaagcggcgcggagtacaactacgcggcggcgtccaagggcgcgccaaggtgctcgcccacaatcgcgaggccaagggcgccgccaacttcctcggcgccacgctcctccgccgcctctgccgcctcatctcctccgctgccacacagctccgccgccacgctcctccgccacctccgctcctccgccgccacacagctccgccgtctgcgccgacgtccgcgccgccgcactcgcctcacctcgctgaccgcacacgccgaccgcccgtccctgcgttcgtcctcgccgtgcgagagagaaaagagtgagagagagaatagagagagagcaagaagtgtatgacatccgggtccacaatattttaattaaaaaaaacgctaactagactgccatgtgtacgccacgtaaaccaaaaccaccgtggattgggtcgaggggggtaattcgtctggtttgcatagttataggtgaagaatgtccggttttatggttaggggggtaattcagacgaccgcgatagtttgacgggtaattcgtactttttccttcgtactgctacgtgcaaacgacaagcacatttgcgcagaaactcaaggacacaacagacacacgcgttgcattctgtttcgcagctgcttcctttctccagcttttttgtttgcagtcgatcggcttgtttcagccgtagtagtacagtgtgatttggtattatcctgcaggaatttttggagttggtggtaccaacaatagattatagtaattttactgtccttaaggaggtaccatgatataccattttttctactgtacataataacctagataggtattatgagataccaaattttacactaaatttttggtactcaaggtactttcccaggtaccgtagaattgctcaacagaaaaaggctttttcgagtggataggcataggcaggctctgatcgtttggcttcggcttatccacatggacgaataaaagaattctacatagtaaaacttttacaatgttaaaatacaaaggctatgtttagttcacgctaaaattgaaagtttggttgaaattggaacgatgtgacagaaaagttggaagtttatgtgtgtagaaaagttttgatgtaatgaaaaagttggaagtttgaagaaatattttgaaactaaacacggcgaaagtatatctgtataatttgtggtttcaaatacaatgttaaaagcaaaaacgataataaaaaactctaaaatttaatttgaagataaaactgataagccaataaacagatggtgagagtgcgactctctgaagcgtttacaggcttttgtgtgaaagttcccggaaatctcgtgttgacaaagagtcaagagccgtccaaaattctggatttgcttccgccatgtctacttctcatcctgccaataatcagccgaaagtttctcgccaatttcctacgtaatatttcctattggtcattaggaaaactaatttttatttgacccatgcttaggacaagaagactagaccggattgtactattaattaggctggtccctcatgttgatcagctcggtgattatcctgttgttaagttaggcttgtcctgtagcaactggactttgcatcccaagtcatgattctaccacacaatttagtatctgctcagatgttcatcacggcgtgccttttcaagctctaatcaacatgtaccgatgtacgagctgcacgcgtgctcaatttgttctttacctactccctcgggatgtgtcatgtccaattttaaatttattttttttaaggggagtactcaataacaaaatatgtcagattcacatttttattgttttcattaatattgctatttcggcattactagatagcgtaggatgtgtgtttgttgacggtgttaccaaattcgctaaattaagtttttaagagtggtaatttatatagaattaccaaaatttacagcaacaatacatttagtttattgttttaggccgtgtttagttgcaaaatttttctttaaacttttaactttttttatcacattgctacaatttcaaacaagtttctaattttagcgtgaactaaacacacccttaatactaaattagtagggataaaagtgatttcgaaaggaacaagcgagtctacatcactgtggctgaaatgtgagtaggaaaacgaacggtcgacgagaaaagctaagtcctgtagctaatttggctgtggtgaaaagcaccatctgtcgctctcccctttgctgctttgcacgtacgtgatgttgtcatacatattgtcgtattactagttgatcgggttgaagattctctcctgctgatatcttgtttacactggctgtcttgtacaataggcttgataaggagtctaagtttttatttttcctataactttagttatcttcaaaagaaaatttcatataaaaatataggagggtagttcattattactcccgggtacaattggtgcacggatttgtattccacctattgtggcggaggcaagaattttaccgatcagtttcatttgatacttgagtgatgataactttaaacccatataaattaaagttgatataaatggtttgaaaaagctatggggtcagctcaggggcggaatcaggcatggggcagttagggcttgagccccatgcctagctccataattcccattataatcatgaaaaatgttatgtaacttatgaaaatatttgagatctcgttagctcagccttagacgtggaaattttctggctccgccactgggtcagctaacccatgcacttctatatggatccaatcactgctcggatagtcttgctacgtgtcctcccttctgaaatgcttatgacagttgtaaaaaaaaactctgaaaagaattgatgataggaaatgttgtgggaagatacttgtattttgtcttttgttatagttatagttacagatatactaaaaatctgggaagatacttgtattttgtcttttgtttcatagtttcctcggcagcggcaaggagcactatttgtttgttcatatatattgaagagaaatgaagataaatgagatcctagcattttactctgtttcaatcataacaaagttggttaacacttaaactttgctctgtgttttgaacttttgatcactcatgagcatgagaccagttctctgctattgtttacgataatagaaggttcactaaacaatgaaaacatctgacctctgcaccaagtagttctcataggattattttcccaattaataggatgtaagggcttgtttggttatatccaattttttttggcaatggtaagatctggcaatgccaaaattttgtcacctatttggttggaaccaaaaaacggcaccgatgttaaaactagtcaatcttgccaaaaaaaaaatggtaacatttcaaacatcaaccttacaaatgacacaggatcaaacatatactgcatgataatttcaacaacccccccccccccctctctcttctctccaagataacttgcatggccttatactctctctcaatatctgagatcatatatattccgtactataacatatattgattggtatgaagaaaaccagatttgttcaaaaaaaaatcgtcacacgtcaatcactgatgagtatgagtaaaagcttaaatcagctcaggattcaggaatatgaaaataataagtgtgcatggttaatgtgtgcagcccaatcagtaccagtaggcagttgcatgtccagtccggcccacaagagggtgctggtgatcaggcagtttgttctcaagaggctttcttgttgagtttcacagcaacaagtccataaaaaagcctagctaggttgcatgctgcaacaccgcatgcaaaaccttacataagggcgtcaaatcaattactaagagttatatatatattggcacacctagctagttgatcatctacacgaagtcgatcgatcatcacacctccatattcatcaggtgtttgttcaaactccgagtacaaactaatagttaaattaatttatattattaagagctatagctggaggagctctttcccgtctcgccgccgccgccgcccatcacggtgaccttctcgcaggacgggcagacgttcaccatcgccgccgccgccgccctcgggaactggacgtagagctgcgagccggccgccgccgccgccggcgaagccagccgacgcagctccatgagctcatgcttgagctgcttgttctcctcggtcaggctctcgcagcatcgcttcaagaactcgcagtccacctcagtctgcttcagcttcgtcctgcgttttgatttaatttttcacagatgttaatcataacactaattgcagaattttgtaatctccaaactgaatgtaattaatttaattctacgaacctggctcttctattttggaaccacacttcgacctgtctcggcttcagtttcagctgacgagcgagctcgtgcttctgagcctgtcatatatgaaacaaccatgagatacgttcatcaggtagccctagaagaagcagaaactcatacggctcgatctcttgatctcagttgaccaagaaatcatcagttaatttcttactaactacatggatcatatgcatgaatcgatcgaacagttgtgttaaaatcccaaagaattagtaacagattactcgatatgatgtgcacgtaaacgtacatgagaaagaatgttgtggacgcggaagctgtcctcgagcaaggtcgactgctccttggtgagctggagcttcttcctcgtgccgccaccgccgccgccgccgctgccgccatcgccgccgtcgtcgccgaggctcagtacacgcgagcggctaccgtcgccgccgctgttcctgatggacctcatcacccttagccttgcacctctctctcccttcatgatcttgctccctgaagcttgttcttcatcacggccatgatcatatcccctcgtgatctcttccttgacatgctgggagaacaacatctgcaccggcgacggagacgacggtgacctccggcaatcgtcgccgccgtatgcgtaaccgccgccgccgatcccgagaccaagccatgaacctagatcctctccttccatgctactagagctatacatggactatatcttatgtagaagcttctattctatgtagaagaagaagaagaagaagaagaagaagaagcagctataagtttaaggtgtttgctatggagaagatgaagtgtatgtagaagaagaagaagaagctagaagcttacaaggtgtgtttgatagctatggagaagagaagaaggggtcaagaagaggagtagtgtgtttatgctagctttataggtgacaacaacaactcgatcaacaaggtcggtttcttgtgtaaattgaagaagaaaattataccgcatgcggttaattatggggatcaattaagctagcaggcgtttgcttgtgtacggaggtgaattaccgacataatttaatgtgtcatttgactgaagaggaaggcgatgaaagggatcggaaggtagccaattaagaggactagctactagctaatggtagggcggtttcttggacaccagcatcagatgctatctgttacagtatcaggagtgtgttgtgaaaccgacgacattttaattggcaatttgtgttaataacgcccgtgctaaatgcctaaatgtagtactatatgatagtaaattgctctgctttttttagagcggtcagatacaatgcacttagattggtatgaattaatttaaaaatgacaatttccatttctttagtgaggcacaagaatatttttgttcatttctagctgcaatgtaatgtgaagtgggtgcctagtggatttgtgcaagtgccgagaactcttctttagctttatattaacaagcctaattaagttgctaccatgagtttttttgcacgaagaacacattttgtactaagttgtaacaaaacatttcattgacggtctgctgactggtgttgttcatatgaagcaagtgcacggagaacgacacatttgtaatttttctaggaaggatcagtccacgttttacaaaacagagaagcatatccattatcgtctccctccagtcacagtttagcctatttaatctccattcgcaacagccaattccttttatttttctcgaggcaggagagaatgaaagacaaattaaatctatgttgtcctcaaactcttctcgcgagttttcttttttaaaaaagaagacagagaaggatggcttcaaatataaatatactctattcgtcctaaaaaattgtaatgtttaaaaaacaagttaatataaaatgaaaataatctagataactctcattaaacgggggtgcttcagaatggagatagttggggtaaggcacggtttagttctaaattttgaacccaaaaacgtcacatcgaacttttctacacacaaacttccaacatttccgttacatcgttttaatttcaattaaacttctaattttagcgtggaactaaacacaccctaagattggaaggaatttaaatgagtggtgattggagtgaaaaatagtactactccaagtctaaattgatgtagtttaagcgtaaaaagttgtcccgtaaagattgtaattttagagtgggtccactataattatttaatagtagtatcatttcatcgatcattttctcttagttttaattagaaccagaagcattcccacgtccttgctcttcctgcattaatgaagaaggtcacagtagtattttaacctcctatatatttaatctatctttaactagctaaaaatataatcttttaggaacgatgggagtactactttagaatcgtatccttttacaaactttaagtgctatagttatattctttttgtacttggatttttttcctttctactggcataaatgtatagtattatctattactctctccatccataaatatagccatttataggtttattatagattaaggttgagcacagaaaactttgttggaaggggggcaaagtgaaagaaaaaaaatgtatggttgtaggttcttttgaagtaaaaggctcgattatccattatgtaaaaaaaatgaatgagatatgattaatgatacaagtagtactttagaatcgtatattcgtaaataaattttaaacgtttgaaatgcttatatttatggacaaagtggagtataatattactaattgtgaaacttaattatgacattttaataacgtgtgttctaaatatagcacatgatggtaaaataatccagtgattttattctcgctgggtaaaagaaatgaggctagcattggccgggtgagacttacttagctaggtgtgaatttaaaaaggacatattgtccatttttttatgacgcacaagaatacttgttctgcaatatgtgcagagtggactagcggacttttgcaagtgccaatatggtccaatgggagtatgagctttatcaggcctaattaattagtgtttgcacatgattaaacactatctggcacaattgcaataacaaaaataaatcgagtgaagctcgtgtaacacaccaatttaggggtacgtgagcgcaaactactccttcaattaaatgaactaagttttacattatttaaggtgtcatggagtttttttttaattatataaaacgaatcctgtatataagagacattgcaagattttatattgtcatggaccaatcgacaccaatctctactccagttgaatctgaatcaatcctcatgcttattcctggctatatattcatgcacccaagagaccggaacaattcgcaatgcccactgcctattaatgcttagatctctcacaagcagccggtccatagggaaaaataacacctccaaagtaactggatttttcacattttgattcttttaaaaaacttatttcgcaaatagacccctaaaaaaacttttcccagaaatggtcctttttggcgccagagtggctggcgccatcgtccaacgggacgacgccagcttctctggcgccatcctcctgccaccgtggcacacgcgaaccgacgtggcaggaggagggcgccacaatggctggcaccgccctagggatgaggcatgctggcgccgcccctctccccccccaccacccctcgcctctattcctgtttctctatatagagttgcaacctttttatttttattttagtttttcggatgttttttcgcacttaggatcacgatacaaccagccacaaaaaaaaaatttaaaactcgaacggaatataccacttagctagatatgcgaaaatagcataccacttagcctactttacaccttcatcaaaattagaccataactcctttaataaaaccatttgatcagcatgttaaacataatgcactctaccactatatgaaattacttaatctctaattcaaatataaccacatgaaatgatagccataagttaaatagtacagagagatgtattttttttatttttattttatttttttgatatttttttcacacttaggagaatacaggaaccaaccatagaaaaaataaactcaaatggacaaaatatgtgactcgtagaattttccaaagctctactgaaaagtcattcgggtatcatttattaaaatagacgtaactttctcatacggactcagaatcaggcaaataatatatccacagacatctacagaaaaagttacatccgattctccccgctttgtcgggtacggcgattctaaaacctccaaattctgcttgcaagattgtgttttcgaggagagaagtttttcggtagagctttggaaaattccacatgccacatatttcgtccgtttgagtttattttttatatgattggttcttgtgagttcctaagtgtgaaaaaaatatcaaaaaaataaaataaaaataaaaaagttgcacatctctctcctctgcactagtttggagagagagaggagaggagaggaaaaattctacaggtcacatattacatccatttgaattcaattttttttatggttagttcttgtttgtccctaagcgtgaaaaaaaaatcaaacaaataaaagaaaaaaatcgggggggggggggggg

SEQ ID NO: 44005 - DNA, 4011 bp, Oryza sativa
ggggggggcgcaagccagtttggggggctccccctagccacctcaacatcgccttgccacgtcggtagggggtcgacgccagagaggctggcgccgtccagttggaccaaaatgtgaaaaatccagtccaaagtaacacgcatgataagtttctgaaagcggcacatcatgacagttccgtgtccgatgatttctgggattatccccaaaaaaaaaaaagcctaaggcccatgtatataaagaaaaggaaaaaaatcttggtaagagataagaaagtgaaaaactctcctattaatatatcatgatatatatttgatcaattctacacttctactccctccgtttcagattataagtcgttttgactttgatcaaaataaaactgattaaaatttgatcaagtttatagaaaaatagtaacatattcaacacaagacaaatatactataaaagtaaattcaattagaaatttaatgaaactaatttagcgttatagatattgatatatttatctataatcttagtcaaacttaaagcagtttgattttgacccaagtcaaaacgacttgtaatctaaaatgaagatagtactattatatatattgtttcatatatttgtggtattttagaaaaatattaagttcaatcacccatacctaaaattctagataagtcactaggtggtttgcagaattttgccatggttcatcttatttgagtctatcttgttcttgaaaaccatctcaggctttcagcaggttcagtgcatcaccaagaaaactcatgcaaggtggtctgcagagttattttccatggattattatatttcagtttcctgttcttgaaaaattgcctcatgttttcagcattttcagcaggttcagtgcatcgagaaaactcttgacgaagaacgaatttatctttatctccggcggcagatgccgcatttactgaagaaaatgcaatcagcgatggggacacgtgtgcctcatgtgcaaataatgtgtaagctaaccaaaaagaaaaacttaaaatggacagcaaattctctgataatctggccagctcggaacaaaatctaggagatgatctcaaattctcaataccacttacgccgaaaaaaaaaagtctttattttgaacgcgtaaaaactttgcacgcgaaaacaatataatattctcaataccagtataccacaatctagcttcacagcacacgactaatcagtatataacttaaacttgctttgagcttttaatctggatgccgtcgttcttacggtggagaatttggctgatatctccccatcgtttgtcaggggattatgcagtcaaaaggacgggttttgcgtatttaaagccgcttgatagccaagcttcaattcagtaaaatagtcaatccacccatcctgtcgtaataatgctggtaattagcttgaaccgttcaattacattggtctagcattgattcagttctccaattgatgatgcttgcgtttctatcttttgctagctttgtggctgttgaaccatgaacagtatctttgtacaggaggaagtagtctctgctgtagtgaactggttctgtcaaaatattctcctttttgctcaggtttttcaaagttctgaatttttttgtcggcatttctaagttaagttcacatgttgtaaatgatatgcttcggagattttaggaatcggagggaagagaatcgaagtaacaatgtactgaactagcattagtcctgatcaccatgacagggcactataaaaagatgggttaattaattaattagtggtgcaaattgatgcagctgccatgcattgaattttgcatttgtcttctcttctgaattcaactgctatggtgttttcaggtcttctcttctgaaacaacattcgcctgagctgcttccttagtcatacagttagttgcaattctctgtctgaacctgacatgcatttcttccacagattaaaattaacaggacgtgtctagtgcttcccggaagtttcagatttcgcatcaaatgtcgatgcatggtgaatttgaatttgtttcattcgatgatcgagacgtatcgctggagatgaagactgataataattaataaatctccacgtgccactaaaatctcaacaatcatagctttgcatgacaatgtcatcagtacactaagagaacagataggatcagtgttagtccggctgctgccgcgagagaggaaaagaagaacatgatgaactaatcagtgattcgatcaggccgtaattatgaacgctgccggagtcgtttctttttctagggacagttcagagaatgagagtgctgatcgatcgatttgacaatttgacaatctgacaatgacaccagtggagaatgaatcgaaaaaaactgaaaagatcgatgaacaaacagtgtatcgacgaacaggtcgcttgatcgctgggaatggacagtttcttgcgcgaggggatcgatgcttacgtgagtgcttccgaatggttggtgccccgtccttgtctcggtggcaatgatcttggactgccatgaaagatttcgcagaaagatgaggaaaatcggtaggagaacccacacacacgagcgtctctgagattcttggtttgactgtctaaagctcgtaggaagctgaagaagcacacagtttcaaaggttacagtactttttatcgtcttgccggtcatcttagttgcctgatgtgacgaacaattcaactggaacaattgtaaacgttgcaagtacaatttgtggagtggagatatatatgctcctcatcatctgagaaatctggagcagaatcgatcaaacttgacatcagccgttcaggtatcgccaaagtaagtacagcatccggttcagtttcagtgatgtcagtagccaattctgctttctgcactgcaaaagagaaaagtccactttatttttctttttgagcgggaaaaaatatctactttacgtcgtttaaatgggggtccagtttcaattacatatccctcaaccgtaaagccgaatatagtgtatccctcaactaccaaaccaatccaaatcaagtccccaaatagtactatgagcggtttcgattcatataacatcttattgacctagtcttcatcccatataatatcgtgatgatattaacatggcactaaaaaataaaaataaataaacaccgatgaacaagatattacatgggatgaagatcctgtagttcggttaacgtttaagtggaactacaaaaagttgctgtggtctagtagttgaccacagacggtcttcctgtaaggcgtactccagaaccgctaaaatgttaaccgacgagatagaggaattgaatactctggagctcctctcctttcacagctgccaataaatgagttctgctccttccatagttgccaagaaaccaagaggactaggaagtcgaagcccttacgaagatgcttcagcaggcaattcctagaagtcggccaccaaacctaaagcgtgcaaccgcgggaaggagcgaggtcaggccagccaagtgaagacagcacatggtgccaaacctgtcgaacgaacacacagtcgatgaggatgtgactcgttgtttcaaggagcgaacacaacgcgggaagaagggaatgtcagtgacatggggtttcatttttttcccctaattgtaagtacaagataggcgccacgtaggacacaactggatcaacacgccacatcagccgtcatcaaaaactaccgaggaacgtaggttctagaggttgaatgtgcttcatagttgagggatgtgactgaaactcgatacttaaggacctaaactgaacttttccactgcaaaatgcaagcgaactgggccgagagtggcgaggttgggctgggccggaggcctatgtaggatggcatgtacagtaataaaccctacatctaggggcttttccggaagggtcgctctataagtttgcaacaccccagctagggtttccatccacattccacctg

SEQ ID NO: 44006 - DNA, 1420 bp, Oryza sativa
  unsure (1)..(1420): unsure at all n locations
nnnnnnnnnnnnnnnnnnnnnnnnnnnnnnnnnnnnnnnnnnnnnnnnnnnnnnnntttggtttggtgatctgaggatggacgccggcgatgaggaagaacatggttcgctcgtctgaacggtgggttatttacccaccttgcagattttaaaagtagtctgagccgatgcaaatttcctctggattcatcgttttccttgatgagttactggctttacagttttagaccttaaaaatcctttgttttcacttatgtttctgtccagtgaaatctctccgttgggatattcagttgcagtgatgagtatctcttttttcgagagcaggtctcgatctgcttgatgagtctgggaaataatcaccttatttcctcctgagcggttacctgagcaactcttagcaccatccaaactctttggagtttccccaacacatctgacttttcttggaatacaattttttttttttgctttcttagcttcttgtttgtctcactttgctgatttaatagattaacgtttgcatataatctcaattttcaggttcattttcaactgcaaattcagaatgtacttaaaaacatcattacgcaagagacacaaactctctagaatggcacacatatcattacatcaagtttagtagaaagctacatcatatgattgaggaccaacacttaacctgcgattgcaagttgccctcaaacaagatcagggcaacgcaagcaacgaaggagatggcaaaaaacacatcccccgacaagttacaatgttcagctacagcagcatccacagatgacacttatgacagatgcatcatctgcttggcacaagacaaccataaggtcgaagaaacttgcaagagcaatgaagaacggtgtgtatggaagagagctatgattgatatgttaggaggcttgatcattcgtcggtctctctggcaggtgattctcctgctccaagaaacggacgacgaggcaggtgatgttgtctgcgcttcccctctgtgaggcctcctggaggagcttctttgcagcctgctctgaatccagaattggcttcaccatggccacagcttcctgggatcacacgagaatacatgttattgcttcatttttttcacaagagaacacatgttattacttgcatttcatataggagattttgagaaattaaaaatacatttcagataggagatttggagattgaaaaaacatgtcattagtactttattactggcttcagacttcagagttcagaaacatgcatttcagagaggagatttggataaattaaaatgattcagagatcagaaacatgcatttcagaaagatatttggagaaattaaaatgatnnnnnnnnnnnnnnnnnnnnnnnnnnnnnnnnnnnnnnnnnnnnnnnnnnnnnnnnnnnnnnnnn

SEQ ID NO: 44007 - DNA, 8718 bp, Oryza sativa
  unsure (1)..(8718): unsure at all n locations
nnnnnnnnnnnnnnnnnnnnnnnnnnnnnnnnnnnnnnnnnnnnnnnnnnnnnnnnnnnnnntgtacagatcaaataagcagataaatgtcgaatttcgatttgcaacagtacataacgtaatatggtcgtatcctgaaatcgttcatggcctctatgcatatactttctttatgagctgcatgaattatgaatttgagattggaagaaacttgaggaccttgatctctggatcagcaaccacatattgcttcaggagtttgtcaccaaatgctcgagagacagcaagaacaccacccacgcgccatgttcctacaaaatttccgccaacagaattttagcatttttatagattaaggacttggtgttcaatgtcgaaaaaaagggtaaatgtagcatcagcacaatgaatagatcaagagttgaaataccagcccacatcacaaaaccaccagcatcctctatcctctgcctctcgtctgactgatcaggcttgtggtctcttgacacagctatagctgcatcatcaagatgaaataatgcatcacaaaactgaggtttcaatcattttagaagcaaattgtaataggtaatatagagttgctcggttgacacaacgaacattcatgatacagaccaggacaggacattggttgaaaaacatgtacaggtgaagcacttacgctatctgcccaacaatcagtaaagtaaacatgaattgaaatgttcttaatcttaccatctcctcctctacaaatgacagccctagaatctccaacatttgcaacgagcagacggtcgcctacgagaattgcagtggaggcagtcgaccctgcatctcgattgtggctggtttcagctttcagaagttcagagtccgtgctagtgtaagtttcagctgcaggacagaatgttcagggaattaaacatccaaagtgcaaacaaaatttttgggtgaagtagtttgctttagagaaaatagacacagataaatagcacaataccaattgcagacttggtatcactgaataactttgggtgcttgattaaattggtgaagaggttctgcttgacgaattctgctgctcgagctccaccatgacctgcagaaaacaaaccacgtagtattacgatcagtaatcactgaataagcaggtgacgatatttatttaagtcaacacaaaacactaattgcatcatgaaaaagcatcagattaccatcaaagacaccaaacagtccaacggtctctccatcgacaccatcaattctggtgtcatagaagtcctccatggaggatctttttccaggagagctcgcataaccatagctaaatttaccatttgcactgtcatgataacacaagaagaacaacaatatcaggtaataataacagaaacgaattctctgtcaatggctatatacagatattcgaaactaacactcccaatccaaaatgaaaaatcacccatctaataaataaaaacccccatcgtttggcttttttcataataagccaaaacggcttattaggaaataaaaataaatttgtaggtaaaacttttatatatgcgttctgggtgatttaaaaaccaatgttgttaaagaaactacgttgaaaatatctcaaaatcaatcttaaaattaagtttaaaaattttaaatttggcttattcgttggctgttcggcccccaacttgcttaaaacggatcaaacgaaaacgaaatcagaaagagagatgaagcgaaacggaatacctgaacccgccgccactgccaggcgagccagcggcctctccggcgagccccatcaagcgcacctcgccgtcgtcctcctcctcctccgctccctgcgagagacaggagcagcacgggaacagcgacaacaaggcgagaaccaccaacgagccgaggaggagcacctcacgcatgcacgcgaacgacggaggaggaagaagaagaggatggcgatcgatccggggaacgcggagctcgctcgtgtcccccctccccccctataatggaggaccggacgcgcgcgcgcgccgggcgtcacgtggcgccacgccgtgcgcgccacgcccgcgcccatggttggttttggtcttgtggttctcctcctcctcctcctgctgctgctgagcacggacgaacacctcgtcgtgggagacgaggaaatgggaggtgacctccacgtggcgcgagggcgacccgaccggagctcgcgcggggcgacacgtcgtcgccgtggacgacggtttggcgccttctttcgcggtacacgtcatggtggcgagatgcatcgaacaaactccgtactattcaactgtttgatgctttccaccgtccagatgttgcaaattaagtgcttcatatgctctttattttttagaaatttaataatttagcaattgtttttgttaatttacttgaacggatactaatgaagatgatactacgtaagatcatctaaatgcataaaagtgaattaggatatcagataatcgagacctaatttaaaagtacaaaatagggtcggatcaaatacttccaacgtgttgaaacatctggaaacgtgttgaaagttcacgaatcgaacccaacgcgttcgtactcgccaccgactcagaagtcggaaattaaactactccttgtatagaaaaatcgaaaggcttttcagattcaatcatcaaaccaaacctgttcgatcgacttcgccccggttcgaagttcgcccgccatggccgccgtgtcgtgccggtgcagcagcgtggtgttcgtcggcaacgtctcgtaccgggccaccgaggcggagctccgcgacgcgtgcgaggagatcggccccgtcgagtcgctccgcctcgccgtcgacgaggacgccggcaaccggcggaggggcttcgcgttcgtcgagtacctcgacgacgagaccgcccgcagcgcgtgccgcaacctcgaccgccgcgccctccgcggccgcgcgctccgcgtcgacctcgccgacctgggctgcggcggcggcgggggcgagacggactagccagtgggcgtcgaggacgccacgcacgcggcgtcgctcgtcaacggcgcgccacccagcgccgccgtcacggcgtacctcgccgggctgaaccggcggcagctgcgcgagacggtggacgcggtggaggcgcagggggacgccgccgtggaggagatgaagcgggcgtacgcggggctcgccacgctgctcgagcaggcaaggatactgctcgacatggccgacgccgacgccgccgccgcggcggcgaagcgcaagaagcgcggcgcgagggatcaccaccacggccgtgaggcccagcttgcgtcaaagctgaggaagctgaacgatggcaagcccagcacatccatggcgtttgtactgtagctagtcgttcacaacccaatcgcagcccatgggccggtttcagctgggccggcccaagcacagagaatttcaccggcatcctgcacaacgagatggcacggccgagatgactaccgatagagtaaaacgtgctcggttaaacacgattcgccatttcgcccccacgtcggcccgcagatcgtacgaggtctctccacgacacacatttgcattagccactgcacacaaaaccatatgtgcacagcaaaaagatcaactggaggcaatgggtggattttgccgacatgtgggcgtttattttccttggacaagatcagtgctttccacggtagcagatctagatccacaggtataatgcatttgcatatggtcacaacaatgtcaggtctttatgaaacacgcgcctctgcaagactgcaacatacagccttcacaaacgtacaacctgcgtttaatttcggccttaagccacagaatgttaacgattctatctaccaactgtaactgcatatagccacattcatgactgataagataatttcagataaaagtagtagatgaaatttgagctatttaatcatgtattaagttaaaaaagttgaaatatcttatagtatatgaaatggaagtagtataggagtccgcataacattgtgataggaatagacaaaggtaaaattgctcaagacttcaaacctactcccaaaataagcaaacgtaaaataagatggaaaataacctagtataaagaatctggatatggctatatcttatcatattttaggtttctttattttggaaaaaaaaagttttgggctcatttgaattgcaggaacgaaaaaaaataaagcaatagaaaaaacatatggttctgacagaaatgcaagtgtaaaactataattataaaatacaaaaaaaaacatatgaataactattaaaattacataaatttgagaagagataaagacttaaaggaaacttcccataagattctacctcttaaatttcctccaaaacttacatgaaatgagacattttatagaatttcttagaatttaatgttttgattcggagggctatataagaaaaaagtcttataggaataaattctctaaaatttctatgattttcctttaaatcaaaggggtctaaatgtcccattctattttaacatgggatggagggactaagggtccctttgaatcgcatgaatggaaaaacggaggaatagaaaaaacgtaggattttgacaggaatgcaagtgtaaaacagaggattgaaaaatacaggaaaaacacagaaataaccgtttgattggaccacaagaaaaacgcaggaatcggatgagagagatagactcaaaggaatttttccaagaggttggacctcttgttaactttcctccaaaatctctataggattagtcattctataggaacttttaaggatagtattggatccaatcctttatttcaaaggctttcataggaatttttttaataggattaaaatccttcaaatttcctacactttcctaccaatcaaaggggccctaaagttcaaaagtctatgaatcgcatatgaactgacaccgaaatgcactactcgcaaagaagtgcatttgtgtgtcatcttttcagtactgtacagtgtacacattgcatgtctagtgaccagtgacacgggtgtgacagggaaggggggcctgattgtctggatcttggtgtcctctctctgacactccgatattcatcttcaattaaatttaggtctctcaccaaaattttagtctctgagaggactaaagtttagtccctcccacccaaacatcaccttaaatcgtgtaactaaagattaagggactatttagtttacgaacaaaaacttttggcgtgtcatattggatatacgaacacacatttaaagtattaaacatggattaataacaaaacaaattgcagattccgtcttaaaattgcgagacgaatttattaagcctaattaatccgtcattagtaaatatttactgtagtaccacattgtcaaatcatggcgtaattaggcttaaaagattcgtctcgcaatttacacgcaatttgtgtaattggttttttttaatctatatttaatatcctatatatatgtccaaatatttaacgtgacggagtgaaaaactttttgtttcgaaactaaggctgtgtttagttggatccaaagtttggattttgattgaaattggagatgatgtgactgaaaagttttgtgtgtatgacagattgatgtgatggaaaaggacggaagtttggatctaaacacagtctaaacaggctctaaagaacgtgacgtgcagacgagaggaacacactcccatgccggatctctgccactgtcctctgcaatctaggaggagtaacttttgatgacaagacgacgtgcctgcaaaggtgtcacgtcctgagctctttgcagagtcaggatatgccttccttgcctcatcaggtttccgtgctcaaacttccaaagctgcccactttgaagtttgaaaaagaagcaagaaacagagaaaagaacagcatgcaaagaatggccgtgtgcctttttttcctgcattgtggacggaagaacaggtcgcaattttctgcctcgtttgttcagtaccaagaacacagatatatgtgcagttattcagttgattctgacggtaggtgggaatagaaattgtactacctgaaacctgatcgttcgtcttattttattttttttaaaaaaatataaagaataagtcacgcatcatattttataatctaataacaataaaaatactaattataaaaaaaaattaaataagacggatgatcaaagttaggtagagaacttatggctgcacttattttgggacagaggggagtagtacgatttggttttgcagaactttttgtagtagtactaaaacacagaagtcagaaacaggcaacattctgtttctgttgaacgggtttcgcttgattggacatgatggcagaaaagatgatggagcactcaagagagaagctgcattctgctgcaattgaagagaagaatggcatcataattacgaataatatactattctcatcgatcaggtttcagttctgatcacagcttaatcagtgacttgcacattatgatcaagggagtattcgccgcttccccattttatgtgccccggcctttctcctccggctagttcgatctcaatcccctctttctccatccaaagatctctcttccttcgcatctattttcctgaaaagaatgaattcaaaatgttactatttgtttcctgcaccattcaaacattcaatattacagaacaaggttcaagttctcaaaaaaaaaaaaaaaacaaggttcaagttctgaacttctgatgcattataacagttccacatggcgcaaaggtaaatgacaagcatccaagcatgtaattgaaacaatgaataaagttactaaataatgagttatgatccataatctcagttacattgttcagagtgaatttatccattcaacggacgaagactaatgggcagcagtactctatacgacgatacaaagacctaacaatttctcaagacaggactgattgtgtatatagaggttctgaccattcttatactaccagagagaagtatttaggttgtgcttgcaaaaaaggactctgaagatgaccacacaactgaatgtactataagaatctcctagaaaaaagaatgtactacaaggcatacatgttccgttgtctaaatgaatatatcttcagccaacaatggaaaagtgattacgatagctcactaagaaataaaagaaatggatcacagcaagggttgcaattaaaccacaggatgaaggtacattgtttgataggtcaccattatgatggcctcaatgtcacttgaacaacttctacaagcatgagtgcatcaagctagaaagaaagtatgatcagcaaaacacctaaatggcatactgatcatatgtgtagtaaacacttatgtaaagcacacatgtcagtgttccccccaaagcaactaaacaactaaccatgcaagtaaaggaacaatgaaggcaatcttgccgaacaaaggatttaaacacaccaccaaccgctcagtccatgacaatgaaaacaatatgctttccctaagctacagatcatggccaatgtggaccacaattgggtacacctgcgacaactagtacgcgataaacaggtaaagttagcagaagttacagtgctaggcagttgtaagcatattgcaagtgcacacctcctgaattactacacccttttcagtaccaaaactggccattgtgtggagattatctaacttttactgttcacaccattgtcctttccattctcccggcctagcaaagacattccacccccacattcagttatgaaattaacagtagagcatgttctgctatgttctacacttcctattctaaatgacatgagacacagggtgaattgcaactaggtgctgttctgtactcccccgtcccaatacgtaagggatttacccggcaaaaaaatatataagggattttgagtggatttgacacatcctagtattatgaatatgaacagagagcacgtccaaatttgtagtactaggatatgtcacgtccatccaaaatctcttatattttgggacgaagggagtacgaggcattagcagttgcacggaagtggcaagcaagggccaaccactgcagatcctgaactcctagaagaaagatggggccgtacgcgtgccaaattaacaaccaaagcacacacatataccaagatgcatgagattaatgtggacattgattagtactgtcatcagatatcgcaatcttggacctcgatagaaaaaagggtcaagaaaaacgcctcttgtttttgtcataggacgtactactaattaaccaacagcatcagatccctagagcagacttacacagaagcaatgacaaaacagcaatggtccctgtcatcccaacatcagattaattgcttttcggactaacacacatcagatcagtttatttattatcaaataattaaacaagattaggaaatctcaacactttgacaagaaaaatatccccaccgcaaacagcacatcaacacattactctcaaggagacgagacgaaaatgcgttgagacttgaaacagtacagaacatcactgtcattttcccttgtaagactcaatgtcacaannnnnnnnnnnnnnnnnnnnnnnnnnnnnnnnnnnnnnnnnnnnnnnnnnnnnnn

SEQ ID NO: 44008 - DNA, 1330 bp, Oryza sativa
cagatatcgcaatcttggacctcgatagaaaaaagggtcaagaaaaacgcctcttgtttttgtcataggacgtactactaattaaccaacagcatcagatccctagagcagacttacacagaagcaatgacaaaacagcaatggtccctgtcatcccaacatcagattaattgcttttcggactaacacacatcagatcagtttatttattatcaaataattaaacaagattaggaaatctcaacactttgacaagaaaaatatccccaccgcaaacagcacatcaacacattactctcaaggagacgagacgaaaatgcgttgagacttgaaacagtacagaacatcactgtcattttcccttgtaagactcaatgtcactaaaaaacaatcgactccacccgaataaatcacttgctagaattttgtaacccggataatcaagaactagttgctcaaaggtagcatgtgctacggtgcatcttttattacgctactgtaagtttataccaacaggttcatgctttttaatcaataacagtgattaaacagtggcattgcgaatccgaattgcgaaacagtattagcactggtatgaaaaagaatggctgagggagaagaattgagccctaacctcctcctccgctcccgcgttcctggcagctcatcgacctcccgaccttgccggcggcgcgttcttggtggcggctatcgttggccaccttcgccgagtgaaccctgaatccggcgccagccctgccggcgtcggggaccacatcgtcgggcgccgtctcgacatacttggcggcgcccatctccatctgcgcgatgcgcacggcgccgaagagcctctcggggagctcctcctcggactgggactcgacgaggaaccccatgtcgatggtgacggaggtgaccgcgccgagcgcgaggtggaggatggcgctggcgatggcggagctgccgatgtcgacgtcgatctcgaggtagccgtccccgccgtggtagcggcaggtgagcgcgcggccgaggaggcaggcggcgtagttgccgacggtggcgcgcaccagccacgggcccttcacgatccggttcacgatcttgaaccgcgcgttccggtacgcgtcgtcgccgtggacgaaccgccccagcagcgactccgccgggatcgccgcctccgccgcgaagtagaacaccgcgctgtacgcgtccggccgccccggcacctgcacacgaaccgaaccaagagattgattgtcacaaacaattcgatcggcgtcgacgcgcagatgcgatcgatcgggggggggggggggggggaacggacctg

SEQ ID NO: 44009 - DNA, 8972 bp, Oryza sativa
  unsure (1)..(8972): unsure at all n locations
gcggcggaaggcggcggcgacggggatgtcgtcgcgggcgaaggacgtggtcgaggcgggagtggctccttaaccagtcgacgccggcggggcggaggagccactcggcggcggagggcgccttcccgcgcctcccacccccaccaccgccaccgccgccgccgccgccgccggaaaagtaccccctcgcgcgcaggtggaacaaatcccccggcggcgaggcccacccattggcgcccctctccaggtccacctgcctcagcgatgcgcccgacaccgcctcctccctccacccctgctgctgctgctcctccgcctgctccctcctggggctcatcgccgccggcgaggggagagccaataaaagaaaaaccaaaaaagaaaaaaaaaggaagggatttttggttgggggaggagagcaggtgggttcggtgtttttgcgcgaatggagggaggagttgggggtcgctgcttcttcttccagctctacctataaaacagtgggaaagaaaaggaaaaaggaatttttgatgcgtgattcgtagaggaaccaaaataaaggtctcgcctttgctttgaagcacctctccccctccctaatttgcacttctcttgttgattatcttgatgtttctatttttttttctcgaaacacgggacaaacgcggatgctagaatacatacgtgtacagtcatctacagattgatggatcatcgtgaggttttttcttccttccgaaacatgagacaagcatggatcgcgaatgctaagagggtgtttgggtgaaagtttagtccctctcacccagacaccccctaatatatatacgtgtacactcatttgtagattgatcgatcatcgtgaggttttttcttccttcccaaacatgagacaagcatggatgctagtatacatacgtgtacactcgtatctagatttatcatcgcaatgttttattttcgaatgcggttactcgaatatttatgtagttatgtacatactcatctccataaatataatatgagcaaaaagaaaaaaaaactcttgtctttgcatttaagcatctctcgtcctccctaatttgcccttctttcgttgaatatcatgactttttttcgaaacacaagataaaagcggatgctaatatatatacttgtacacttttctatagattgctgactatgattttttttctcaaaacacgggacaaacgtggatgctagtatacatatgtgtacagtacactcatgtagatttatcaccacgatgtttctttttcttctcagaacatgcggacgcggatgctcatatatatacgtgtacacatctctataaacataacatacgcaaaggaaaaagcccttacctttgcgtttaagcatctctcgtccttcctaaattgcacttatcatgatgtttttttcgaaacacgggacaaacacagatgtccaatgtgatatttttttccctaaacacacgacaaacgtggacgctagtataccaatgtgtaacccaccctcccctcccccactcccagtatacacatgtgtacacatctctataaaacgtaacacgcgtaaaaaaaagctctcacctctacgtttaagcatttctcctcctctctaatttgcgcttccgtgttgattaccatgatggttttttttcaaaacatgggatagacaaggatgctggtatatatacgcgtacacttatcttcataaacttaacaagtagattctattcatttgatcacctccaaaaaaaaaatggactattgacgaagtaccttggtgtgttagcattgtttttcttcaactagtaattaccaattataatgcgtgatacacgttgcactatccatgaaatttatcataatttttagataatccgtatgtaacaatttatgatgatcacaaacacggttaacgttttcgactaacaaagaccaaaaaaccccatgaaatatagaggtttcgatgcagtacaaaagcagattctatgaaattcggaatggttttcaataattcaaatttaagacagtaaaatcagccaaaatttgattaaaatttagtgaaatttaacaaaaaaaaactgtcatgtcgctatggtcgatcggaatccggcactcaatcagaagggtaaaccataatccgtgagcgtataagaaaaccggcgaggagtcgtaggaagaaacaacagacgagtaagcgatagatagttggatctcgaatttgcgttgctgccttcgtgggaacgaacggtcgccacgccttcgcctgcgtacgtgcttgtcctgtccggcgacggcgacggcggcggcggtggcgaggatccacgtacgctgacatgtggggacacacggcggcgccgtacgccggcgcgtggactcgcgacacgtgtacatgcgacggaacagttgaggggttggatctgaatcatctgatctgatcacgagatgcgatcgtgcgatgcgccaccgacaagattcgggggggtcgtagtgcctcttatcgcatcgaccgtccagtctccatccgacggtccgaaagtaggacacgtcgaacaatgcatatacatactgtacatgattacgcctacgtgtgtcagcaacagtatttttctttataattacacaatgcaacttagacactcccaacgtatgggcactcacccctatgaacacacgcacacaaaccctacccagagcatcttcgaagactgcctaccactgaaagcacaatgccgataaatccgcgaagattgcctaccactgaaagcacaacgccgataaatcctgaaaaattcgctcccatatagagtcgaacctaagatctaaggtgctactgagtttcttgtaaccattaggctataggccctttcgcgtgtcagcaacagtattatggctgaaggagccgcaagcactcaccaattgtacatgcatggccgtttgcttggcaaatacagaatcacatgatacatcaatttttcaacttgcacgagataaaaagtgactgcttaattgggcatgcaaattttcaacgcaactatgcacatcatttgtactgttgtacaatacttgcgcaatggactgacaactgatggaagtatatataatcgaaactggaagtactccttcctccatttcagaatgtaagactttctagcattatctatattcatgtagatgttaatgaatctaaacacatgtatatgcttagattcattaatattcatatgaatataagcaatgctagaaagtcttactttaagaaacggatggagtacttaagagtgcttagcaatctttaccttttcattcctgttttattaaaaaccgaccaaaaaggtaaaacccgataactttcgataaacgtcatataaaaaccgactaatatcgatcggttttcatatattgagatctaatcggtttagtgaaccctcatactatgtatagctactaataataaggtagcagttggcagttgtgagtcgtctctgctacttcttcagttagcgtcaagatgtgaggccagatcaagatggcagtttaaagcatccacagctagctaagctccatggtcgacggagtaaggctacagtacacaaacatgtggatatcggtttataataatcttgcgacgaaattagtagtatatcgagactcgtgtctgttgaatctatccattatcaaacaccagtggccggcgtgttgtgtccatgtgcaacaacagtataaattatacctcctggcactgacaatctcctcttaaactttcccattctttgacaaaatattgaaatgagagctgaccgatttatgaagaagaagcagggcctgtttggcagctcaagctccagcttcatcctttctggagctgaagctcagccaaacagttttagctccaccaaaactgagagtagagctgggtgaagttctctcacaaaataaactagagttgtggagttgggtttaggcagctctataactccactccagacccaactcctagagctaatttagaagttggagctgtaccaaacaggcccgcaatctactcctatctctgttcttgccttgatccatcctctttaaccaactttgtgaatactgaacaattcagtctgaaagttacaatacccttgaatactactccctccatcccaaaaaagacaaaccatgggtttccgtgtccaacttttgaccgtccgttttatttgaaaaaattatgaaaaaaattaaaaagacaagtcacgcataaagtattaatcatgttttatcatctaacaacaatgaaaatactaatttaaaaaaaagttcatataagacgaacagtcaaatgttggacacggaaacccaggatttgtcttcttttttttggatggagggagtactttgaacgaaatgcatgcctctgaatattattattaaagtaaatttcagaaaatcctatattttatggtcataatgcatgaagtattaagcataaatttgatcataaaacatggagtagtattaagcataacttagaaatgcctagctaacaagttgcagttggttaggctgccaaatgattggccaatcgagccaatgcaactgcaagcagcggccagaattatgcgatcgatcggcgagcacatgcacacccacttgcagtgcagctagcaaaacattggacagcgcatttatgcatgcacaccggccggcgcggttggattcaaactcaaacatggcaaaaacatctttgaataatccacggagaaacaaatgttcagtcagtctttgcattggaatgctagccatcggcagccagttgcctctttctttctatcagctacaactactcttttttatcttaaaatataataatttacaacattctaataataaaatactataacttcttctcctcgtaatcgggattgcctacacatttgtcgggtgatttttaacaagaaatcacccatattttttttacacttagatttatatccaacggactacaaaataaaataactaatacaaatttacttattcaatatttttatcaaaattatagtgcacttacatatcatatcaactaaatttacatatgtaattttagttatataggactgtaattttatattttaaatacttacatgtcatatctactgaatttacaaatgtaattttagttatataggactgtaattttatattttaaagaaaataacaaatacatatttacttacactttatttttataaaaattacagtgcacttacatgtcatatcaactgaatttacaaatgtaattttagttatataggactgtaattctatattttaaagaaaataacaaatacatatttacttacactttatttttatcaaaattacagtgcacttgcatatcatatcaactgaatttacaaatgtaattttagttatatatgtctgtaattttagttacatataagttacagtgtaattacactataattatattgtaattacatctgtcaaatttctaaaaaaaaattatcggcaaatataaaaaaattgaatagaacaggtttctagagatggtagatttgttgggcatggccgcatggtggtgtaatctagaaggtcgtcccgtccggcgatcgtctccactcctcatgcccaaagggacgagcacagtgcgaacaagatcatcccgaccggctgaccacgcatgcagcctccaccatcgtgcggtcagcaaatccgtgaaatcaccgggaaaaaatcacacgacagatttctagcgaaatcgaaagtgaaatgtacaataccccatgagaatcatgcatgttctaaaatataacttctcctcccgctagtaatatttaactattcaaactcttcacatactttctcatctcaaccaatcataacattatcataaaattttaccatttcttaaaaacattatcataacaatttaccatatttttagaaaactaaaagggaaataataccccatgagaattgggggttcaaaattacagaacaaaatcagttctatcgccccccccccctcctgatacaatattatttcgtctgagatttttttaatttggtaatatttgttcaaatttgtttgaattttgtttaaaaaaaatcaaataactgtggaccaaaataatcaaaatttcagccatattgttacccctgatacaaatggctaaaataattaaataaagatcgaaccttgaaaatcatgctagggtcagcattcgaatccaggtgggctcgacgaacaccctcgcaccacgctagagctatgctcagttgtcaacaatttactatttaattttacttattttcttaatactcttatctaattttaaaatctctttggacggaagagattagctagctttcttctttctcctgctgctgctgatgcatatactgtcatatactgtatgagcttgttttattcgctaatgcgtttgcttaagccaatcgttagacagagagacagcagccaagtggacagaaaaacagcagcagcagcacacgcatgcgtgatcacctggctgtattctctcctctctcctctgcgctggtcgcagttgttgccagcagggagttcagatgattgttttgatctgaataattcagatttcaggctggtcttaaacattttggagatgggaagtttacaggaaatctttgctgctgctctcttctggatgatttgtccacttgtcagaagtgaagcaacatctagcttgaagcataagcgcaggaaaacaaatctgaaagacctaattagctgtaattgtaaggcataataacttcgaaaaggtaaatcgtaaagagacagtaagcaatggcttaacagatacccattctatggatgtcatcttcagtttattcccaaggaacaaagtatgtgcatctcatattcttatgccattatgtgctcatctttactttctttttcaagtatatggccccatctttccgttcaagaaaaatctgaaaatgtttatggcctcgtctgctgaaacaggagttgaacaagagtggccgaaaaccgaggcagtgaggaagcacatgggcttgtacgaatgtacaaccagactatgtttcatttaggcctgattgctaagcccatttatttaaattggattatttctgggccttctggtggagcacatgggcttgtacaattgtccaacacaagtttagactagattagtaggatgcctttattcatccttcttttttttttctgtaactgtcgctcgaataaagtcatttatcaactttgctggaagagtggaagattagcagtaatcagtgtagtggagtaagttctttctgtgttgtctcgtgatctgatataacatgctgaccacttgtaaacattgtaagtttgttacacactggcacaactcaggatcgatcattacaaggcagtacttttttttaaaataataataataataatctttgagcaacacaagccactgaaatcaggacaaccaagtgttgagactataggtaaacttctggttctattgtcaagccaacctcattaattagctgcctaacttttcatctttcctaatcttggtcatagtcaaacatgcacggaaattttttttttcttatcttaatcgtaatagtcaagcatgcacggacagcctcgtaaagaagattacacaagtgcaggtataaatttaacttgaaggatcatgttgatccattcaggcagtagcagcagctaaccaaccaaacaatgctgattcactgaagagtcaaggagatgggcaatttttcctctgttaggagcaactgatcaggacgagctaaactgatatctcatcacaagctacatgcatcaaaatccacttccttatcaatcgccacaatttcatgcataatcttgtaactacttcagggctcttcaattctttcagagatcagtaccaattgattaccaaatgatagtatgagccgcaaaagtggttgggaaaacactgcacttttgcgtctctgcattgcctgaagtttagcaaagctgttgaggcatgcgtatgcattgatcaacagaaagatcacaatgctggctagtgttatgattttcacaagtcaaacagaagaagttttgtgttcagctactctgaatttgagttttgttttttctgcatctactgttgttaagatctctgaaactcacgaatggtcgagattttcagggccgatttgtctcattagccgacgaaataaagtactactcccaaatgctttgatgatcccaaatgctgtccgattcaattgaaaagcctgatgaagtagtggggggagtttccatgttcttttctgtcataccagtgacctgctaccgaagtacatgcttgtgacatttcttggactatctgtacaccgatatactatccccagtctgtttgatcattctgcattacacagatatcccatcatgtgaaaaagaactatcttaatttacaccgctagtgatttctcttgggtgtaatcatatattcatatttgagagtaagaatgtctgaattcagaatttgaaatgtcgaaaagatgaaattttgagggagaaatgggttgaaatataggtgtgtgagggctctcccttttgagttgatcagaggtgtttcagtgtttgtcactaccggtatcttattttaaatcgctaatcgtttctcttggggacaacatatttatcactgcattcgagagtaagaacgcttgaattcagaattcgaaacctccaaaagatgagattttgagggagaaatggctctaaaatgtgagcatctgaggctttcactttctcttgagttgatcagaggtgtttgtcagtaccggtggtttggatggcaaaacacggccaggaccagggctacgtccatatcgcatcannnnnnnnnnnnnnnnnnnnnnnnnnnnnnnnnnnnnnnnnnnnnnnnnnnnnnn

SEQ ID NO: 44010 - DNA, 3317 bp, Oryza sativa
ccacccttttccaacctaaacctctcctcctcctccccctcctcgccgccgcctctcttcccatctcccctcacctactactacctctccatgtcgccggataactagcgtcccaaccagcctcgccggcgaggaggaaggtggtgtctcgcattcttcttcgggggatgggggtgggggaggaggagggacgcgggatggcgagcctgctggcggcgaggcgggcgctgcgggccggggtggagaggtcgcgggcgctcagccacgcgctggcgcgggcggggcccaggctcggggagatccgggcgaggctcccgccgatggaggcggccgtgcgcccgatccgcgccccgcgggacgcgctcgagggcgccggggagtgcgtcgaccgcgccgtggggcctgccgccgccgtgctcaaggtgttcgacgccgtgcacggcctcgagccgccgctcctagccgcctcagccgccgccgacgacctccccggatacctcgccgtgctgtcccgcctcgaggaggcgctccacttcctctccgacaactgcggcatcgcctcccagtggctcgctgacatcgtcgagtacctcggggaccgcagcctcgccgacccccgcttcgtctccgacctcgccgaggcgctctcccacctcaagaccccctccgcgaacctagacggcggcctcctcgccgctgcactggacattcttgaggccgagttccgtcgcctcctcaccgaacactcagctccgctcgccatgaaagaacccaacaacagctccgaccctggctccatcacgccgccgcggatccccgcctccgccgtgcacaagctgagcttgatccttgaccggctcgccgctaatgggcggctcggcacctgcacggctgcctacgccgatgctcgtggagacacggtgagcgccagccttcgagcgctcggccttgattacttgcacgacccagctgaggatgctcaggttctcaccccaaacgtcgagcattgggggcggcatctggagttcgccgtgcgccacctcctagaggcggagcggaagctctgcgtcgctgtgtttgaacggcggcctgaagccgcatcctcatgcttcgccgagattgcgtcgcgtgctggcatccttgattttctcaagtttggccgtgctatatgtgatgccaggaaggatcccatcaagctcttgcggttgctcgatgtgtttgattctttgagcaagctgagaatggacttcaaccggttgtttggtggaaaggcatgtgtcgagatccaaacccgaaccagggagcttgtcaagagggtggtggatggttccgtggagatatttgaggaattgctcgtgcaggtagagctgcagcgcaatatgccgcctccagctgatggcggagtgccacgcatagttagctttgttgccaagtactgcaatcagctccttggggacccgtatcgctctgtgctcacgcaggtgctcgtcatccatcgcagctggcgcaaggaaaccttcaatgacaagatgcttgttgatgcagtgcttaatattgtcaaggcccttgaggccaactttgaagcatggtcaaaagcgtatgaggatgtgacactgtcgtatctcttcatgatgaacacgcactggcacttcttcaagcacctgaaaggtaccaagatgggtgagatcttaggtgatgaatggctccgggagcatgaacagtacaaggattactactcagcagtgtttttgagggagagctggggaacacttgcaccgctgttgagcagggagggtataatcttgttctccaaaggccgggctacagcaagagatttagtgaagcagcgacttaaatcgttcaatgcaaactttgatgagatgtatcagaagcaatctgcgtggatcatatcagatagggatttgcaacagaagacctgccaccttgtggtgcaggctatagtgcctgtataccggagcttcatgcaaaactatgggccgcttgtcgatcagcaggatgccagtgcaaacaagtatgtgaagttcactgctgaaggtctagataagatgctcagcacactcttcttgcccaagccaaggagagctggaagcttccagatcagacactcaaatggcaagattacgagcgcaatgacagggttgtatcgaagctcttccacactgaagtagcttcagttgaagttcagggatattggatgtacaatttgtgcaataccattaaagatcccggttggccgggagacataattatggcccagtgacaagaacaaccggatcataacaagaactaagcttctccagtactgacaagtggcgaggagaacatgagtgactcgctttgcatatctgtgcagtctcctccacccaagttgtttctgtcgcctctgttattatctctagcagtatactcgattcattttaggaactttgtgtgggaaacagaagatgtgtaaccacttacctggtatgtgtaaaagattggttgtatttcaggggggtatttagttgttccacattctataagttttaattttatcaccatgcaatgaaatataaggaaagtacaatattacctctgttgatcaaaatgattgtggctaattgattactgattatatgaggcagtaataaacctctcaaatttctatttgtagacatgttcttgcatcttatatccataattttgtactgcagtaatgcagtttacctttaggattccccatgttcagctgtatacagaaagcttgtgtagtcctgtgaggcagtctctgtatatcgcagtgtgtgtaagttcacttctgtagttctggagatctgtatgttccagttattccccttgatacaggtcctggattactggctacagtacctcgatgaacagaaaggcaagaatgtttactagtaacaatttacctggtgggaagtccatgtcagatatgttcggaacttgaaagtctggaacggaaatattggcgtgagcaccttgttgagatgtcggaagcactggtaaactgagatatttttcaggagtttcctgcagctccatgcaaggcagcaggaagaacatgagggtgaacacccaaaacctggcattccaggttctgttgttctgcatgcggcagttccacaaagaatgttcaggtactgccggcttatcccagcagatatgccatcagattaccactggtttattctgatgcctcaacagaaagctcgctgaacctggtatagcctacctgtatgtaccacatatatccttgctaggagtacttggaaatattggcacaagtacaacgg

SEQ ID NO: 44011 - DNA, 8445 bp, Oryza sativa
  unsure (1)..(8445): unsure at all n locations
nnnnnnnnnnnnnnnnnnnnnnnnnnnnnnnnnnnnnnnnnnnnnnnnnnnnnnnnnnnnnnnnnnncacaggagcttaagacgtttcatacttgagcaacaaagcgatcaaaacaccagcacatcctgcatccagccgctaagtacacaggcaagataatatcaagcacgtaacagatgcagccagtaataatctcacaagagccaacaatagactccgatattacgcattgacacataaaacacattaaggttttgatagataaaaagatctccagcaggagtgtgacaccacatagtctgtaaggaccgtctgggtttattgaccaacattacagataagcaagcgcacaggacacacgaacaaactcgaagcactcataactcgtaggaaaagcacacgacgatacgaactggaaatattcatggcgaacgaatactcaaaagacgataaggcgaagtaggcgatgattggggacgaggttggacgcgtcactcttcctcggattcagaatccgcgctctggagccactccacgaatggtttggcattcttcaccacctgggactccttgccagcagcaacagattcattgtaccactgagttatcacttcttcatccaggatgtccccatcatacagggccttgagaacaatcggcacctccttcacagcttcagggctagacttggcaccgaaggccaccagggcttgcagcaggaccatctgggaggcttcatcaggtacagcagccgcgaggaatttcttcttcttcacaacctccttggcaaatcctttgccgaggccgccaaagagtgcatcaaaaagagcattcatagcatcctggggtggcagggctgaggaagtcatcagacccttgagctgaacagcagtagcacccttgctcaagttatccttcatctccttgaccagatcatcataaggactgcttttagcctcttcaaccacatgttttgcacttccgttggaggcaccctccttgtgtgaggcctcgtgcttcttcttcttctcaggttcttcagtggacagcatcaccatctcagcagttgcagcgctcagttgctcttgcatgcgctgttttgcagcctccagcgaagtgtcagtctgccactggacatcatcgtcgtcatcctcatctgcagccacattgtcaccatcatggctgcgagttggtgaatttgaatgatcctcatcagagccagaagcagccttcttcttcccagcaccacttttagaggaggtgctttccttggatgcacctttcttctttgcttccttctttagcttcttcatctcctcatcagcagcctcaccttcctttagacgctccttctcagctctcctcattgccttcttgtctttcccaccacccttcttctgttcaggtggattcttcaggataaaagttgtgagcttgtccctcatgtcaacgtctgacacgaaaccacaggcagcacacttcaatgtaatcatctgggccttggagatgaggacctcagtctcagggttgccacatccatagcattggacatacttcttgatgaagttctcgaggagaccagccagtttagcagtatcatgtgccccattaaccaaggaagtaccagtcttctcatcaaatttagactgtgcaccaagctcacatccaaagtactttgttgtgtaggaagcaggcctagctagggcttttgctatatccaccatgttcacgatgttagtcttgatgccattgccacggccttctattttggtgatcatcctgggcatcttatacctgtagaaagcatcatcgcggtttgaagcaccaatgttttgcagagccatcttggattaattttctttcaccgagataatatcagaagcaccaagagccagaagtgacaatagtcttgatccttgaagtggatcagcagaaaccagtgcactccaagagcagccagaagtttgcataaattgacaaggcttcggatgcatgcagcagggccttccaagcgggagcttgtgcctttttctcgtccgagaatattctccaagtaatccaactgatcccaagtaaagcaagtcttgttcagacataaaagaagcttcaacttttagaccctccactttgtcagattgcagcaaaactgatgctgcctcctgcatcatacgtcaacatcagattcttcactcatacagacaccatagaaatgtacttatgtaagaaataattcaaatgcaagtaaaatatacaatatactacatatctgatgcatatatatgataccaaagttcaaacgaatactataaatcacttatcacttaaatattcactccatcaacaaagcgaacaatctatctgtttgtattctacttgcattatcctgtataaaatattaggatagtgaataaaaccatttgcatgtccaaaatactgtacaagaatggcatttgtatgaatgcaagatgaagaatgcaacaaaaccatgttgcaatgcgcaacaggctcctttgttacattataatgccagcaaaagttgaaaaccacaaggcacattactgaaagttctaatatgtcagacacactgaccaaacagtttgtactattatacaattgaagcacttattacacatttgtcgaattcagcatatactggattaatgtgtcatctagatcatctgcataataaacctttcaccaatattatataggataaccactcagaaactctatggaccaaacaaatagcataaccatatccatcaaaagtgcaaccagagctaaatagacaaggagactgtcactcaggaaatagaaaacagaagctcgtaagtgcgacatagctacgagtaaagaagtaaccatgcataagcaaataaaactgtgattttgctggccaacatcaaaagtgcacactaggcgtagtaaacaatgccataaataaactcagcctagcagattgatgacatcatggaaaaattaatacaaaaggaaggatagtaaataaggaatacgatagcaattggcaaaaacacatgaacattcaatttcagatggcaaaatattgcagtaataactgggaatggtcttattagcacgacgaaacacaatgcaccagtacaactactacgagatttgattacataatggattcgatcaccccctaaataccagaatggctaattcagtgtactaagaaacatacgacagacatcttttgcatagcactacattcgatgaaacaatcgaaagtttcataaactatcactacaataattaatgctagtaaaatccaaccaatagatggtaactaatgcaactgcaacatgtttaacgcatcctagcagcatgaagtacaacaatattaactgaaaaactacacgaggcacaataatcgaagctggatgaactgcaacagcacgagtatatgaaaatccacgcaacatcacatgaccgagctgacacgttagataatagacgcaatatacacacccaaagtatctgtattcccccaaactccatcactagcaaattactcataatcaggactatcaacgacttcccaagccttagaaatcgttcgatccgacgagatttgaccatgagagaactcctaaaatggcataaatccgcaccactccagatgccgaccagagagaaaccgaaacctgcagagggtgaggagatcaggggaggaggagggatcggggagttgctcaccttgcgatgggcggattggatttggggacgtcggcggcggcggcgggatcgacccgacgagggttcgcgaagcgtggggaaatttgcttgcggcggctggattgtggaagaggggggaggaggatggttaggtaggggtgggttatatagctaggttggctagggcttccattccgtgttggggttggattcgaattctgtgagaggggggaggatctgttgggcctgaaaataggccggaccagggcttagtttggtggattcccacggcctgttttgcaagagaagagaagaggaatggaagtttaaagaagggagttgatggtgtgattgatcatgggagtaaacatttttagtacacatctcttgtttggttttcgcatctaattccctcacagtctcatgaattaacatgtcttccttagataagagattggtaggagtcggacgccttgattctctatcctaaaccctctcgaattctcaagtcctccaaccaaactaaactttttaagctcggttggcatgttcgttgtggtgcgaatggccggtcgcgagttcgactcgcgggacctcacctcgacgggttttttctcgtctttctttaggactgtccttcgggtagtcttgactagaaataacggtacacatatacacacgcgtgagtgttcagtgggactgtatgtttcctgtgcaccgaagcctaatgcctctaatctcaatcttagcgtgtgttagggacgcgcacgcgtgtgtgtgcgtgtgttgttgtggcgtgtgtgagtgtacactctgagttgtatcctctgtcaccaactccctcaaaccaaaccgacccctattattttgggctgtaataaggtccttcacagtacgtctagctctcgtgtgaacttttgatgcgccatctcggatatcggcggcggcgatcggccacgagggttcgcgaagcgtggtgaatcctgtggcgagcggtggtggttaaatctctctctagaagaagactcgaagcgggctgtatctgggctggtatggggtgaacttttttaattgggccgtaattattttacacacctgtacatgtgggccgagagcgcgggagtccgccagaaaaattatgccgtctcgaactcccgacgtcgccggagacgaagacgaatacgacggcgagtcggcgacgtcgacacgagatggagcccaatttctcccgagaaaacggcgcgagaaacgaggggaatctcctcctctcgtgatgcatcgcacacaacaattaacgccgctctagcaacctgggagtactcctatcaacacaaacacacaacagcaagatggagctagctagagatgctctttgcatgcaacgatgcaagcaagaagaacactactcctgtagagtggtagtagcggcagctatacacgcctatacaagcgaatttttttaaaaaataatacgattttaatagaaaatcgcaaaaatataggtcggttcgacgaaatcgtaaatttagcaccctgtcgaacaaccgtgtctcgatagaggtacttatcgaactatggcagttcgacatgtacctgtcgaactgccatagttcgatagggtagttggtccaagggaaaaaaataaaaaaaggacagtaacagtgcctggcaggacatatcgaacaagcaaacttcgatagggtggcatgtcgaacagcccaagttcgatagggtctcagctacagtgtgctacagtgtttttcctctttttaaaaattattttatcatctgtcgaactgcgggcaccctgtcgaactgcggttgttcgataggtaccctgtcgaaccacggatattcgatagagtgccaaacttgcgatttcgtctaaccgacctatatttttgcgattttcctttaaaatcgtattatttccaaaaaaaatcctatacaagcacgttgggtgcatgcactgcacgcagatgagtgaatgcatcgcgttgatcgagccatggatgtcacggtgcatcgacctgggatattaattaatccatccgttctgcttcatcttataattaagtcgctttaactaccttttgagttaaagttctataattttaactaagattatagaaagtttagcagccatctanancacaaaatattttcattaatcaagaattgaatatatttttataatatctttgtgttaaaaatactactatattttttttatgaacttaatcaaatttatactacctctgccttacaaatactctatttttcagtttttagatgtaatgtatgactattcgtcttatttaagaattttctatgattagtatttttattgttattagataaaaaaaagatatgaatagtatttcatatgtgattaactttttcataaaatttttaaataaaacgaacaattaacgttggacatataataaatttaaaatgcagtctttatgaaacggagggaataagtttaactgataaaaaaatcaaaacgagttgtaatacgaaacggatggactggtcctagtgcggtgtcttggatggcgaagctagcgaacgaaccttccatcgatcgatgagagatcgagcagccggagaaattaatagttcccgtgtgcccggccggaatctgattccttttgctaaagtgtgcgcatggcgtatgcccaatactttggaaatttctttattcacagcattcaagcttctttatagttgttttgctatgtgaactttcaaagatgttgtcaactttaggttgtacgcatcatattatgccaagcagtcggtatatcacttggatcatattattcggggattcacaccgcatatgctatatattgatatcaagtcacttggttgattacaattatcaaaaccactcggttggttagattatttattccttgactatatgtttggatggttcaattaaccacatagtcgggggctacacctattaggtgcatctattcgatgcacctgactttatttttcagccctccacagtcttcagatttggtaaaagtactcgggagaccatggcgaagatgattgaagcactcggctttggagtaatctagttcgagagaagattatattttcgactgtgaaggtctcaggggctactgtggagattatgggtaccccatatccacacggcatggttatccgactagtaataggggataacatatatgtatggaatatgtaacagatcgtgacttgggtattacgtttccctatatattatggaacggcctaaagttctggtttgataagattgtaaagtagatttaggaaaccgataccgtattggttaaggtttctatcttgtaatcctgccccccatcctatataaggtgggcaggaagccctctagggggcatgagacacaacctgatcgtcagatcaatacacactcggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacacgatgagagatcgagcagccggagaaattaatagttcccgtgtgcccggccggaatctgattccttttgctaaagtggatacctagcttcggcggcgacgtacgtctccaatggaatcgtacatgtggagattatggatatcccatatctacacggcgatgatatttggactgaatataggataccgaatatagatagaatatcttatgtgtatcctgggtttgtttcctgacttgtatatcaaggaaacaacttaagacttagtcggtcacgactgtatttaatctgtatctgtgtattccgttagggatatagattatcttttgtaacccggactccttcctatatataaggggggtccgggcgcctctaggggcagttgttggattttctccaaatcatacaatcaataacacactcggcggattcatccccggacaggagtagggtattacttcttttataagaaggcctgaacctgtataaatcctttgtctccaaacccatacactttcctagcttgatagccacccccttttattattgccgaaatctagtttcgacagttggcgcgccaggtaggggtagcgtcaagcttttcgccgatcagtgcaatgggttccatctccggcatcgacggcctcgtcttcccacccgggcagacgtttcggttcggcagcctcgacttcgtcaccaacaacttcggcaagatttctctcctcgactcggaatcagaccagtcgggagagaaccggatttcggtcccgtttggattcccgaacgcggctgaaagctacttcaagaccatctcaaccgagtcggcttcaaaccactcggccgagatcgcatcttctccaacgataccagatcaagatgatggggcttacccaccagtcctgatgaagctccccgacgatttagcggccgtctccaccacgacagcgtcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcacgtcctactgacattgtggagtacgacgaatttagttctcgatacaacgacttcgacgacttcgacgac

SEQ ID NO: 44012 - DNA, 758 bp, Oryza sativa
  unsure (1)..(758): unsure at all n locations
nnnnnnnnnnnnnnnnnnnnnnnnnnnnnnnnnnnnnnnnnnnnnnnnnnnnnnttttgacatgtagaacttaagaaaaattccacatgtcaagtccgattattatttgcattactttcttagggttttctcctgatttcacctgcattttcttggggtcatttgaaaattacgattttggctagggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaacacggcaaaaccgggtaaccttgtttctggttctcctttcgctggtatcaagtatgcgaaccggcttctcaacataagttaggtcctcctggatatcaatgtgttccgaatccgcctgttcttcaggtacccttaaacacttctttaattgggacacgtggaacacgtcatggatgccgatcatgttggatggaagttctagctgataagcaacttctccccttcgttccaagattttgtatggtcccacgaagcgtggtgccaacttgcctttcgtctgaaaacgatgtactccccggagcggagtgacacgaagatacacgtaatctcctgcctcaaaagtgagctcccttcgacggttatccgcgtagctcttttgtcgagactgggcaatcctcaacctttcctgatgattctg

SEQ ID NO: 44013 - DNA, 770 bp, Oryza sativa
  unsure (1)..(770): unsure at all n locations
gtaaatggcagtagttgcccgtagttgcacacgcataaatgcgaatttccagctccacgtacgtcagtacgtagtactcctcatagtagcactacagtgctatcaaatactactagctaataaatcgaaacccaaaaagaaaaatgaacatgctagtaccagtagcatggccaacttagccaatatgatcaagacctgaattccccttaaccactcgtatatgattgcatatataatatatgcagagaaaacaaggtgatcagcctgcacaatatctactgatcaggctccaaccttttgtctgtatccccccgtgggataatcagtcaagaaaaccaaaggaaagaaagaaagaaagaaaaaggtggtggaaagaaacaaaacctaattaattacatcgcctaatggctgatgctttcgtgtatggtcgttaaattaagaagaggcctcctctgagaggtgtaagaaagttctagcaccctacacaaggttagctaagcgggcgaggcaggacggtatccttacaggtagcctcccggcaaaattgcgggaccgcgcgtagagcgcggcgcagagcagcgtcccgacggcgcacgtcgtgccccagatggcgaacgtctcgcggtagcagccggcgccggagcaggtgagcgtgccgcgggcgccggcctcccgctggtagaggaacgcggcgaagtagccgaagcacagggnnnnnnnnnnnnnnnnnnnnnnnnnnnnnnnnnnnnnnnnnnnnnnnnnnnnnnnnn

SEQ ID NO: 44014 - DNA, 6428 bp, Oryza sativa
tctaaccccttatgttataattcccttgtactcccttgcatttattttgcatttgtgggtgtgtcttgttgagtacggtggttgtactcagtcttgcttaattttcccaagcccagatgaggagttccctgaagatgaaggcttcggtgtctagctcgtgcctgccgtcaagtgcctgtggtcgtcgccctagtcttccgctgtttttcgttgtctttgagtgtgctgggccttcgttgcccatgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcatttatcgtcaaaatctgatcttttaaaatgttgcttttcttttgtttttgtttgtagatggccggcagcgttacccgtcgtggtttggacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgatcctctccggctctcctgagtggacttcgctggcagtcactgcgggtggagattccttccccgccgcttgccagaacgccgctctcctcgccatcggcactcttcaccagcgctacccggacgagttgcagcactcgccctaccgctaccacccccgtcgcggaggagccagcgaccacgccaccttccgagacgccagctcggaggatgacgctaccgtcgtgcatctggcacgcatggtggaggcgtacgacgcggctcgtatcgacttccatcagatggtgcgtcgtggcatggtggagaacaacctgaagatcctggagctgcgccaagagaatctgcagctcaagaaggacctcgacgcgttggaggcgcagctgcatcagctcaaggtcgcccagggagagatctgccgccccaagcgtcgccgcgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcctgcgcgtgtgtttttcttcgttttttttcttgagttgtgtggggcatggttacaccggtgtgtggtgtaactatgtcggagcctgtcttattttgtttgcctaagcaacttgaaccttaatgaaccaatttaatagcagtgataaatttaagaataatggtagtcgtgggtggttagttttaatcgtcagctctccttctctgtttgctggttctgtgtggggttttcagatggtgtcgaccaggagaaatgttaacaccggagaaggcaaccaacccgaaggcagcaaccccaacccccaaggcaacccacctccaccaccaccaccaccagacaccaacgccattctcacccaaatcctcgcccagcaagccaacatgatgaatgctttcctccaccacctccaaaatctgccacagcagaatgctcccccaccacctccccaacactccaaactcgccgaattcctccgcatccgtccacccaccttctctagctccaacaaccctgtggatgcgttggattggttgcatgccgtggggaagaagctagacacggtgcagtgcagcgacgaagagaaagtcatcttcgccgcccaccagctgcaggggcccgcatctctatggtgggaccacttccaggctacgcagccagaggggcaaccgattacttgggctcgcttcaccgccgctttccgaagaacccatgtgcccgctggagtcgtggctcttaagaaaagggaattccgggagttgaagcaaggcaaccgctccgtgatggagtatttgcatgagttcaacaatctagcccgttatgccccggaggatgtgcgggaagatgaggagaagcaagagaagttcttggcaggaatggaccctgagctgtctgttcgtctagtctctggggactacccggattttcaacggctggtggacaagagcatccgcttggaagccaagcacaaggaactggagtcgcacaagcgccgcttggcgaatttccgcaatcagcagggtgctaaccagagggtccgctacaccaatccctacccagggggatcctcctcgcaacagcagcagcagcagcaacctcgctccgcgccccgacctcaattcgtggtgcgcgtcccacagcagcaacagcagcagaatcagcaagggactcgtgcgccacgtcctcctacgccaactgtgcagcctgttcaaggtcgcagggacgctcaaggtcagcagcgtctgtgcttcaactgtttcgagcctgggcactttgcggataaatgcccaaagccaaggcgtcagcaaggccaagcgcctccccgctccaacaacggtggcaaggacgtcatccgtggtcgcgtgaatcacgtgacggccgaggacgtgctgacaactccagacgtcatcgttggtacgttcctcgttcattccatccctgctacaattttgttcgactctggagcctcccactcgtttatatctgtgccattcgtggggaaaaatcagttgggggtagaaaggcttagaaaccctctgctcatcaccacccctggaggggttatgacagcaaagtattatagccctgccgttcctatagaaattcagggaattccttttccctcggatctgattctgttagacacaaagaacttggatgtgattcttgggatgaattggttggcacaattccaaggagtagtggattgcgcgaggcgcactgtcactctgtaccgaggaccggaacagccggttgttttctttgcacctccaacctctgtcagaagttcagaactgcatcaggtaggtctgtcagaaatccccatagtcagagagttcggagacgtgtttccggaagaactacctggtatgccgcccaagcgagagattgagttccggatagatcttgctccaggaaccactcctctgtacaagcgaccctaccgtatggcagcaaatgagctagccgaagttaagaaacagttggaagaattgaaagaaaaggggtatatacgtccgagtacttccccatggggtgctcctgtgatttttgtagagaagaaagacaaaacgaaaaggatgtgcgttgactacagagctctcaatgaagtcaccatcaaaaacaagtaccctcttccccggatcgatgatctgttcgatcagcttaaaggtgccaccgtattctccaagattgatcttcgttccggatatcaccaactacgtattcgtgaagaagatattccgaagaccgcattcactacgcgatatggactgtatgaattcacggtgatgtcgttcggtttgaccaatgctcctgccttcttcatgaacttaatgaataaagtgttcatggaatacttggacaagtttgttgtggtttttatcgatgacattctgatatactcacaatcagaagaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggatcccgaaacagtgaccgccgtcaccgattggaagcaacccaagacagtcactcagattcgcagtttcttgggtttggcaggatactatcggagattcatcgagaacttctccaaaatcgctcgacccatgacacagttgttgaagaaagaagagaagttcgtgtggagcccgcaatgcgagaaggcgttccaaactctcaaagaaaagctggtttcctcgccagtgttaatcttgccggatactcgcaaggatttcatggtgtactgtgatgcttcgcgccaaggattggggtgcgtgctcatgcaggacggtcatgtggtagcctatgcttcacgccagctacgacctcatgaaggcaactaccctacacatgacttggagttagcagcggtggttcatgctctaaaaatctggcggcactatctcattgggaaccgctgtgaaatatatactgatcacaagagcttgaaatacatcttcactcagtcagatctgaaccttcggcaaaggagatggttagaactcatcaaggattatgatgtgggaatacactatcatcctggtaaggccaacgtggttgccgacgctctaagtcgaaagagccattgcaacactctcaacgtccgaggcattccgcccgagcttaatcaacagatggaagccctgaacctaagcatagttggtcgcggattcttggccgcgttagaagcaaagcccaccttgctcgatcaaatccgcgaggctcagaagaatgatccggacatgcatggactcctcaagaatatgaaacaaggtaaagccgctggtttcacagaggatgaacacggaactctatggaacggaaagcgggtatgcgttccagatagcagagaacttaaacagctgatacttcgggaagctcacgaaagtccttattccattcacccgggcagtaccaagatgtacttagacttgaaggagaaatactggtgggtcagcatgaagcgggaaatcgcagagtttgtggctctatgtgatgtgtgccagcgtgtcaaggcagaacaccagcgaccggccggactcctccaacctctccaagtgccagaatggaaatgggatgaaattgggatggatttcatcaccggacttccaaaaacccaaggtggatatgattctatatgggtaatagtggatcgattaaccaaggtggctcgattcattcctgtgaagaccacctatggagggaataaactagcggagctctacttcgctaggatcgtgagtctccacggtgttcccaagaaaatcgtgtctgataggggaagccaattcacctctcacttttggaagaagctccaagaagagctgggtactcgattgaatttcagcaccgcatatcacccgcagacagatggacagaccgagcgtctgaatcagattctagaagatatgctccgcgcatgtgtcctagatttcgggaagacttgggataagagtctcccctatgccgagttctcctacaataacagctatcaagccagcatacaaatggcaccttatgaagcgttgtacgggcgcaaatgccggacaccgctattgtgggaccaagttggagaaagccaagtgttcgggactgacatcctaagagaagccgaagctaaagtcagaatcattcgggaaaatctaaaggtggcacagtcccggcagaaaagttatgcagataaccgtcgccgtgatctggaattcgcagtggatgattttgtgtatcttcgggtcacgccattgcgaggtgtgcacaggtttcagacaaaagggaagctcgcacctcggtatgtgggtcccttccgtatcactgctcgacgcggagaagttgcttaccagctggagttgcccgcctccttgggcaacgtgcatgatgtgttccatgtgtcgcaactcaagaaatgtcttcgagtgccatccgagcaggccgactcagagcaaattgaagttcgcgaagacttgacctatgtggagaggccagtgaaaatcctggacaccatggagcgcaggaccaggaaccgggtaatccgtttttgcaaggttcagtggagcaaccacgccgaagaagaagctacttgggagcgcgaagacgagctgaaggcagcccatcccggtctcttcgccagttcttccgaatctcggggtcgagattccgtttaaggggggtaggtttgtcgcgtcccaaatcgactctaaaatctatcctcaaaattgtgcaaaagaataagtaaaattcaatgtgaaagcctccaacaattaaaatgtgcaaagataaaagtcaaatgaggcttggaggatttttgtatatttcctaaaagcctaaaatgcttaaataaattttagtggaattttcagagcacaaataatagttgaaaagaaataaacaaagttaaaaaggtttataaaaagaaaaaccctaaaagaaatctgtgtccccccccccttttcctcttgggccgggtcggcc

SEQ ID NO: 44015 - DNA, 738 bp, Oryza sativa
cattgctgatggccggattagactcggcaatgcgcatcctgccgctgctgaaagcatgtcgtcagcagaaagaaatatctcaggttattgcgagatgccgcccggggcactcgatcccatatttttgaatcaatcatgtacaaaccattaatgtgggtggaggatgggagtgttaaaatattttcattaccttaaatagagactgtgtcgatcttgtctaatactccctccgtcttataatataagagattttgaatttttacttatactgtttaaccactcgtcttattcaaaaatttttgaaattattatttataaatttttacttactttattatccaaagtactttaagcacaacttttcattttttatatttgcacaaattttttgaataagactgtcggtgatatgggcccgggggtatcacgtctagagggaggaggtcgccctcaaacccacgtggctccccgcgaggggggatcaagcccggggtggagcggtggctacccccacccagctagagggaggaggccgcccttaaacccacgtggctctccccgagggaggtcgagcccggggtgttgtggcggctgccccctcccagcttggggttgggccgcccccaaacccacgtggctccccccgaggggggtcgagcccggggtggcgcggcagctaccccctcccagctagagggaggaggccgccctcaaactcacgtggctctcccgaggggg

SEQ ID NO: 44016 - DNA, 4513 bp, Oryza sativa
  unsure (1)..(4513): unsure at all n locations
nnnnnnnnnnnnnnnnnnnnnnnnnnnnnnnnnnnnnnnnaacttagcaaataaagtttagactcaagtcaaagaaaagatcaaaagtgaaattactgaaaggaagaatcgagaagagcatgacttaaaatatttcgcaaaaaattttccctaaaaatttaagtccattacatcgtggtacggcgagccggccgcccggtggggggggggggggaggagggaggaggggatgggatggtggtggggttggggatgtcaaggggcggtgtgttgcttatgacatgctcgtggtaggacgaaggagggacccaactcggtgacaatggagaagacctctgggttctctactggggtcgttgggggtgtactggcaacgataactgctcaatgtcatacccgtctcagttggtttgtccgctgcaggggtcttttctttgtgggcgtcgtctcaccacaacggcgtggcggtggtacgatgagccgacgtagaggagcatcggcagcgcgtcgccttccttctccttatcttccaactcttccgccaagtgagatcccccacattttttcttctcatttacatgtggactctatattttttttctttttgctgactaggatgaaacatcagcgaaaccagatattcgtattgctatggtattcaaattgcacggctttgtatagtttagggtaaagattgctggtatcagagataacgaatgtcaaacaaacttgagcaaagttgagggattgcaagtgaacttattccatccaataaagacttgtttgtggactttccaaactggcccaatttaaggcccaaaactatgaggttctcatatttcctgggcttcccagttctcaaatgctcaagaagtaacgatgccctgacaagtgacaaatgcccattgagcaggtaccgcgttgcgaattttttttatttctaattttttttattaaaagttttacaaaaataattttccattttgaaaattgacggaagtagtcgcctaccgccctctgggagggcgatttttaaaaatcgccatcccagatggcggcgaaaatgacgtggcagacggccgttcgctctcgggcgacggctgtcaacgaaatttgcaggcggcccccttgccgccctccgctagggcgattttgtactgtgcggggggccgcctgcaaatgggcggcgagggggcatggaattttgcaggcggcccccttgccgccctgggggagggcgatttttgcctcccccctataaagcccagtcccccctctctgaaatttcattatattcactaaaaatccaaaaaaaaacgaaagagagagaggagagggcagcagaaggggagcggcgaagccctgctggttcgctcacttcatcacaggtttgctcccatatatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggtatcgataggcctgtggagaaaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtgaaaatggcttttgaacggtcatggcccctcgttatatttgtgtcggtacaagagaaagatataaatgtttcaatgcaaaccgaagatgtagagggtcctatcaatgcaagggatgttgttggaccatcgatgcaaaatgagaaaaatcaaccaagggaggagcaggccatgggcatggcggatgagggggagagagtcggtataattgttgatgaaatggagagggaagattcggataatgaggaagcgaacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggtaagtgagatgtacagcagtgttgttggtaacattggctttgaaccaaaatcaattattaggcacatcgagaataaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccaaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgttcgtcatgcgggtatgttgcgggctattgactacttgcagaacggttgggatgagaagggacttccagctaagtggcccgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacataatgacccaccaacaatgagaaggaggtcagggtcggccatcagaaattttactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtaacaaagtacatggaagataaaatcaaaaaggtacggcgacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcagaatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacatggtgaaggaacaacaagcaggcgcgcaaggccaaggcgtcgtcgcgcagcaggcgattccatggtgtaacaatgctatcgatttaggaaataaaacgctgttgtgatgtgatgtgtgttcggactaaatacttannnnnnnnnnnnnnnnnnnnnnnnnnnnnnnnnnnnnn

SEQ ID NO: 44017 - DNA, 51366 bp, Oryza sativa
  unsure (1)..(51366): unsure at all n locations
tcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacatggtgaaggaacaacaagcaggcgcgcaaggccaaggcgtcgtcgcgcagcaggcgattccatggtgtaacaatgctatcgatttaggaaataaaacgctgttgtgatgtgatgtgtgttcggactaaatacttatatcgtgtaatttcaattgaatgttgttgtaatgagtacctccgactattgttgtactagtagtattgcgaactattcggtgttgtatcataatgttatcgtgatgagtgttcggactagtaactgcagctattgttgtaatcagaaatattccgtatggtgacacttttgtttgtttgtactcttgtttaatatgtgttagtaattcgcttatgaacatttattacttatgttgactaattatttatatgtttctgaccaatctatttgatgcaggtatggcgtacgacacaccggcgctgttgaaccgtgggattgacaggaaccaccgctcgttcctgtcagcagtcgagggtgcacagctcgacaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcaggtagaccgctggagacctgagacgcacacgttccaccttccctgtggggagatggctccgacactgcaggacgtgtcgtacctgctcgggctaccgctggcgggagcaccagttggtcccgtggacggtgttgttgggtggaaggaggatatcactgcgcgcttcgagccacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctacgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgatacttacttcatcgagccatataatttacctcggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctgtttcgcacggtactgctcagcccagaggtttcttaagttttgtttatgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacaaggtactttactttttattaatactattaaatacatgtatgaaactgatggtccttgtccagtaggatttgcagccgggatcttcggtactggggcctcttcgtctcacgccggtaggactggtcctactagccagttctacgacgacgacttgcacggtgcacatcaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcctctacatagttcttttcattcatatggtgctagaacaacttatgctcacgacaacacactttcgtacaatggattgacacagtcagagttacttcaagtggcgggccgataacgcaacctgaaccgaccatacagttcattcatacttggatggagtacgaacgtcgggtggaaattgcaagcttagactggaggaacaatccattagggttacataaatggtccgagcgtccaaagtgtgggtgcagggatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttaagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaatagaccctaaaaaataataaaattgtattttaccagtcttggagattttaatcttgtataattttcaatataaaaaaaattgataactattgatatttataaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatgaaaaattatttttgtaaaacttttaataaaaaaaattaaaaataaaaaaaattcccgcgttgcggcgttggcacgaaagatttgtactccagacctccagttccttcgcaaatgtagcacccgtaacgacagttgatcaaacattccgtcgatcaattttgacgtgtttggagctgaggtatactagctaacccaagctggtgattggtatgtttcgcagcagcagtgaacgcgaccacgtttggcgccctcaattggtagtcccctaaccttttcatttcccggtctttcaagtctctttcgtatggaaaatatgctgctctgaactccaaccatgagttgtaaaaaaaaaaaaaaaagtccaattgagaactacaccggccggctaccagtctccatcctcgcttcgtgacattccacattaacctcagtgcacgtgcaccgtgcccacgactactgtatgcgactgcaacccactgcacaaaattagtacttttagtctggcgatagatctcaacaaatgcatttacgaaagatttactacgaagagatcgattggtcgaaacagcggatattttaatttgcagatgggcagatggtctgttgtattgtcctttttttttttctggagtccgtacatatcgcaacgtgcagccggactcttttccatttcattggattattgcagcggccgattaatggctccgagcttttacggtgtttataaggtacttcgaaatactaagagataggataatgtataccgttgattaagagagatgcaagatataaaataaaattatcgtaaacgatagcagtggggaaataactagtcaaatatggtattttctgtgagtcgagaatagttagctccatgtgattagtatcgttcattaggaagcaaactaaatcttcaaagatttagtggattgtattgtttgatagaaataaagtaaattttccgcaaatttagtggattgaattgatctgcatggggaaaaaaaacaagattgatgtatcatttgttctcctccaccgcttcgttcttgtccatggtcatgcttccatcctgccatcaagctccaatgcttccaaccactcccgcaccactttcgtcaataagttcaggaaaacggaatccctatcagttgggacgcgtggtgatgcgcttaggtgcccgcaaataccaactgaagcttgctacatgccattctttctttccctgactcatgcccttaggttgtcctttgtgcctgccttcacttcccgggggtgcgttgtgccacgggacatgtcttaccgccatcaccatcatcatacaaccaccaccagaacctcaacgcccttagcctcctcctcccatttgcccaagcttggacgagaagaagaagatgaacagtgttagggcactgtttcttctcggttgggtccaaccaactcccaaggactcccatgttattagataccaaatatatatcacaaaaaacacgtaaatgacacaataaaggatcatagaagataaaataccaatgcggtacctatgtaactagagctaatatttagacaattatacccttctccatttcaaaaaaaaaatatttttacccttcctacctaaataactataagttataacaatactcaaatactttttaagtggtatctttcattgtggagcgttggatgtttatcctttttaatacaaacacagtatgttttctcaagattttatttatcgtctattgtactgcttggatcaattggattttatttatcgtctattgtactgtttggatcaattgttctatgtagattatttttaaaaaatatttaatttcccccctacgatgaacaacaaaatctgcccgtcatcgtgtaaataatttaactcaccatgaaatcgtgagactggatcacatgcggcgtactttacttgtgttaaccgatggagaatccttgtttactccgtgttactactactccacccgtccagcgtcgtggacctcgtggtacgtaggagtacacgcagttaccgttcagtacttaaccccgtacgctgatctgcactgctccgcgctgcgctgtgcaactgttgcgacacatggcatggggcagagctactcgaaacgcgacgagtcttcccatttggcgacgggtatagccccgatgtgacgcgaccagaagggctcgatccgtcacttccacgagtagttccattcacggcgaagctgatgttcccgcggtgggttggtcttggccgacgaccggccggtggccagcctcacgtttcgatcacctgggcgcgacagatcggttcttgccgcatgctgatgtaacggtactgggtggtacgcgtacgggcggagtttctgtcaccgtccgtcggtccgtgccagagatctcgcgacgcgcgacgcgcgcgtgcacgggccgaccaggcgtcgccgcgctctgttgcttgacacgatcgggactgcgtccgcatgcgcgccgagcgtgacgccacggcgaccggcacgggacgagtggacgacaggtacgcagcattgcagcgttcgaacgaaacccagccgggataacaaagagatcgcttgacttacctggagagcacgcgctatccgaacgattgagaccaattttaggtagtgtttggttgctgggatgaggtgggatgggttggtccctagagaggaatatttctctcaaatccgggaccaactcatccggccaaaactggcggactgggacgagcgaacggcgtgacgacgctgctcgcgcacttgcctgctcgccctcaggaacggcggcgggctcatcgacggcggcggcaacaggctcagcagcagcggtggcgacaggctcaggtgacagcggcaggctccacggcggcggtaagccacaggctcggcaacaccggatcttgtggtggggaaatcggcggcgctggatctaacgatggggagggctcgggcggcggaagatggctcgggcgacggcggaaggctccacggcggcggatccaacgatggggagggctgcgccgacggaagacggctcgggcgacggcggcaggctcggcggcgacggtggagacaagctcggcagcggcggcgttgaggggctcggcggcaccggatcctgtggtggggaaggcggcggcggcggatccgacgatagggagggctgcgccgacggatccggcggcggcccgaccgtccgtcatcgtccccgaagctcttggcgtcatcgtcccatagcttcacgtcccttcgtcggcccgaaggtcgacgccatcacccgccgcatcgcgtcccttcgcgaccgcagctcggtggcggagatggaggtgagggcagaggcggcggcggccatagttgttgccaacggcgtcttcagtggtggcaaacggcgtccatcaaatccctccctcatcccttcaaccaaataaaaaactgcgatcgtcctattctataaaccaaacacgtaagtagaatcatcccaacctcaaaataatggatggtttcatcccatcctatctagttttagaaccaaacactaccttattttcggaacaactgaatatggatatggaccgtgtacgcgcccgccgcacacttgcactccccgccgttgaacagtcggagtgtaaactttaaagagcgttgagcgagctgtaaaaattagcaagtgacggggaagtaaagtacccacggtacggtagctgaggagacacaaaatgtcttcggatgcctgaaccttacagcagtgcgcagttgtgcttgtgcaccaactcgtgtgagtccttttggtgcctgaccacgagtaaggtgttttagtttttcttaatttaagggagtagctatatttgtgacgtcatatttttcatcaaaaaataattagcatgtatttacattgtaagtccctaaattacatatgtaaatttagtgtatttataatgtaagtttcaaaattacatatgtaagtctaaaaattacacagtaattatatgtgtaagtggtgtgtaagtgggatttaagtggggtgtaaatttgtataaagtatagtatgcatgcgtgtaaaaccttgaactaatgaagacgttaagctttaattaatcaattaatcatgttgacagcctcaacgttagcctgccatagcaatatgcacggacaggatcgcattgacacgggataaaggaaatcggacgcttcaaaacgccgactgtgatggaggagaaaatgtgtcgatacaattctagcaatttcgtaatttaatcagtataagatccggtaccaacaggcattagctgatggcctggtgtcgatatggtgccaacataggatagaaatatgacaccttatagtactatttaacaaatatagtaaggccctgtttatccagggatgaaaagtttcgacgtgtcacataggatatagaccgcctgtattaaacgtagactaataatataacagattaataatatccagggatatacagatacacatttaaagtattaaacgtagactaataatataacaaattacagattccacctgtaaactacgagatgaatttattaagtccaattaatctgtcattaacaattgtttattgtagcaccacattgtcaaatcatgtagcaattaggcttaaatgattcgtctcgtaatttacacgtaatttgtgtaattagttattttttatttatatttaatactccatgcatgtgtctacacattcgatgtggcaggatgaaacttttgccaggagatctaaacaggccctaaatatttctggtttgtatacatgcttttatattgtattaacagtacctaagtagtcgagatactctgtattcctgttgaattgtcttaaaacaatgagaaaatctatcctgtatcactgactttgccctggaaccacaatctgccactgactttgttcagttccatactatgccatcgctttttgtttaacttctataatttaccatcgccgtcaagttagcctccgttagtaccatacaattttgttctaatgacaaaaatacccctaagatgaaaactttcagaatttggttgaaaattcacaaatatcatactgtaacatgttacagaggttgcccggctcattttcttctatgatgatacatgattatctaagcatacatatgattgttttagcaacttgtttgacggaatgttgcacttacaaaaagtatatctctgtgtatgtgtgtaggttcaaagcaggttaattaggtacatgattcccatgcatacatgtacgagtgcgagcacctgccggacttttggtcgtcgcatccctgtgtacacttaattagaattctatcaatacgtacgtatgtatgcggtcgccacgggcttgtgtaccacggacacagcctgcagtgcacgtgtacttctggccgtaattgaggcgggcatgaaaatgaaaatagattgggttaattttaggatttttgttcaggggtattttggtcattagtataaaattgtacagtgctaatggagacttaactaacggcgatggtaaatcatagaagttaaacaaaaagtgatgatatattatggaattaaacaaagtcagtggcagattgttgaactagactaaagtcagtggtgtatagtagattctctctacaatcccgttgaatttctgagaaaaaaaatgtttcgctccaaataaagccgggctccttatggtttgtggagatgatccgctctctgtttaagcatcttcgtacaatgaagagggattagaacccaattgaaaacatgatcaaacatcaattgacgggtgattgatcaattcaattccaagagtccaaacagataattcgagtgctgagctataattgcaaacatacttttccgatgtgcagacgataattaagtcacactgtgcactcaaactgtactccctccatttaaaaaaacgaatctattattatatgacaccacataatacaacagatttaaacaaatatatattacatatattattaggttgattttttttagagttaattgtatattggaccactaatatttaccttggttgcacattggactagaggtaaatctatcttttcacattgggcctgctaaatctacaatagttatatattgaaccggtattcttctccaactctcttctccgttgagttgaattgtacccaatttgtaaagtctccatacctgtcatctagctcaaggtcgctaccacaaatgagcaaggctctgggagaccaggaccttgagtgagctgctgccggctggcgatcaagcccctgccctacgctgcatcaagctcgaccttgcactggagctacattgagcgttgcctcgtactcgagctcactattggcggtgagcagaccatccagatcgcgccaccaatctagcttgacctcctccgatccctgcctgcgcactggagctcaagtttgagctcgaccttcgtcagctctggccactcggtcgatctcgctcgcacccatccctgcatcaagctcaaccctcctggtcctgcaatctctcaagctaaacctccatccaacaagctgttgcaagggagaagttgatggtgagtagctacgattaggttgagtaagcgttgcctgagctccttcgtagatatccgtcccaaaaagactcaattcttgggtttccgtgttcaatgtttgaccgtccgtcttatatgaactttttttatgattagtattttcattattgttagatgataaaatatgaataataatttatgcatgacctacctatttaaatttcttcaaataagacgaacggtcaaatgttaaatactagaacccagaaattgagttttttttttgggacgaagggagtatccgttaattgttggccaccagtgttcgagagagataagggatactgacactgactgacatgtgggccactagtgttaagtgaatttttggtaataatacctagcccaaaatgaaaagttgtgctaccacccagttcatcatgcaacaaaggtaataaaaactagtccattataaaatttactcttttttataggacagagtgagtggagtacctagagggagtacctagtactcccttcatctacttttaattgtcatatttccaaatctgaaaattttatttttgataggtatatttcaattcaagaacttatcatcttaataactttctcggatttaatacgtgactctccattcttccatacaagattagctacatgggcatcgagacatgtaaatattaatgaatcgtttgtttacgaggagtagaattacttatccttcatctgtgtgtcaggataaaatataacaatcaaaaatagatggagggagtagcatcttgcaagaaaacagatcagtgctacctatggacgcattgcagcactcctagacaggctaaacctcccgtacgtcatgcttcacacaaatcttcggtcgaatctactcctatatgactgcacatgtgctcgttagtctcacacttgacccgagaaagaccagctagatacagtactactagtcactgcccaaggcatgtctgcgtctccctcttggaccatgtactagctccccttggttggacccctcggtgctgtgtactcactccgtcaaaaaaaaaaaaaaaaagacaaatcctactttccgtatccaatgtttgaccgtccgtcttatttaaaaaaattatgaaaaaaattaaaaaaataagtcacgcataaagtattaatcatgttttatcatataacaacaataaaaatactaattataaaaaattttcatataagacggacaatcaaacattggcacgaaaacccacggtttgtctttttttaggacggagggagtaacttctggcaagtatcacagccttttcggggttgcacatgcgagcctttacgactatccctacttctccatgggcaggaataactttagggcttattaggatcacggtactgcaaaaacgtaggagtagaaaaatcgtaagaatatgatagaaatatatgtgtaaaacagaggattgaaaaacacaaaaattctgtagataggattggtaaatatgtgttcggataggcagaggaaaaacataggaaatggaaaaaataagatacgagtggatggaaattttcctttgtttctctattgattccacatgaaaggaatttttcctcttattttcctttgggttgattcctatggactgaatgtcaggaaaggaaatatttcctatatatagtattcccttgaaaatccttaaaaaatccttccatccgaagaggccctcaggaggttttggcgctggaccaactgacgtactagtactagtcacgtagtagttccccgcttcccactgagcaatcacaattcacacacgagtgaagtgaagtgacgaagggaggactcaggcgaggatgcaaagatatggtaaatagagggagtacgttgctagtgccactgttctttctcgctgatgtattaaacccgatcgatcgatgcatgcagtggtggcctttgcctggattcggagagagatctgacgccgctacagtggccagtgggagggctacaagacagctgtgaagccgaaccgtcccttcgcgtcgcggcaccggccggcttcgactgaccctgccttccagcttcctaaatctggccggctgatcagcctccgctctacagctgctgccgcggcgtgcggcttgaaaaggagctggtttttgggggaggcgccaatggcgagctcgggggggaggtggaggcggagcggcagttccatgctaaagctggtggtggccttgtgcttcttcgctgtggccatctccctgtgttgcgtctgcctcagctcgggttgcggtggcagtggctgtggtggattcaggcggcgcgctgtgctgctccgtttaggtaatgaaattcagcgagctgcatccttctgcgcacttgtttactccattttggtattctccagttcactggctaattctggccacaacctgcttgttgggtgtttcatttcgtttggttctgtatgtttgtcgtcgtggttcatatgttcactgctcatgctgatgcgagttcttcgtttctgaaattcaatctggataagttcattgcaggctttaagttgaaaatactgctataatgtttttgtttcactgtattactcctatatcggtaccatatagtatatcggttgaaatgttcaaatcactctgtaataatccgtgttatcgtgttttctgcagatttccggacacgagcaacagcatattttggcgctaatcaggtgagttttgcatctcctcccccttgctatccactctacatgcccgctaccataagttcgcatcgatcaatgcagttcaacttcaaactgcaaaatgatgaaacgacgcgatttattgttgtttatctggccctcaatcatctttcatcagttgttgattcgcgatcgatgacaagtcgaaatcaacacagaacactaggcaacctcacagggtccgcaatggcagtccccattagcgcgcacagtcacggccatgaaagctggcgtccttctccgacagccgttcaacgccggcggtcccatcgccttttgaccatacgtctctgccgatcgatgcgtagtagtacatccaaacgtagcacgccggcacgccgcgcgtcacagcgatacgtgaaaacggtgaaaggttgaaggacggtgatacgtaaatccattgtgttttgtgttgtagcaggatcacagctcgagcgggcgtcgatggcggcggctgctggcggagggcccggggtcgtacccgccgcggtgcacggccaagtgcggcgcctgcgtcccgtgctacccggtgcacgtcgccgtgccgcccggcgtcccggtcaccaccgagtactacccggaggcgtggcggtgcaagtgcggcaaccggctctacatgccatgacgggcagagcgtgcacggcggggtgacgctccggtggcgaagcgatttgcgcgagggtggcgcgcggtggccggtgggcgtgccgggccgaggtactagcacagtacagcagtgcactgctgcccgatcgaagcggccgtcgcgcatggggccgtttcattattgcgatgcgggccgggagcacagtggcagtgtggactgttgccgcgcccgcgcgcgaatcgggtggaggcgcgcgtgatgatggcctactgggctgctgggctctggaatttgcgcggccctaccacgaggagcggtggcatggggttgtacggcgcgtgctgcaaagggaagcgagaaggggagcacgaggcagttgctcgctgcacgtgtccaggcaatctgttgatatgttttggttcttcctccttgtccatttggatttggatcttcgaaatcccatttgtatctttgtgagaaatgatagtcgttataggccatttatgttaaatttcagcattattcttaccgggcttcaacagcatacatgagtacatgacatgtgttggtttcttctagcagcatggaacagttggaagtgtttgtttagggtatgattgtgaagtgctcgacgttcaatcatgttagtgttttacgtttggagaacgaagaaatgagtgttgctgtttggtgtgtacttgtacgagaccctcacatttgaaggcccatcaatgttgctggtaccacccagcccaactattgatgataggaataagttcactggaaatcactacatctaaactatcacaaaccgtgccaaaaaaataaaaaaggtcccgagcagtattgacctaatttttctcctgttttgctgacgtggtatacatggaccccacatgtaagtgagaaggaaaaaatatggggtccgcatatccttttttctcttctctttctcttctctttctcagcgagctggaaggctgggaggccgccgctggctgagggcagagcggcggcgggtggcactttgttgcgattcgcatcattccatgcaacggcacggccttagcctccatcatcccaacaccatgcatcagcgtagccttggccttggcggtagcgggagccgcgctggtcatcgtcgttggtggtggttgcggggacgtcagggtgcgcgaagacgctgaggtagacaacggatgcgagttagctcacgacggtggagaactcatggtcgccgaggggccgctccctatcgctgcagaggagcaggccgcaacatcggcacgccctcggcctcggcggcgggttcttcgtcgacctcctccgtcccatcccaacgcaagccgaggcggcgctgctgtggctgcggacgatgtcaacgtagacctcgacatctttgtgagagagctcgcgaaggtcggtagagctgttgtcacagaggatggcggtggcagcgatagctcccccgacgccatcccacggtggcagctcgctcgccgcccctgaccgctatgcaccagtctccagcctcgcccaagaagagaagaaaggagaagaaagaaaaaagaagagaaaagagatgcggaccccacatatttccttctcacttacatatggggcccatatattccacgttagcgaaaccgaagaagaattggatcgatactgctcgggacttttttttttttgcacggtttgtgatagttgagggctatagataacccgacgcgaagttgagggacggctgttgaacttattcctgcggataaggattactttgatgggctaaatcctatcgcgtgcgatacacggatctgatgtccttgcattttcagcccatttactatctagaagaggttgatgccttgatggcctttctctccccatggccacgatccgacgaaccctgttttcctaccacaaataggtcggatggccacagacgaattgtgacgatggttcgtggtagcatactatacgagtacacacgacgcatcaaggtagtggctatagagaggcacacgacaaaacgtcacagctatacaacaagagatggcaacaagcaacgccaatagatggcagagccgttgcctgctttttttttttctggccttggtgggagatgatacattagatacgacgagggaaaaaaaaaacaacaaacaagccaaccaacgaaagcgtaggaggctaggagccgttccgccactgaaagagcacggatgacgcactaaccggcggcggggcagacgtgacgctcgtattagcgacccggcacgcggcgccctcttgtccgcccagcgcgacaccgccctctgccctctcgcgagttacgtgaaagcgcccgcgggcctctcgcggtcgtccgttgaggtggcgtggaagccacgaacggtggaacgcgcgacagctcgcgctcttctccccccatcgtcgtccgttcctcgtcagcgtcgagggtcgcgctttcgtttactcacgcattccgacgaaccagccgttaacgacctcggcctcgacccttgtattccggatgatttaccttgctgccatcgctctttttgcgacctgattggagtaatacccggaccccaacggcaagaattgatagtttgaacagcatacagcaacagtcattggccaaaacctctcatcttttttgcttcctcgtactccgtttccgttctgggagaagcccagcgaaaatctcacaattgggccatgggccaggcagccagcgatatttacctgtccaaagcctacgcatccgcagcacaaccacccccagaatcccgtggaatcagtcgagattaggggcaaaaacgtgagaaaagccacccgtttcctcaccgcgacagctagacggccgcgcactacctgcctgcctcctagtagtgggggagcgcgcggcgcgccgtcgtataacctcgcgctgagagcggagcggaatcggaagatcccgaggggtcaagccacaaaagttcggcgccaaccgtgaggaagaaatctgagagcgccgggcaggcggagcagcataaactagaacggaggaagctcccgcggcggagaggaagcggcgtccatttgctgtccgcgaggtcgtgcctgatcggttcagatgggttcgtctgcggttcgctgcccgtcttcgtccagttcctgatcaggtatggtccttctcccccccgaagagatctgcttgtcgtcagatttcgattccactgcgactgggtggaatttgtgcgatttagtgtttcctattgagtgtaggcaactgatgatctgtcagaacgtagtctctgttaacatcaagtaggaattcgccactacttttatttttcagaatccaaatggggacatttcgtcgcaatccaatcgttcaacgtgtactttgatcgccgatatgtgcttcccgcatttttaggttgattgacagcattagggcatccgtccgatagtctgtctgggttggtgctgaagtcatataatgaaattgggggtgacatacctgtgatgtttgccggtggctcttataacagtactaaattaccgtgtagcatttgagattttaacatccatttggatttggattacatttcctgtgtaggtgtactaaaattcagtttgttctttctaatgacagctcttaacaggcagaggacttgggaatgcagaaagatgtgcttgcacgacaggaagttaatatttcgtgcaaacaagatcccagcttggatcaagccgatgttgctggaccttcatgtgaatgtgctgcatagtgataccgtgctgcttttccgtgttttgaagcatagtagattgaaggactccaagtttgttgatcatcacattgacgacgacggataacatctgctgcattcattacctatactttgtagatacttctatagaagtggtgtggtggtgtttgctcattttgttgtgttccaataacttgatatgatggatgggaggtcaatcttgatgggccgttatgaggttgggaagcaattaggacaaggaacatttgcaaaggtgtattatgcacgaaatcttactaccggccaagctgttgccataaagatgatcaacaaggataaggtcatgaaagttgggctaatggagcaaataaagagggagatttcaattatgagattggtgaaacatccaaatgttcttcagttatttgaggttatggctagcaagagcaagatttattttgttctggagtatgctaaaggtggtgagcttttcaacaaaattgctaaggagggaaagctcagtgaggattctgcgaggagatatttccaccaattgatcaatgcagttgactattgccatagtcgaggtgtttatcatcgtgacttaaagcctgaaaatctgctcctggatgagaatgaaaaccttaaagtctcagattttggtttaagtgccctggctgagtccaagaggcaagatggtctcctgcatactacatgtggaactccagcttatgttgctcctgaagttcttagcaggaaaggctatgatggtgcaaaggcagatgtatggtcttgtggagtaattttgtttgtgcttgtggctggttaccttcctttccatgatccaaatttgatagagatgtacagaaagatttgcagagcagacttcagatgccctcgttacttttctgctgagctgaaggatcttatacataaaatccttgattcagatccaagtactaggatttctatcccaaggataaagagaagtacttggtacagaaaaccagttgaaataaatgctaaaaacagtgaggcagccacaacaaacagcatctcttcaggtgtagctacaacctcaggttctgcagagtgcagcacttctgaggaaaatcaagggtccttaagcctcccaaacctgaatgcatttgacataatttctctctcaacagggtttaatctatctgggttttttgaggatacgcatggtcaccaggaagaacggtttaccactaggcagcctgtgacaacagtacttggaaagctgaaggaattggccaaacgcctgaaactaaaagttaagaagaaggataatggagttttgagattggcagcaccaaaggaaggaaagaagggctttcttgaacttgatgcagagatttttgaggtcaccccttcattcctcttagttgagttgaaaaagaccaacggggatactatggagtatcgaaagctggtcaaagaagatataaggccagcactcaaggatattgtttgggtgtggcaaggtgatgagcacctgaactcacaatctatcctgcaaggagagcagcagcagtccccattgccaccagagctaccacaggatcagttgcaaccatcattgccacaacaggagaagcaggacatgcctgaaccaccgttgttgccacaagtaccacaagaagaagtgcaaacatctatccccgcagaacaaacaaagaattagttttaacagccaactggtaattcaaatgttcttgtcatccatgtttgtatccttcttttatgtctttgctgcttgtttctaattcctctggaattgcaaagctgtacctgtttgtacagaagtgcaatgcacttcaattttggaaactacaaaggaacacctccgagtgttactcctgaattttcgaaagagaaacaatcattgatgagaagtattgaaccgtagaagtttttggtgatggggacgtctttggatttttccctcttcactgtgaacagttttggagttttggtctttggttttaatgagcgtattttaggtttgttgaaaattttgttgactggtccctttatttcttccttggatagccgtctactcgcttatgtctgtcatggactgttttcaataagaaatcaattcaacatttttgcaagtgaatccacataactagctttctttcttattctaggtggctgttctttgcaaaggagaatcgacattatattatttctatacgtagaagtgattataaatccgaggaagaaaacatactagtaggttttactgaaaatatccatgctttttgattgtttgagaaaatctcatgtggttttttaagaggttctgaacatcatacattcgcagtttttttatgtagcagaaacctttattacctcatgaagaaatctctacaatggtcagaatttcaaatacattttctatttagcatctagatttccatcatctatgtgaagcaggtcaacgcctcaacggggaatcacaatgaccattggttggtccattggttgatgatgaaacctttcaggtttcctgtgagctttcggagaagaccctgctcaagtctccccacaacagactagcattgtagtcaacggggatcccaactcttagaaaagctccggtaagccattacacaagatcattttagtgcacccatagacccactctctccttgctggcatcgacgggcgcagaagaactgattcgatctatatttgcaacatgagcggggaagtcgaattaggacagccgttgcgggtaattaccttgacctctcttttaagttccattcttgttgctccagtaaggaatgcctaggctacggacaatttagagactagatttcctataacaatggatattgctaatcagtatgttgtgaggtacaatttccattacagcatatcaatttcaccatgtaaatgccatgttttttctttgacttcccctgttgtgcttaatttggtggggaataagactgagccgttgtatgtaaggattatgaatccctaattgttggcatctcctgtcgatttcttgcactgtccgcagttgcgcatcgtctcaactcgctagtctaatgccttgctgaagttggttgaagacttgaatggattgccctttgttgatgtgctgactttccatgcattcccgtactgtttgcagcccccagattctgtaccaagtacaggaagagacgaggaagaagggtcgtcgcaccatggaaatggctcaggcgcagccagagagaacccagagaacccattgccggacctggcgctggcgaaatccgagtcagaccggataaaagccttttaccagacggtcctctcggccattgtcgtgttcatcgtggcggcgctgtcaggatacaaggacatgaagccgctctactcgaccacaaatcacaagaaagttcacctcagcaacctccttgtcatcgaggggttctgcatgattgctaccttcatatgcgcggctgttttgatgatgtacgagttctacacgtaccaccatgagatcgcccgcgaggtcgtcgcaggtgcagggacctcaccgtcctcatcgcggtcgccggagcgatgctggttgcgacggacacgatcctcgtcgtcatcgccaacagggacaacgcggtgttcgccgttcttttcgtgccggtgctgctgttagtcggcatggctgtgtacaccggagcatcgatggaggagcagccgccgaactcgccgcacgacggcgggtacgatgaggcaaccaaaagcacctttgatctggccaccgttagtacaatggctgcattgggtttgcaggggaccatcgtcttcggctacctgaaaacgcccgagaagaagagcgaacatgatgaccctccactggacctcgccgtctgctacatcgcctcgacggtctgcctgaccgtcatggcggtttgcgccatccgctggctcttctccccgaagaaaagcggaaggctctggtcggaatcatcggcagcctcaggcacgtcctgctcgcctctctggcgctgatggcggtggttgtctccgtcgagttcttggacggcttcgtcgtgctctccgtctggccggaggccgtcgcgctggtgctgtactacgcggcacagctctgctcggggcggcagcccgggggaggagtcgggagccggccatggatcgaatttgtcttccggattgtcgccaccgccgggttcacgctcatggccgggctgtacgcggcgttcctcgggaccaaccactacagcgtgtacctcaaggccgccatgctcgtgctcctgatggcagttctctcgagcctcagccgtctggcgaacccggtttacatgcccgagatcgacggagctctccttgagttctgcgtcgccggcgtggcgctcgccttccccgccgtgtcgcttctggttgcttgtcccttggtgcttaaggtcttcgttgacctatatattcatcatagttctctttgaaccaaggaggtgggtggaaccatggtactccctccagcccataatataaaggattttgagtttttgtttgaactgtttgaccgctcgtcttattcaaaaaattttagatttattatttattttttgtgacttactttattatccagagtattttaagcacaatttttcgggttttatatttacataaattttttaaataagatgagtggtcaaagagtgcaataaaaaactcaaaatcattatattatgggacggagggattaggttactaggtttggtgaggccgtgaggtttcccatctgcttgctgttcggacatagagcaaggataacattagcaagacatactccctccgtctcaaaatataataacttttagctctccggatttgtcccaaaatataacaacttttctagcaatattctcttcccactcaatcacaacccttcaccattcacttttcccacctatcttcactactcattcaatcacaaccctccaccattcacttctatctacttttttaataaccgtgtctaactctaaaatttcttatattctgggatggaggaagcaactaaaaatgtagagcgttgttctcatgtaataacaatctacatttgctccgtgatacatacattttaaatctattaacttattaaaggaacagaaaaaggagcatccatgttcgctctcacggcctagaaattatcatattaattgaagaaatagaaaaacagagtccatgtagaaatacaatttttaaatagttgaaattcggaattaaaaaataaggaatattgaaagaggagactagactccatatagaaatacaatttataaataactgaaattcggaattaaaaaataaagaatattagaagaagggtatagagtccatatagaaatacaattaagaaataatagaaatttggaattaaaaataagaaatacttatagaaatacaattaaaaaataatataaattcggaattaaaaataaggaatattagaaatagagtatagagtccatataggaatttaaaactaactaaaattcgaaataaacataataaaattaaaagtagagaatccatataagaataccatttagatgtaactgtaattcgaaattaaaaattaaagaatattgaaagatgagtttagagtccacatagaaatacaattagaaataataaaaattcagaattaaaaataaataatataggaagaagagcctagagtctatatagtaatacaatttacaaacaatgaaatttccgaattaaaaataagaaatattggaagacgagtctagaatccatataggaatacaatttagaaataactaaaatttgatattaaaaataattaataactatcacgtatatacaatacggtatgaatattacacaatggtagtttggtaaagttagtaaaaaatttaaaattatgtcatcattttaatatattttaataataaattgagaaaacatatatgctattatataatagaaaatataatcatgccagccgcgtaatctatgtgggccaccatgctagttcatgcatagtaagaaaaagagggttggctgacctcagggtgtccgtgtcgctcccaccctagggcgacactgacagggggcgacatggacggcgaccaaagatccgccgccacccatccttcctcctccttcggccttgcagccgcccgaaaggccaccggcaaagccgactggctccaaggactacgacgacggggcttcgtatttcccccgagggtgccattctggcaggtggttctgaggcgacccaagtggaagaggtggtgccgtcgcccagatccatgctctcctcggccggatccggtgaggagcagtgacacgatttggagcagcggcagaggtggccgctcatgctgctggatccggcgacaatagtttgcgtgggtcgacgcgatggtggagggtgctggcggcggggaagagggagcgaagtggaggcggctcctttggccgggtcaggagaggagccatggcagggaagagggtgtggaggcgacaagcccggatatcggcatgaaggggcacgactggcggtgggaggctggcgaggtgcatggagaacgtgacacaaaggctcatggctggcaagcgcgacgtggaagcgacgaggtcggcgtggaggaggcgatgaggtcggcatggaggctggagtggtgtggagcgtgctaaggtgggagcaccgcaaggctgggacagtgtggcggcgaggcttccccggtgggaggatgaaggcgacggcggtgcgaccaggcggcccgttgaagagacacgggtagcttggttgaggcggtgacgatggtagcaccatgaggtaggcgttgaatgctgttacgagctcctttccaggcgtcagtcttgttgtggcgatggctagccacattggacgggctagtgggaggagagaggatccatttttctctctcaccctctccctctataacccacccacaaggatggatctggagcacgccggaggttgagatgctactttgatggccaaccggcggcgaggcatcggcgcggtggcaagttgaaagggattagctggtggtgactgttgaatttgacagatacttaatcaatcgttagatttgttttggacgaccgatatgtacaacccccccccccccccccgcggggggtcccgcgcggcacagcgcccgcttctctggtctccgagtcttttacccctatgccgttaaaaagttgctgcttatctgtgtgccacaaaaaagtttagagtcacatgtatgccatgagcccaactttcgttgacccgtgtgccattttggatggatggagacataacgaggtgttaggggctgtgtaaagacagttttgtccttgtgtacaataacccatcggagccaccacttttcctcacccgggaaatcgccggcggcgagcccctcgtcctcctcctccggtgacccgcagcctcccgcgatgcgatccgtggcgaggctgctcgccgcgctccgtcgtgccccgccgcacccgatcctcctcctcctccccggccgtctcttctgcggcggcggcggcggagatccggcaatcccggtgctgccttccacgccgcgacgccccagcaacacatcgctaccatgccatcgccgtacaaaccgggggcgcatcgtggcacccccggagcaaacaccgccgccgccattttagccgccgccgttgcatagccgtcgtcgcccgccgctttgccgccgtctcccattgcttccaccgccgccgcacgacgccgtgccaccgcccgccgtcgtctctctctctctctctctctcttcctcccggccgcctccctcttttgcctccccggccgccgccgttccattcccggcgtcgacctccggccgctgtcaccgacaagcaccagccgccggggctcctccctctcctctgctcacgccctctctccttctccctgtgtgcaagaagaaagaagagatgaagaggaggattaaaggaggaatagagctgaaaatccttcaggggcaaattagtcattttccccacatgtcagagctatggaactgttaagttctaacagaaggtggacggaatggcacacgggtcaacgaaagtttttctcatgacatacaggtgactctaaacttttttgtggcacacatgtaagtagtaacttttttttaagttgcataggggtcttggttctccttctcctcgcgccgcctctactcactctggctcaccgcccccctggatctggttctcagaaggcagacgagagagcagacgagaggggggagagttgcggagcagcggaaaggggtcgccaatcacgaccctatcttcgatccgtacggcgacggtcatcgcgacccccgcgaattgctccgtcgcggcgtcatcccgtgaaccaggtgacactgaggtgaacttcccttctctctcttcctcccccgttgtccctctccctcccctcctgtctgccaacaacagaatcattggggttctgatccagggcattatcccgatatcaaggtgcatacctaggaaggatcatgatctaagtgggtttgttttacgcgtacttgatcagttcatatgatcgattgttattactagtagttcatgacttcacgagatcagatattctcgacatatcaactaattttataaacggcacacatattactgtattgttagggggactgctttatacatacagattattcattactttactggtctggtctagtctggtctggtctggtatatcatggtgctactgtttctgagcggggtctggtctggaaatgtgctagtacccgggactgataaattatgtcctagaacattaccagttgctgcaactgcatgaataactgccaatttgtagtgctcgtatattggcaaacaatgaacagaacgccgttaaactcgccagacaagagcgcaatacaatttgaatccatccaaaagtcagtctcacccaaactcctgggcatctcttgttagttgtttcttccattctgtttagccaagcttacttagtttctttcaattgtgcagatacatgctggtggggttgtgttgattgggtggattgcagtaaacatatcaccttagtatgtcagaaaagcaggagtccatggcaaagcttctgcctgacgatgtgcttacaatcatcctccgttgtcttgcgccacatgaccttgccatgtctcgctgtgtctgcaaactctggtgcaccatcatcgacactcatcgcatgctgcgtgtggacctcctcccacactcagtaggcggcatattcatcaactttcatgatctaggcttgtcagaattcttcgcccgcccctcgacaggccccacaatatctggcaacatcaactatttgcctctcacatccatagttaggggccactgcaatgggctcctcttgctttacagccatatcagtcgtcccggcatgaagcagttttatgtggttaacccggctacaagacagtgggtgcaattgcctccacctccaaggcctgatattgggatcatgcacttagacaatttgtaccttgcctttgaccccaccttgtcgtcacactttgaggtatttcaaatcccctatgttgatgtcttccgccatcgctctgagttgaatcctgcaatagagggaatagaatggccaccgtcaacatgcgttctgcatgttttctcaacaaggacaaggcaatgggaggagagatcatttgttcgagaaggggaggctgcaggatctttggctatcatacgacgagattttccaaattttctgcacaatgctgtctactgtcggggagtactttatgtacgctgtcaaaccaactttgtaatgaggtagtctcactgataagtattataatttatttctttattaacaaatagtatcactcaattttatcatgttttaatatttctaagttttccaatatttgcagaatatctttgtcagatggcaagtatcgaataattaaaccaccagtagagattgaacggtacgaggagtcaaatatttatatgggactatcacagaagagggtgtactgtacattctttgatgatccagacataatttatattcttgatgaatcgtacggaaaaatggagtgggtgcagaagaacgctattagctgtctggtcatacatgcatttcagcaaactgatgggccctggaccttacaagatataactatcatgaatatcctgatgcgtacggacatgacaacagtgaggcaatagaggaacaaaactttgattgggactctgacaatgataattttatcaacactacagacgaaagaaatttgcgctacggtagaattacttttctaggatttcacccttacaaggaagttgttttctcaagtcactcattgagccgaggactggcataccacttaaataccatgaagtttagaggctttggcaagattcaagacttgggcaatcttggcccaaaatattatggaggatgtatgggtatccaaccattcattgaagagtcttttctgtgcacaccttggatgggagagttcccaaaggacattaattaagatctcatcttgaagattactacacaatgaatatggcatattgccttactgtcattcaggacaagtatctcaagccatgaagtatcttttgatagcttgtatcgctgagcttctcgagttcttgtaatttatctgctgtcggaatattatgcaagttaagagtccattaattgacactgaacaaacatcaacactcagtaaggagtcattagatggtactaattacagagcacggtgcatggtgttacgatttgcaagagcttttgctgtgtgcaatgctatatgctttttgtaatgcaatgccagatgttccaaaccagttatgtttattttatgtgtgttactcccctgtcctaaagagattaccctctacattaatgttaagtactgcaaatctagatggactggtaatatttgtctctctctctctctatgtgtgtgtgtgtgtgtgtgataggccatatactgtggagcggcatgcttgtggcagatgaatagctaatagagtaatctgtgtgaaaagttccaacctttgacattatatgaagaaggttttgtataactgtaagttgtccgcacgttataaaccatacttaatcccctccaatcaaaggcgattgaggggaatactagttcaatttctcccccgattcgaggtgattattttgccaaacaaccccttgaaaatggcttgagagcgaagggccttgtgacaattgaggattttgtataactaaagtcgtccacattttacgaacagacaatgtttgactttttgagagcaaaatgatccttttatcccttcgtcagtttaactggaaatggttcgccgcgtgtccatgttctcggctctccccaaggaaaggctgtcactgcagaacagagtgtataatagccggccccatacggggcatttttggacgattgcttcacattgactctagtaagggtgtgaggtgagtcattagcacatgattaattaagtattaattattttaaacttcaaaaatggattaatatgattttttaaagcaacttttctatagaaattttttttgcaaaaaacacaccatttagtagttcgggaagcgtacgcgtgaaaaacaaaactatctttctctctttctgctgcgctcaaacgcagcctaaatatagtttgttaatatagaaacgaagattacttacttatctaagcagcgtaggctgattataaactgtatggcttattaggaaaaataataatttgtgagtaactttcatatatatatgttcttaatgattaatggtaatgctgaaaacacttagattaaaaatacatcaacgtcaagttctaaatttaaattcgatgaaaatatatcaaaattaagttttaaaaatttaaatttagtgctgattgcggaccttgtcgattgtttggagtttcaactttcacggaaacacaacgaagaggctagcaggaaggggaagccatcaggcaatagaaattttgtactccatttcaggttataaaatattttaacttggatcaaagtcaaactgttttaaatttaactaagtttacagacaaatataataatatttataatactaaattagtttcatcaaatcaataattaaatatattttcataataaatttgtctttggttaaaaatattacttttttttacaaacttggttaaacttaaaacagtttaactttaaccaaagtcaaaacgtcttataacctgaaacggaggtagacggaggtagtagtacttaagaggtacgaataggtaccaattttttttattgcaaatttggtatatcctattattgaggtaataaattttatataaaaaatactctaaaaatactccctcagtcccgtaatataagggattttaagctttttacttgcattgtttaaccactcatcttattcaaaaaattttagaattattatttattttttacttactttattattcaaagtattttaagtacaacttttcgtttttttatatttgcacaatttttttaataagacgagtggtcaaacagtgcaagcaaaaactcaaaattccttatattaatattatgggacggaggggacgggaggagtatgatacaatacactgtagaatcactcataaggtaaagggcctttgtcatttgctaattgcttgcagatgttccaaaaactactactactaacatagaagcaaacttaaattgcggctgcttgttttatcctgtggtgaaaattagctccgtttgaataactgaaggcgtatgctactctaaaaagactaaaaatgaatctgcaccatcctcccattgcagggcagagctagaacgagatgaggggtgccacctatttaattgagtaaattacacgagcgatccttaaacttgtaacgaacttttacttaggtccacgaacttgcaaaacatgcatcaagatccttaaacttagtttaatgtatcatcacggtccaaactctgatttgaccatggtcttacctatatggtatgccacgtggacgatgacatggctaaattttctttttccctttctttcttcccatcttttctctccttcctcacctcgcgtggagaaaaatgcagcagaagagagaggaaggaggcaaagtggagaaaaaaaagagataagaagggagaaaaaaagaaggaagaagggagaaaaaaataaaaaaatttcatatcatcgtctacggagcatgccacataggcaaaaccacggtcaaacaaggctttggaccgggatgatacattaaaccaagtttaaggatcttgatacgcgttttgcaagttcgtggacctaagtgaaacttcgttacaagtttaaggaccactggtgtaatttactctgctttatatcaagtttaagctaatacaggtgtttaaatttgtattgagggggtgcacatcagtggtggatttaggccatttctgcggggtcggctaaccccacaactttttaaaaatgtcctataaatctcaatttttatgtataaatccaaaagaatttagagaaatgaccccacttaaatacaaaccactagtaattgaccccacaggtttaaattcctggctccgccactgatgcacatatgataaaattaggttaggtatagctacaaacttttcttgaacggattcctggccacccccctcagtactcctgcctctgtccccatggcatgttacacctaaagacactattaatatcatatctaccttcgacatttttcactctcgcactctccatgatgcatttttttatccgtatttttcaattttataacggtgtaatgataatattgattcctagtagtttatattactgatcaagctttaacgtatagactatgaaaaaggaaaagttaacacacgacaacgacccattgagaacttttaaaacgaaattgccaagaagattagtggcaattgtttttctatgttgactagagtccagagagagtttagtcgtcccctgcatttccccatctcctcctctgagcaactatatcgagtttcgactaccatctcagcttcggtctcgtattctcgtggatcatcggaaagatgatctctacggaagaggactctgattcttttcaggtaaagagaagagatctcttttatcttgcttcgtgcttgttttgtttgtagctttgtaccaatcttttcgtccaatttcatggatctagaccaaaattttcgtgttcctaattagtttcttttcatgattgttttatgatgcaaatctaactgccatgtcaattgttttatcgttagtaaatttcttattgttcgcgtccgtgcttttgaagctaacagcatgatttttttttcgaacgcagctaacagcatgatttggctagtcctttaaaacatgtgtataaaaatcatatgtacatatattttgaacaaagtcacctcttgttaagagagattctaatgatataaattattttaagttatttgcttattagactctgccgagatgctgaagtaacttgcataaagccgataagtagagaaaggagtacagaaaaaaaaatcaagatctaaactctgttagcatggatcatggacctgtttgaaatactgtacagacaactctgacaaaattagttaaccagtagtacagctttcttttcttaggaaaacaactttcttttcagagagtttcatgtcttgttaccaatttctgtttgattccatctctgacatatattcagtgtgttgggacttcgagaccacagcaaaatactacttgggcagctttctaatagtactagatttagctaataagagaccatttgtggatctaatcgccttctgaaggcgattagctagttttactcgggagataaaacatggaaataactgagaaacataaagcctccgccggccattcccgttaaccatttccgctctttcttcttaatctgcctgtgggcaggcacgatgtggtgttcagacatcttcaacgacttcttcgtcggtgtatcgatgatgctttcttatgggtttagcatttaaagtgctaagatagaattgtcctcatagcctggaaaaatattctattgttctctcccggccccaaaactctgctaatctgttatggcaaagctgttggtttatgcctgaactctgatagcctgtaacccgttactcacttttcaatggaaaattcaggtggagaaactcttaccctcgagtgatttactcccaaaaaaaaatggaaataactagtgataattttttttaacccttcccaggatgacagcgaggaactgcaaatgcaggtgacaaagaagacgttgaagcgtgtcatatcactagccgaaaccttcatcgccatagcaaccggcatcctcgcggcagctttctcggcaggcaaagatgtccacctgcaccgccacgtcctggccgccggcggctgcttcctcgtcgtgacatacctgtccgctctcctgctcatctacatgaagctgttcttgtcagatcacaggcggctgcgccgatggcacgtccggtccctgcagctcctgtgcgtgaccagcggcgcgtcgctcgtcgccacgaactccctgctcctcgtcctcatcggcgaaggcaatggcttgctgtcgctcaacctgctgcccgtgcagggcatcgtcggcgtgctcgcgtaccacgcgacgccgacggaggggagcgcgcgcgacgaggcgttcgaggcgcaggtcaagagcgcccgcaaggtcgcgctgttcgcggcggccacggccttcgccgtgcagaccacgctcgtgtttggcgcgttcagcaacgccgccctgcaggcgatgggcggacgccggctggacctctcggtgtcgttcctggcgtcggcgctcagcgtgttcttggtcgtggcgacgtgcatgccgctcgggttcaggaaccagggcgccagggacaaggtgctgtccatcgtgaggtacctcaagaaaggcgtcatggccgtgctcgcggtcaccgcggtgactctcggccaggagttcctcggtggcgccgcggcgctcgcgctcttcccggagatcaccgtcgccgccatgtactacgccgtgagcatgcccgccgacgaggcggccgcggccgctgaccgcaagatggaggtgcttccgaccgtcgtcgtggcgacgttcggcttcgggatgctcggggcggcgtacgcggcgctgttcggcacgccggagtacgacctgtacaccaaggccctggcgttcaccctgctcaccgccgtcgtgtccagccttgggccgcgtggcggggccgctctgcaacgcccagcgtgacaagagctcggcggcgtgggtgacattcctcagcagcatcctccccatcgtggagatgctggtcgccgtcccgctcgccgccaaggtaatggttgattttctcgccgttcctggtaatggctgattttctcgccgtgcactcactagcacttgatgtcttgatcacttgtacaaattcttcgaacacgatacgtgcatactctgacacgcaccatgttgttgttgtactttactgactttgtacaatgtcatgtacttatagtagtggacctctcttggacaccctgaagagcacatattttttgtgtgattttgtctgaaatagtactgctaggagtagtatttgccgcagcagcattgcggagttgccaacgcctcgaaggtattcatgggcttattagattgatgggctgttttgtacagacaatcacggccccggttggctgtcagcctataactccatcagattgtgtggttttggtttaaaagaagagcaattttacaattcgaggtaccatgaggtaccatttttttattgtaaatttgatatctcttgatacctaggtactgtgaggtatcatgagtgaccaatttttacactaaatttttagtacctcatggtacctcctcaagtaccgtagaattactctcagaaggactcattttgatcggttgcaaacacgtagtctcgcagttaaaaaaaaaaccacgtagtctcgtgaaataagcctagaattgatcgagtcgagtacagttcattcagaggggaaaaataaaaggaagattacgatcgtcgattgggaccgaaattccgaacggaattgcaattgctgaggtttgttgacaggcgactgaactcaattcttgtccggtgtttccggctttccccacttccttgaggcacaactcagcccgccgtcaattccgagaacttatcaaatccatgatgaacaattgcgacgttcgctttcgagcgggcaggtccatggagtgtaacaatgagagaataaaaatcgacagtgtaaggcaggaaggcgacgcgttactgtgcacgatgcggacctcgaaacgctctagtacacagcacacgcaacgggccggagttgtagtgaagctcttttttttttccttaacgaacatagcgaagcttgagtatcagaacaaggcattttatacgcatggggatcacatgatgatattaaactacttgaccgacacagcgttcatccgtgaaattatcgcccaaaacgcaatgcctcgtccagccagtagtacatcggctctgggtttcttcattatagttcagttggatcgtcggtttcatctagacaagtatccgaagtaataatctgtcgcatcggtcaatgactatctgctactggctgatgcagggagcagagcatactctgctctcgcaacgtaccgattgacgtacatggcactcacagcaatgcagcatcgtgcagtggtcgatcgacatggtgaattggcgatcgggttggctcggctcggccgtgaagcaagcaagcgtacgtgagcacgacaagtgacagccaaccaccgaacacgatccgctatataagacgctgcatagtgcgcacaccttcaagctcgtacatgtacgcaccgcgacactgcgagtcctgcaagaagccaagccaagcacacgagcgcagcagcagcagcagcagcagctaagctagctagcttggagagatcatcggagatgcctcccaacgcggcggaggtggcgcggccgaagagcccgctccggggcatcctgccgcagagcccactccggatcaagcaggacggcaagttctacgagcggctcctcgccaaggagaggtcggcggcgagccgctccttccgccactactgggccgccgagcccggctcggtgccgttcgtctgggagtcgcagcctggcacgcccaaggtcgacgtgtcccggatggtcgccggcgcagtcccggccatcaccccgccgccgtcgtacctgctccggcacggcggcaaggctggcgcggcggcgccggcggcgccacgccgtcgtccgcaggggaagggcaaggcgaagacaggcggcaagacgcggtacaggttcaagcggatcaagatcggcttcctcgccggcatcttccggaggatcgccctcggccacgtgtggcggcggtcggcggcgtcggtccaggtctcgtcgttgtcaagccggtggctcttctcctcggcggccacggcgccggagaaggccgaacacctcgaccacgacacgcccgcgccaccgccaccgccaaggccgaacaccgagctgtccacccgggcgcgcgcgcgtccgagcctttggatgctgcgatttcgcggattccgaagctggagccgcgacgacggttgggcgtaggtcgctctcgacttctcgagtgtatacgtgcgtcatcatgggggattagaacgtgacaaatgaaatgtttatggttgcgagagatgttaacggttgtttgtatgcatgctgttgttgcctagcgtttcatggaaatcatcattaattacgcgttgattatgtttacggatgaaacccgacgtgttcggaacagttgatcatcttttgtcactagtttaacagggtgattaaaaggatcatacacaataatctgattagtacgcttggtattttctgtgataaattaattttattttcccatatggtctcagatatgtttggagatgtagcaaaggaaatgtttgatgtgttcgcttcggtttatcggagatgtgatcagtacggtacggttaaagattcttaattagctacaggccctagattgaaagaccaagaacggctatagagggggtgaatatagcaattcaaaattcacccttgaaaatactcatcaaaacgattttctcaaaattcttactagaatcgcagctattagaaaagccggacctagaaaagaagagagaaggaattcccgaaactagaagagagatgagaggaagatagcaaatctcatcattgcaaagttcaaatcgcaagcagaatttaaattgtagaatttaaatggacaaggcaaaaataaaatctttcaaatcatctcattcataggtgttgcaaaataaccgctcaattaggagcaaacatacaccttcatagaaacattaattcaaacttaaaaacctctcgggcaaacacactccaaactcacaccgaaactctctcaccgagcatcttaaaaggattacaaaaggagcaacctccacccttacatccatctctctatttatagcctaataccccctaagacattgtctcaaatacctcatacctctagggcgaaacccaccctggactcaatctcagccacttgcttttccttctcctcaaaggaatagctccagatcgctgccacgtagtcaatccgaactcctccacgctgcactcccttgcacgatccgcgtgctcctgctccaggccagtaacacgccgccacgtcgcgcctcagcacgcgagagcgcgcgctccaccgcgtgaatcccgcgctcatctgcacgcatccagtccgaagcctccacgcgtcccaccgagccgctcccacgcgcgctcgctaaatcgcacgtgggtcccacgcgtacggctcctgcctccgagccgtgcaaaacagcgtggaccccgtgcctgcgcgcgccgaattgcttgtcgccgcgtgtccgcgcatggtgccgatgccgtgggccgtcgtcttctcttgggcctgctcggcctggcctccctgccagccaagcactcgggcctagagctagggatgaaaacggagcggatacggatggataatgctcataccatattcgttttcatatttttttaccggatacgaaaacgaatacggatagctcgaatacggaaacaaatacggattatctcgaatacgaataagaatcgaatatgatcggacatgaatacggaaacaattttttctcagaacacgaaaaccaactcaacttctaatagaaacaaatatcaacatatataattagctcattttatataaaatgaggtataatttataaatattttttaaaatttaaataatattaatagtatggactagtgttaagagataaactactattaaaatctataaagatatattgaaggttatagagttagaaagatatggggtatgtctcatgggtcctgcggatatccgaatagcactgttcaccggatatccgaattattatccgtatccgatggaaaccctggtaccatattcgtattcatatccgggagaaaatatccgtattcgtatccatatccgaactatccgagaattatctgatccgaaaggtatccgtatccgtttttgtccagaacggacggaaactatccgcttagttttcatccctacctggagccaatcaggcgttggcttggcttccgtcccaacagagcccatgtgcaagctagctagccaatcagctagctgcacttgccatctcatgcacacgccagcgcatgcctgcatgctacagtacttagtactgtagctcctcttctattctccattttcttcgtgaacccggcacttgcacacttgaccttgtgaagcccgttgtgaagtcttcccgacacggtgttcgtccaccgtgcgtcaccttgatctcaaccttgtcacacggattcgtcgatcgttctggacctcaactccccctgagtctagtcccaatccgccgtctacccaggctgaccatcagggatcatgacgtcagtcccaccttgtcacatggcctcttgaccgtgctagacctctgctcctccctgagtatagtcccggtcctcgccattgaccgcggttgacttcgatcacctgcacacacgtaaatcaaatatccgattctgggcacagatatcgtaacctgacctacgttagtcataagcattgtcgcctaaaatcgccaacaatccaaaccaaatttcttactcaaaccaactcatggttaaatatttcgttgccaattttccatcacgaataaaccaaaatcacacttggttttacatagatcatgcatacgtcattagtccatgatacgtggttttgtcaggcttaaacgggcattatcaggttcgtgcgaacagaactaattccatcatgtaccataatccatttcgttatcttctgatggtaggtgattgctactagtagtactattttctagtactcctgctcgagatatcaatcaatagaaattaggtgcaagcctttagtgcaagactagtacatctctgaattctaatgcaccgataatagccatgcataggtgcagaccataccgtcctcttctcccaacccaaccgattgatctgacagtgctcttgcaacaaactcaaaatgttcagggtagttaacaacatgatctcctggctgtcagtatgcaggggatggtcctttttgctgacatgctctccatatgaccaaatcaacaagtataattcaagtctgcatattactagccagtaacttttgctgatggagtagtttatatgtagttatgtatagtactgatcagtattcagtactagtacagtagtaaagtttctatgatccgcctgtaagacacatcaaagagatcagaaaagagtacagattgaacaacctgctactctgctagtagtgctgcactctgctctgcaccgtcgccgacgtcgttctccagtccgctgttcactggatccaaaatgacgagtttcgctattgcattggtgcgagctgcgaactgcaacaccagacttatataaatggaaggccaacggcaaaatcactcgtgctgcgtgtaactgtgccgcctccaactgatcgtctggtagctgcccgtgggccgtggccaagtcgtgggaggccgtcgcgacgtcgccgtggggcattttcaaggtgagccgctacgcgttgaattatctagatcgatcggcacgacgcccgtacgggccaccgacggataatcggataggcaacggaagcaggatgatataatatggtatcttgaggtcagaaatatgattcctggtcagattaagttctccaagtaaggaattgaatatgtttgctcatgtatcgcaaatcagctagctggaatattatactggcatttgcttctcaactaaaggtttcaatattgaactaaatctctagattccacattttgtaaagctgtatcgatcaagaaccagatcaggtgctgatcacactagtttggtttatgggctgatcaggtgctgagttgccatcctgaaactagcctaacagtgaagtatagcatagggttataagtgtggccgcctctgtttcggcatttggttgttgagcttaattcgtgtaggtaccttgagactgtgtagaagttcaggcgaacagtacagggagggggccgtttggactgagtagggagttgcaagtctgcatgagcaatggcagcatggacacatgcatcgtccatgcgtggcggcgccgacgcccacgtacattttgtttggtggattggaacagcgacagcttcagaattacgtttcgctcaattgtacacagttcgtttcgatatatcttacactgtcaattagccggcttaaatacataattaaggaacgtgtccttcgcgtcaatgtactgagcagtgagcacgtacgcatcttgcaccttaaagtagaaccactagttagcaccttgcaccttacccccagtaaagaattacattttaatcacataaaagaaaaacaatgcttcctccgtttcacaatgtaaatcattctagcatttcccacatacatatctatctatattcattaacatcaatatatatatgggaaatattaaaatgacttacattgtgaaacggaggaagtacctactttgagaataatgtgggagaattactcggactcgaacaagactcaaccaaagactgttaagaacagaatacaggagaacctagggtataaaggcctagcaccagaaggaagatggaggaggaactgaacagaacaacaatctactcaaaccttgatgctcacaaatcccaccgcgatatccagccttcgatccatcaagagccaccggagccgagttttcatatgtccgaccaacatctcgttaaaattcctagcaagactagcacataggcttaggataggcacatatatcaataaaagtaataggcctacccaaaccaataggacgtagggttattatttcgagtaggccctaaacttgtataaaaatgccacgcgtcggactaccatacctcacacaagaaataagacacacaaacaagattcaggtcttataagtttctattgtcaggatttttatcaacaacagcttgagccacggtcaagctaggtttgcacaacataatctagcttagttagcatttgtttctccaaccaagcctagcaacttagtttgcaaaagtttaactaggtgtgctttttaaccatcgattcatctgttggcctacatcatgatgctatagctagtcataaaaaaatgtataaatcatctcctctttcctcctcatcgctccctcccgagctcagctgatgtggcagcgacggcagagttggcgctagagaagagaggagaggaggcagcggcaccaaatctagtgcagtgttggcgctcatgacttggcaggagacaagggctaccaggtgcagcctttggggaggaaatgagagacgacggagttgcattggggttcaagttcgacatggggagacccaacaagaagttggcaacccatggtgctcttcttctagaggatgaatacgtgattgtatggtggcttcttccgaaccgcgttggttggcaagaaggatgaagtagcaagcgacttttggcccgatacctatatatggccagcgtggttgggcgagacacaagtgctacaatgacgaggagctggataccagttgcattagagatagttatgtggctttgcctcttcaaattttacattttggagtgagatgcaagtccattgaagattgcctatgaatgcaattgacataatcaacctactgcagtaaaaagacactgctctattaatttgagaggcaaaataagcatcaacctatcgtcgtcctggctactatctagatctatatataaattgcacagtgaaagtttgttcgaagtataaaggtctacgaagctacttcctccatccaaaataaaaacatttctgaagttagacataggcatgaagaaagtatgtgtaaatgattaaaataaggttataattagttgagaaataaaaataagtgaggaaaataaatggagaatagttatggttggttgagatgaggggtgtagatggagaaatagttttattttgaaacaaattaaacttgagtggtagaaatatgttcattttgagactttgggcacctttgtatacatttatacgcctcaccataaaccattcatggctgggaatggtttatgaaccgatctcctgtagacgctaatgttatcagatctccgcatggatcatgaactactcgcacttataattaattttttttgcggggaattaattaattcgttcttgcccccgtcttctgtgtcaagaaatcaagatggtgaccatgacgggccctttaatttgccatgtgagcccgcgactgtgaccatctgattctgaatcaatttttgttggtctaatgccagtcgtatcccgtatccgtttgtaaatcactttcgacggaaatacaaatactactcaaaattcttcgacatttatattgcatttctagctggtatctaataggaaattagagaaaaaatcttacaaattttgaaccatcgatttaacttatgattcatacactaggccggctcctttaattaactcagacaactcgaccaactcacgtgaccctccgatagtaaagacaaagcgacgactctggttagggatttagatcaggctagggagggaggtagtgggtttagaaaagccaagtgatggaggctataggagagccgagagtggtgacatgttgatggcaccaccaaagccataaaatgaaagagggtggtggatagtaaaggtagtggggtagtcaagaaggcaatagtaggccacgagtacaaacggtacagccagtgacatccttgaggtcacatgctcgtgtgctgctagccgctactgcaagcaccaccacgacgtccctccagcatcgagctcaccagatccaggatgagcaacgatagagctaaggaggtggctacgagctcaaggaaggaggagcagtgagtgtcgccgatagtgtgggctctgaagaggacgacagtctcctcggtgaagaagccattggcgacgaagtggcggagcatgtcatcgagggaggagaagcgtgcgaaaaggtcaacctcccatgcgttggactagagtcgcggcagccaagcacaacatcataagcggcgcaacaagggacaacaacagagtcctacaccatgagcgacagcatgtcggtgcaggagatgacggcggggtaggcagtcttgacggcaccatgaatccctaataggcgccagggccaggatgaatcgactcggcatgagggccgtgacatcaccatcaaccccggccaccaaaactatggacacacctctacctccccaacctcgacagctgcggctgcaagaggaagttgatccccatcatcctgtacctccataacggtaggctcgtcattggctcggttgaggatgcgctcgagcacgagctcgccaaccgcctctacaccctggcacgcgtcctcgtgttgtccttcaattactgcctcgcgctagagcaccccatccctgcctgctacgatgacgcgtggtctacaccgcagtcgccgtttgccatcagagccacgagcgccgacccgaggtggtgggccttcgtcctcggtacaatgctgttgagaaagatggaaaagaggagtgaggagggggaagagaaagagtctctgattatgtgggtcccaccagtcatgtcagcaaataatgcttcccacaccatcaaaaaagttgattttttgcacccattttcgaagatgggagagacattatacccggttttgcggttgagggatgcgattcaatcaggaggaagaacgagggaggtaaatagacttattccttcaacccccagctcaaaattaagcggcctagcattggcacgacccagaaggccttcaacctgcactgagaaacaaaagagaagtactcatatagacaaaattaggcccagttcctatcgcaagaaacataccgaaaacatagcccaatacacatatcaagtctcaatgtgtactacctccatcccataataaattcatttttagtccctctaagttctcgcaaataagtttatttttaaataattattgtatcggagtttgtaaaagtatgaaataattacatcagaaatagataaagttgtattagaaataaataaagtgtagaataattacattgtgatttgataaggtagggtattttagtttttaaacttattttgggacagatggagtaaatgaatttgtatatatggttttgaaaacctctagaaataagaacgtgcatgtacgctcacctgaaaattttgtgcgctcacaccatgtgctacatttgtcttttctttcaagttatttattccacccatatatactggcaatactctctccgtacaaaaatataaacttattattaaataagatattttctagtacagtaaatctgaatagatactgggaaatattccatttaatattatgttgggttatttcggaagggagggagtacttgtcatcccgaaattggcagccaaactggtgagaaaatagcctggaattggacaaacattgctgtatgtctttcatccatccaaaaattacgtacgtgtgtaaagaaccattaagcactagctggcatcctgggtggcactgaaaaccgaagacgctagctgtaattttgtactccaggttgcgtagcagtaaggtagtcacacacaagagttaaaaatgcattggtccagtggttgcggcaggcttcgttttcaacagcatttcattcccttgacatgagcagaaacacccgcaggaacacgaggggagggctacagggcgccgagggccaggccaaccgatcgagtcaacctttcaacactcgccaacatttcttcccctcctgcccatttactcgctaccaattgtacaagctgcccatccccctcattactcccttgccttttaagcactctttccttccttacaattccaaactttacacttctataccctcttctctcctccggccctatctacaactctacatctcctcctcctttctttttgttcttgttgtccatctccatctcgtcatacacctcccaagcacgggagtatgcctcaatgtccacagagaggtaagtggccacctagaaatgatttcagttgaattctttaccttttgtcccctttttgtctcttggttctttttgaaattatgcttctctctttctgtttcttgatttttttctctaaagaatcggagaggttttctgttccttttgcttggaaggatagcatgtaccttttgtagttcgtggttaaaacttgaaatcttgcattgtggtttgcatctggtccctctcctgaatccatgcaagaaaccctaaaaaccttcttcggccctttccaatttccgccagggaaagactcgatgagatcggcaagaagatcaagcgagagccggacaccgccggcgtcgtagtcgccgccgtcgcaggcaccggcaccggtacagccacgccgatcgagcaccgcgtcccccatcgcctcggcctcggcggcgccgtgaacaccgtgaccccgtgcgccgcgtgcaagctcctccgccggcgctgcgcgcaggagtgccccttcgccccctacttctcgccgcacgagccccacaagttcgccgccgtccacaaggtcttcggcgccagcaacgtctccaagatgctcctggtacgataccattacaggtcaaagcattccttaaattgtacctttcgctagcttgtgcattaatggcttcgtcggtgcaatgcggtttcaggaggtcggcgaggcggagagagccgacgcggcgagcagcctggtgtacgaggcgaatctgcggctgcgcgaccccgtgtacggctgcatgggcgccatctcgatgctgcagcagcaggtgaacgcgctggaggccgagctggaagcggtcagggccgagatcttcaagcgcaggtaccggcaggccggcgccgccaccggcctcatggacgacgtccaagtccatatcaccgccggcttcgccgctcctcctcctcctccatcgatgcacgcgagggacgtggtgtcagtggcggacgccggcgggcaagggcaagagttggccggagcgccggtgatctcgtcggcgtctccgccggtgtatcctgccgggcagccatcaacaagtactactgactacagctccctcaacacaagtgagcatgctgcatactttggttgacttgcatggatttatctaacattttggtgtgatcacaattaagccggggaaaataagatctgtgtgcgagattagttatatatatgtttctctagaaatagatatagttgtggataccttgggtgaagaaaagaatttgtccaatggatgtatcaatccttaattttattgtattgtccattgtgattgggcggttgatttaattaattgagtgcgtgctaaatgatcgaattagctcaaggaagttttcttcggttccggaatgaagtagtggttgtagtaagtgaaattgaactaaaaaacacatctgcgtgtatatatgtacatatatagtccaagtgcaggttaatttcagagttagttatgcgtgtactgaataagatagatcgttttcgtcctacgtattttttcacgaattttacaatgattgatatgaatttgcgtgcaggctagaatgatctggtaccagagtacctgcagagcatgcgtgatccttgaactgattattactactagattggtgacgagacctaaaagaataggtcattcgctgatgtacacgtatatatagtgacatctccttggatattatttgcttgaatgcatcaactaattgattggttcttactattcgaaaaataagtcagcttgatacttacatagtcacgtcattgtcatttctcaacgttctagccttgttcacataatttggcaattgatcattgttctgaaataggttacactgtacaaatacatgcacagaacttatatgaaggaaacaggacaatgaaactactgtaggtcgatcatatatgcatgtccacattatataactgttactctcgcttgtgcaatgtagtatatcattcgatgtgctctgcacaatatccttttgtgtaagttcgtgtattttttttaaccagcagatcgtcgaaagatttctttttacatatccgtctcgtttaaacgaagcatttctttggtgcaaaccccctctctctctctctctctctctctctctctctctctctaagatgatgttgattggtgcattttttttaaatctggaaaagtgttttttgtcctcggatgccatctcatttctttcatgtcatctaaataattacaaaaagttttgaattttgttacaacatatattaaaacctactagatcggtccacaaatatacaagtttaaatcaacttttacaagttattaacaataataacatatataactacgaatatgtgtatatatactagttagagtttataattttgttgtttttttaacttgttgaaattgaatttgacattgcatgtttatggaatgatatatatcgtattaatatttcttgtcaatttgttttaaaacaatttgatagttatttatgtgacatgcaagggtattctcccgagggataaaaatccatctccttttagtagttttagtagttgtacgtgccatgttacactaccttttaactatttcatctaaaatttatcatttgcatataggacgcatgaatcatttgaagaaatctagtgggcgtgttttaaaatcttatgcacagtacaaagtgatagtacaaaacaaggctctgtatgggccgacatatcatttcttcacgtgctcttattttagtatttccctcaataatactatgaccctgttccgaagtctgaataccagggtattggtcatgtagaaatgataggacatttcctatgtaggccagattacttgttcttaatttgtagctcaatacttcttcagatgcatatgagttattctagttttgtattaaattaaactcatccaactcggcagagtttataaaaaaaataaaccaacatcaaatcagttttattaaatatactattaaagatatcttgatagtgcatttttttaagatattagcagaattttttactacataaactcggttaaagttaaaagaaagtttgtatagtacgtacaaaactaaaacaaacaaaaatgaggaatgcaaccttgttgcatgaaaattagtgattctttagtttttctgccctttaattgtatgccagaaagttgttgttgttttcatattttcttttgttattcctgcatatattagttgtgggttgatcggtagtctggtataacatggttcagacttccgatggacgaggaagctaccagtccatacacattacttcatgcacatactttcgagaccatttaatatcgttaatttgcctacatatattgtcctggtacgtagaaagcaatgtgggtgtgtgcaggcatatgctgaagtgatgtgagtcggctgttctatgcatagctatgccagcttctactagctaattgcattatattactaaaacccctgtaggactaggggcctttccttgacgtgcagtgtttgcagctagctcagctcgatcgtacttggttgagttccaagcaggcaaagtagacacacacccggcctcgtattaaaaactggagcaaccagcacggcctctccttccagcgtccatgtgtgcgagcgagagagagagagagacagagagagagagtcgttaatttgtttatttccaagctaaaatgggttgggttgggggagcttggcgtgtgggatgtgattgtgatggggatttggtccagcgtcgtgcttgcttgaggtggcgggcatccttgcttgcttgcttgtccgcactcaacaccaacgccgatgcttaaaagtcttcgctaacctcgaaaacccagcacgggatgcctactactcatgcatctccactgttcctgctcgtactactaccacatttgttgcactacatgttttttcatgtatacagtagagtatatggcctgttgcaacccaacacagtagttaggttgatcagtgttcaggctttcagattctggacctggaatttcagctgtgagctgaaaccggacagattacgcactgcgtgttaggtttaggtgtatgttcgcggctcactgcacatgcttcgacgactggcggtcggtcggcgccgcgacggtgcgtacaccgcaccgtttttttgtttgtataagagtgacgacggaataatgtaggagtactagcatagccgctccattgactagaggagttttgcatgccgactgcacaaatcttgaggtttagcacgtggtggtggcagcaatacgcgaccttgtcgatcgtaccactgtctggtgactgtgccggtgggagaaaaatgaccgagattgaaaaaccggactgctttttccagaccgatacataagtgatggagaccgattttttaaactaattcggtcaagcttttcgtgctacctgagttcaggtggtgtttggatcagggatttaactttagtctctgtatttagacattaatttagagtattaaatatagactacttacaaaactaattacataaataaaagctaatttgcgagacaaattttttaagcctaattaatcaataattagagaatatttattgtagcatcgcatatgctaattatggattaattaggctcaatagattcgtctcgtaaattagtccaaaattatagatgagttttattaatagtttacgtttaatattaataattagtgtctaaatattcgatgtgataaagacttaaaagttttagtcccatctaaacagggtcttattcggccataccttggttaaccaagatgactgaattgctattttatttgtcctaatatataacaacttagtattaaagtattaagtattagataacctagcattacttcattcatagtgctnnnnnnnnnnnnnnnnnnnnnnnnnnnnnnnnnnnnnnnnnnnnnnnnnnnnnnnnnnnnnnnnnnn

SEQ ID NO: 44018 - DNA, 59819 bp, Oryza sativa
  unsure (1)..(59819): unsure at all n locations
cccccaatccccctcctaacatgctcctctcccccctttctcctccccttcttctcttcctactacaccataaaattttaaaaattagaaaaatttatgtatagaaatacctatatatatatatatataatttgaatttaaatttaaaattgaatcggttatataaactttgggtctataaactttaaatatatagaaataccatgtattaaaaaaatatttgaattcaaattcaaaattgaatcggttatataaactttgggtctctaaactttaggtgtataaactttagatgtgtaaatttggggtgtacaaactttaggtgcatgaatttactaaaacaggaaagtaatgcggtaaaaaaaaagaaaccacgtggagaaggggtgattgcttggagcgatcgatcgtccattaggcttttcgctatttaattgctaaaacatgtatcatattattgggttgccaaaattttattgtaatttcttttattttgtgatctcctaacttcggtcatgatcagagaccaaaccatactaacgctctatttgttttcgcttaggattattataatctagattattagtaataataaaaaataaataggtaaattattatgatagattattgtaatctgtaagccagattagtataattggtaatctgttctaaacatatatttttcatattattgggtggctaaagagtcactgcctctattctactataatccattgaaacaaactcatagcttattataattcagtttataaatctggctaaataatctgtattataataatcttatacgatgagaaacaaacaggcccctaagccaaacccgaaaacgtcagatcgatccgcgcggtcagttaacagttaacccattcctttatcgggccacacggttttggccttctttttcattttaacaaaatttttttcatgggccagccccgggaggtacgaaggacatgatcacatgaggtccccgaaggggcatcagtgctactgctcggttagcctcgtcagttctggcagaatggtacgcgcgaattgaactggggctgaagctgggagcctgggacgacaggaattacgcgaatgaagagaaaaaaaaaacaggggaaacatcgtggcgttgctgccgctgcattgcatcagctcggccttccgaatatttttaaaaaatatatgttgagagtgggatttgaacccacgccctttcggaccagaaccttaatctggcgccttagaccaactcggccatctcaacaagtgaccacaggagagttgtcaaactttataatagtcgcatagcgagatgttagtgatattcggcccacacatcgccgtgggcctgtaaggccgcgtgtggggacaagtgggctaaagtgcaaggtgggccaagcgtggtaaggcatgtcgagggaaatctttatatactctccattatacaagaaaagaaaaaagagaagtgcacgttcactgaattgtcaagcaggataacacaggacagcatgtaagtatttagggtatgtaagtaatttagtacttaagttttatatttaagttatttgacttttttctaattaaactttaagtttgactaaatttatagaaaatgtagtaacgtttttaacccaaaacaaacatactatcaaaactatattcaatgttatatttaatgaaactaatttagtcttattgatgtttttaaattttttaaacttgatctacaggaaaaaaaagtcaaagtggcttataatatgaaatgggtaactacttcatttagtaataaggaagatacaaccatcatcagtctttgcatgattttctgaaaatggtttgataagaaaaaataaaaatgaaaaatcttggaccgctacaaaattacctatatcatgagtctatagcctcctctccaccctagtattgtctccagtctcaaactgtgtcattgccgacaagtataatttttgttttaaccatcaataaattttaaattgatctatttaaatgattagatcggtgatatacgaaagtttcattactatatttagcttacaacacacttcattaatatgaaatactttaaatatttatatattttctgtaaaaaagatgagtaataaaaaaataaagataaataatatccagtgataagcatttgaaggcagagcatatgttgcacacttgcacacattgaggtacagacgttcgtgcccctaatttggcacttcaacaaaggattcagtatttcctctccatactggggccttctaaccaatcggctacactggaccatggcttagcttaattagctgtctgttggacccaaaaaaaacagcccaaatagtaacggggcaagatttttgtctccagcgacaggtgtctacttcgcattagcaaattaatggtccgaggcgacctacaaatccacgttcattaaagaaagaaaactctctcgtgtcaaaaagaaacaaattaatataagagagcaaaaaatctcctgtcacctcacccggagatcctaagcacatcaagccatgatcaaaagatagcatgcaactaaacgcttcagaaagtatgagacctgttttctctgaccagaagcagctagcctgctggctgctgcgctgtatcctgtctagctagcactgtgtttcattcttgaatcgagatcgccagttttggagatatactggaacggataaggtttgcttagtgcattctcttttctttccacaagtgtatcagctctcactaatcccttttctcaaatatctggacaatctcatcactatctgtatgatcagcacattgccctctgtgctccaatctctttcagaaaaaaacaacctttattttttcagaaatctgttatacgtaaatacgcatatagcggctaggatatactccgtacttgccactacactgccaacagctttgagatatactccacaatgtctcgcgtacaaaattcgcatcgtctcggtgaagtcatgtgcattggccgagaggtcttggcgctctgcatgctctacaagtggtgtcgtcgctagctcgacggataatgtgaacgaatggatgacgtagactgtctatgtacggtcgtagtattatactactgctgagaatgaaaaagaaaatagtatatgcctttttggtcttctagaagagtactctatatcttatcattagcactatgtctcttccacttaaggtttcatggtggagccaagtaggcttattactagtactctcacagaggtgcagcagaggagtttagccagttacagtctatgactgggaaaggagagtcaaatgcaaccctgccgataattttgtggagacagcacttggatcttaaaaaatgaccaccaccatcaatttttatttcgttaaagtaaaaacactgatatatcagcacactgcatcacacaagcatcagcgtgatgcatacataagtaacataatcatgacctcttccagctggatcagtcacctagctaacttatttagcaaagattaagacccaaaagggaatatccaagaatggttgggatgagatggtgtttgatgtaaaatggaaataaatttaaatagggtaattaaatggataagtagtaatatgaatagtgctaaaattgtttatatttagatacaaattttaaatgttagtagtgatcatattttgaaaaagagggatttctttttagataatgggactaaagccggcttttgctacaacgaagctataaccaattattataatattctctcaaaaaggcaaacacttaattaagcaaaaaaataacttaaataataaagccaacacataagaagtaaactattattgaagtatatttgtgaatctccatctatagttgttgaaaatctgtatgattttaacttctaagtttcgacacgtagaatatatgagcttcttgttctctttacacttttgtgagaaggagggataaggtactgtatacatgtatgacctctgtccattgatacccaagcaaagctggttcacggttgcaggaagcaacatgagtacacggctgcatatatggcatccaggatggctgcaatcaaggccttgtttaggaacgtctgcttcgactgctcagctcgttgatgtgctctcaactgggccaacgcgcgctccggcacgctagctagctgccagatcagttaagatcgaagtgagtgaagacgcgcacacgtgaacactccattagctagtacgcccgccactgtgcgagccctgttctcttgtgacttgtcagtatggctagcagcttgtgatagatctctcgatcgctttctccccgttttattttgcttgtttttttttcttcccaaatgatttactagcaatgcatgacgtaacgatgacgtgagagtagcgtcagcctgcacgaccactgtcggagcacgtccgcatccgatttattcggcattcagtgtttcgcctaaatgcttgacccggtgacagccaaggagccagcggcacacgtaccagcagattgcactgtgcgatggccttgattgcccatcgccgtcacgaaactccgtcgcctttgcgaactaattattctctcctcctagctgtgcctttgctgctgcggttcgtaccggagtcggacgacggggaagatcgcagtttgctcatttgttggtaagctttcccgtgccttccgctacagatcaatagaacgtatatgtgatgaccaccagccaaaaattagcttttcttcatgccttccactgcagatcgaacgtatatgtggtaaccaccaaccaaaaattccttgtacgttcggcctccccgaactccaccgaggcaccaaccaaggatactgtacgtactaccagcctactagcagggtaccgatgctttgccaccaacggcacggctaggtcgcacggctaatctacttatctacgcactaatatgacgaccccccggcccgcgcggccgtccaagaggacggccagagccgcgcgaccgcgtgccctccccagcgtgcagcgccggccgggcggcgcatggggtggctgggtgacggcagaaacacaataattgcggcgcgttttgccgttttgctcctgtcgcgcggatatatatcggatgggccggttaaagtggtctttcgcgtcgcgggcgttgctttcgtccgcccccgcgcgtcgtcccgatcgatcggccccgcactgtatcgcgcattatcacggccggggcgggctcgctcgctcgcgtacggtcggtgttgcacttcttgcaggtagtgcctcgcgagatcggagatggtgagtgctcgcgagcgatcgagctccatgtatctgcccgtgtcgcttcgtttcctcttcgttggtcgttgctttcgctttccctttttgtcccgtaggtgatcggagttcataccagctttccttggcatgtactcatgcacgtctctttcccctcttcacgcgcacatgcggttagcgaaaggggcatagcatttccattgatgtatccagccactacgctatgtcttccgttgcatatgcagttgtagtactctcaagctctcctgatcgactccttttcatataggattctttaccggccggtaaacataaagcgcgagcgcgcatgcaccgccacagccaggccgtttcatccatacaatctcgcatgaaaagccagtcgtcgtcgatcacttcagaattcagattagtgaattattctacgtgcgtgctggataaagagagaaacgggagaagatcgatcaacgaccgatccacgatcacaattcgcaaaccttaggtacgtagctaggcggcctatcctacactgtaaatggttgaagcgttcactcaatcgctcatcatccgctaacacaaacaacattaactaactggctaaggctaataaagcgaagcgtgtgtggtcaggtactaacttaggcgccacccgtgccgtgccgtccctttccccctcgtaccaccgacggatgccaggctcccctcctcggcgtgccgtgcctttggcttttcttctctgatgtactttggatcgatcagggagagagccggtggaccacctcggccgacctctgtgatcgagccgttgtgagagaaaagattgaagggctatgccacacgacggcagaggatggatggatgaatcgaacatgcgcgagatcgaggtgagatcatcaacgagactgcatgcgccgtgcatgtcgtacacgccgagggtccctgccgtatacatccaggtgtaccgattccgttggatcccatcgttttagtacgtgcgatgcaggccggcaccacagtcgacaagacgcggccagtgtcgtgcccatgacaccggcctgcaatcctgcgctcggcagagctgttgctacagctagctcagagtgattaggacagtaaacgcagctaacgctgcccatgcgaagattttctagccccatgctgctctgctccacacgtactcctacaatgcagacacgcagttgccaggccggcatcgtccaagcaccggtgatgcaactaccactattactactacggcagtttggatctaaactttagtcctttttcatcacatcaacctgtcatacacacataacttttcagtcacatcatctttaatttcaatcaaaatctaaactttgcacgaaactaaacacagcctacttctatctctcggttcaaggacatgcaagtcttgccttcatgagtacctggctgaacgttactcctgctcccttgtctcacatataaaagccaatcctaacattctaagataaaaatagtagaaaaaaaataaccaaaatacctctattattgagtaatggtgatagatagataaatagtattgaaggaataaaacttatcattttatgtgttgatagtagatacgatggtagaagttgatcttttgtgggacaaaattcaaattttagaagttgagttttttttagacggagggaatagaacagtgagtttagtcgccaaagcatctacgactacgtaaaactatccgtactctctgtgccttcggtctcgatgctgtaattgtagagggccgtgatcttgattttcgttatatttcgggaccctgttaaataatttcctgtcacgacaaattcaacccgagaaggaagaaatagcctagctatctcaccacgccgagagatccggacgtcgctggtagcaaaacctgattcaaatttcttctccaaagtgacgtctcggattcatccagccgcaaaattttgcatcagctgatggggcccgaaagggatcgattgatcgatggggctcgagtgaaaacgagcggacgattattttgcatcagctgatgtgatcgtgtgaggcttcggccgtggccaacacgagcatgctgtctggtacatgggaaagttgtgatacattgttcattcttgagatattgaatgtagtaatagtacatggctagctttgggaatgctgaggtcagattagtccatccatcgccaattgtctttttcatgtccagagaaataattcacacaagatgatttcgtcacgaatcagaaatccgtttacatgtcccattgtcatgtgatggccagtgtgtacacatttcaaaatcactattaactttttgaattatttatttatttgaaatggaccgaaggttaaattcattataactgttcggtcattttaagctaagttcaacaaaacatttgctttttagtagttctttatctatctgtgaagcctctttatgacgcattggataacaattaatataactgaattagtatagaaaatactccctcattttaaaaacataagaatttctaggttatattgaaaatactaaggttagaacaaaagatttatttttagtcacttcaattatcaatttctaaaattttgaattgcttaaattccctttccaagcatttaatcagcactggaatcatctacctattatattattaagatagctcgaaaaaagagccaccatgctcgctctataggttagaagttccaaattaattagagaaaaagaaaaaataaccgttagactatggtgggtccggattataatggtatagatttattgatatagttgtatgaaaatataattatatatataaatataaatagaagttaagagttgtatatgaaatataagtctatatgaataaagtctaagagttatatatgaaatttatgttatagaaatagaacctaagaattgtatataaaattcaaatatacttctacatataataatacttatgtataaataaaatgtaagagttgtctatgaaatttagaccttataaaaacaaaagttaagagtcgtatataaaatccaaatatacttctacatttctatggtacctatagaaataaaatatcagcattgtatattaaatctaactccacgttaattacctagtgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccctttaggaagtctgcgccacgtatatgggataagtgagcacagctgtgctcacctaacagcatttattgcagtctggtcaagcgtgtcgcgctgcatgcagtgcagcacggcgcgtccctttatccggtctgtgaccagtcacagaccggtcagatcacgggttaggtggcgactggcggtctgacgcacgccatgccccatcccgtcaagacgaaagcctctaggcactcgtctcaagccggcgttaagcgtgttatctcttagagatgacacgttagacccggtcgatatatgccaggcttcatcctaaccattacaggcaagatgttgtgtgagaagggcaaacatgcacgttgccaagataacacgcggtggacaagaatgcccgatttgtgatcggtctgacactgatcatatttttagcgcacagccatgttcccacgacgcgctcacccctggcggaagtggaggtaggtgtgggctgtcccatcggagcgtcattcggacagcaaccgtgctgatcttcgcccgttcaagagaaaaagaacagtccagtttggaaagagaagggtgcatgtggtatccccttgaagtataaaaggaggaccttgcccatagaggtggggggattttttttggttctttcccagattaggagcttagaacgggggagaagacagctcacacttgtagctcattcatacacagatccaccaaaacacaggagtagggtattacgcttctgagcggcccgaacctgtatagatcgccggtgtctcgtgttttctggctggcagacgatatttccacatacagagagagcgagagcttgagatttcaccctaagcccccggccgaactggcaaaggggggcctgcgcggtctcccggtgaggagccacgagctccgtcatctggcgcgccaggtagggggctcagcgtgtgctttctgagctctcagactcttccgtgtgccccaagtttttcttgttcagcctaatggccgagcaaggaaaaacgcacgacctctcgccgagtgtgagcggcgacgacggggagccgaatccacgccgtcgagctcgtactcctccacctcctccgcgccaaagccctaagcagggggaggcgcttgagagggtcgacaagtccgcggcgtcaccggccgcaggtgatgcaggagaacggcgagacggggagcatcgcctcctcgtctacggcgacggcagtacgcctcagggtgcgcttcaagctgctggcgcgctcctacgacacccgcctgtcgtccatgacccggagtctccagcccaacgatggctggaagacgtggccaacttggtcatgacggcacagcagcgcctgggtgctggtggacggtccgccaccaccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggcgtaatagccggcgtactccccgtgcaacggagggagcctcctcgtccagagtgtcacctcgacatggacgtgaagatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggattgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaacactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagtggcagcttcggccgcccccggatccgccgctcagacagggcggcgtgataggaggaggaagaagaggtcggaccgttccggcgacgagggtcatgtcctcgccgtcgagggcgctccgcgggccacccgaaaggggaggcctgcgagcgacaaaaagaaagaggccggaactcccggcagggagcgctccgccggcaggtggtgctccgtccacaacacctccctccacgatctcgcggactgtcgtgcagtcaaaaacctggctgagcgaacgaggaagtgggaggaggacaagaggcaggaacgccgtgagggcaagtccccggtggttccatccggcaaacggcgaggtgaggccaagcagaaggcccccgctgttgacatcaatgatggtgatgatgacctaggtttccaagaacctggggccaccattgccaccgtcgatggaggagcgtgtgctcacgtctctcgccggagcttcaaggctatgaaacgagagcttctggccatggcccctacccatgaggcgatgcgtcgggcgcggtggtcggaggtcgctctcactttcgaccagactgaccacccaccgtgcattgcccggggagggcaggttgcgatggtggtttcccccaccatctgcaacatgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacattgacctaccggtcaccttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccccggtggccccatctctgtccgtggcgaccttaaagtcgcgcttgcttgcattgagcagcgcgcggaccgcctcgctgctgcgtccaagcccgagggtggtgacgagaggcttggcccctctgcccccaccgccccgaggcagcggatggccacttgcgacgaggccccggtcaaggaggttgccttgggcgacggcccatccaggaccacacggatcggtggtcttctggatggcaaataggaagacgcgctcgtctccttcctgcgggcaaacgctgacgtcttcgcatggagaccagctgacatgcccggggtccccagggaggtgattgagcaccgtctcgccgtgcggccgggcgcaaggccggtccggcagaaagtgcggcggcaagccccggaacgtcaagccttcatccgcgaggaggtggctagacttttggaggccgggttcattcgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcctttcgggttaaaaaatgcaggtcctacttttcagcgtactactcgaatttctttgggtagtcaaataggacgtaatgttgaggcgtatgtcgatgacttggttgtaaaaacgcgcaaccaagagaccttactttcagatctagcggaaacttttgagaatctccgctccgcccgcataaaactgaaccccgataagtgtgtgtttggtgtacctgcgggcaagcttctcgggttcttggtctctgcccgaggcattgaggccaaccccgagaaaattcaagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatctcagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggcctaaggcccccgacgaccggagtcggccctccacccgcttgtcaaacggtgctgggtgcccccgaccctcaggaaggccccgaggccactgagggaaggctgcacttaaagccctttggccccgaggctaaccctgtgctgactcgacccgggaaagagcagggagaagaggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcggaagacgagtgtgccccgaggggccacttggacgaagaacgccccgggggtacggcccctagcgaggaggatcggccccgccgaaaggtgcaacggcctgtctactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatacccgaggccagcacggacccctcacagctgcctcaaaccgcccactgggtgatgcagttcgacggttctctgtctcttcagggcgccggtgcaggggtcacgttgatctctccgaacggagacgtcctcagatatttggtccgtctcgacttccgagcgactaacaatatggcagagtacgagggactccttgccggactcagagtggcggctggactggggatccgccgcctcttggtattaggcgactcccagctagtcgttaaccaggtctgcaaggagtaccggtgctctgacccacagatggacgcctacgtacgccaagtgcggcgtatggagcgccatttcgacgggatagagcttcggcatgtacccagaagggacaacatgatagccgacgaactctcaaggctcgcgtcctcgcgagcccagaccccaccgggcgcctttgaagaaaggcttacccagccgtcggcgcgacccgacccctcaggggagacggatgcgcctgaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctggtagaagggaccctctgtcgcgtcccaaatcgactctaaaatctatcctcaaaattgtgcaaaagaataagtaaaattcaatgtgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttaaaaaggtttataaaaagaaaaaccctaaaaagaagtctgttccccccccccttttccctcttgggccggctcggcccattccctccctctctctctctctctccccccggcccatcggctccccgcgcgcgcgcgcgccgctgacaggcgggcccgcccgccactctcgctgacgggtgggtcccacctgtcatccccaaccccgcgccgcgcccgccgccgcgtccgtgccctagcgccgccgccgccgcgaatcccgccgctcccgtccactccgcgtgcaatcaagaggggggatttactccccgcgatctcctcccccgtttccccctctttcccctctctctctccctcggattcgttcgaatcaatcccgcgaagttcgccggcgcatctatggcggccgagatttccgcgcgccgtttcctctctccccggccgcgctctccccctctcgtcgctataaaaacgttgcccgtgctctcctcctccgtttccgccgttcgccgctcgctctcgccgtcggaatcgtgctagcgccgtgctcctctctctccgccgtcgccgtcgaccgtcggttcgccgccgccgtcgctccgctcttcctcccggctcggcgacccctccttcggcatcgccgcatcgccgccgaccccgtccgccgctccgcttcgtccgccgaccgccggagcaccgtcgtcgtcgtcatcccgagccgcgccgccaccttcttcctctccgtccgccgttctcgtcgtcgccgttgtctcggggtgagccgaagaccgccgttcgccttcccccttccctcctctctctcgggtgccactccgccgcgccgttggtcgccggcggcgaccatcggggcgctggtgcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataaacatgatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgtcggtcgtgtagacgctgcagcttcggaagatccgctcttcgttgaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagacaaacaaaaccccaactagtggacactctctactcatagtaccactagtataattctaggtagatgcttcgcaagttaattaggcaacattaggtggttttacaactctagacttgggaaattctcatatcatttggacaccatggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacagattggagatggatgaagtcgggggtcgatggacattctccagggcaaatgaaggctacacgagctgcggcccggtagtcgagatgtcatacggcggagggttggtgcccaatgccaggggctcagttccgtctgcctgtcccgggggtcccggccgtaggcggaattgggtcggtactcttgtctaaggctaggatgggttggaaactatgtcacgtctttcgtctgtataccgtggtggtatgtggcacgtggttacacgtgaggaagatgtgtcttgtgggtaaagatgtacacctctgatcagagtaaatctattcgaatagccgagccctcggatatgggcaagcctagcaatgtacccaagtcagtgttataattcttaaaatttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataacattgtttagttctaggatcgtgtttacaactagctttgagcaactaaattcctttaaatgctgtttactgcaactctaaccccttatgttataattcccttgtactcccttgcatttattttgcatttgtgggtgtgtcttgttgagtacggtggttgtactcagtcttgcttaattttcccaagcccagatgaggagttccctgaagatgaaggcttcggtgtctagctcgtgcctgccgtcaagtgcctgtggtcgtcgccctagtcttccgctgtttttcgttgtctttgagtgtgctgggccttcgttgcccatgtaataattatatttacgcttccgcttgttaaactctgaattgtatcaacttttggtgtaccttgcctcctgggacaaggaataatacacgcacgtcaggaacgcctgttgggtgatttccggtcgtgacaccctctatcggcgcgcggctaatggaatcctcctgaagtgcattccacaggaacaaggcgttgagcttcttgctgacatccatgagggcgagtgcggagcccattctgcctcgcgcaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgagctcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccgatgtgggagggtccgtatcgagtgatcggtgtcccccggccgggctcggtacggctggccacgggcgacggcacggagctgccaaacccgtggaacatcgaacaccttcgtcgcttctacccctgaaggggggggtcgggtgtcaggttttggctcgggctaaccccgcacccccccctcgggtgtgcagggttagccgggggctaccacacatgcacatatattcctttcagcatttcaatagaagcagtttcaatttcctaaaggttgtgtctgtgccgttttttccttttgaagaatcttgacttgaaataatgtcactcgtgctcaaccttgtcctcgggggctcggttcggtcagctaaaatcgccaaacggggcccagaaccgagccgtgccccggggcgtggtgaactccggggggggatcggcaaaaacccacaatcgggtcacccatacccctcggtcaccacgttcccggcctggccagtctcgacatgcggatctccccaggcactagccccgacccgagccattcgaggaccgggacttgggcgtgagcccttatttcaagctaaggcgcaaaaggaccatggcacagatcatcctcaactcatatatatagcaaaataaaattaacacaaaaatttttcatcatttctcattgcagattaagtcagattgtacaaaaaagaggcatgaaggccttagaagaaagaacaagaaaaaaaagttaagagtggcgggggcctgggggctcattcatatgcgcccgggtcgccggcctcgtcgccaccgccgtcctcgctgctggtgtcgccttcctcgtcggagctgggggcgaacgcgagccgaggggctgagccctcgaagccgttgacgatgtggtcagcagcatccccgacccgcgcgcgcgcctcgtcctcggtcccgggagggaactcctccagcgccatccatggggagaagttgggatcccgggcctggtaactcgccagcacgagttcgaccgccccccgggcgaggtccctcgaggatgccttaatggtcttctcgagctcctcggggagtcgctcgagaacccaagccatcctgttgaggtgcggagcgaggccttccagattggtggggggcaccgtcgtctggcctccccagaggcctgcttgccgaccggcgcgcttcatgcgggagaccgcgtcccaaagcatgccgggcccaatctcgcccgccaagcgaagggcctcgacctccccggtggaagagtccagcgcgcgctgcatgtcggcgacggtgtgttcggcagccgcgaggcgagcggctaagtcgctttcgcccgcagccgccccaccgatgcgcgcccccgcggccagctctttctcccgtgcctcgaggttggcagcccgctgctccagcgcggttctctcggcgcggacgctttcaaggttgcggcgcgcctgctcctcttgcgccgcctcgcggagggagaggctgtccgccagccgtcgcgtcgtggcctcggcctcctcgagagcccgctcccgctcggcgagtgcatcctcgcgaaggcggagcgcggactcctcctcggcgcaggcggcctcgtgcgccgccagcgtcgcctcccggagagcagtggcggcctcacggtccatcaagcccctctccacggcgccggcatgttcttccagcgccatggcacgggcctcaagggcctcctcgcgccgccgggacgccgcttcggcttccgttgcccgccgctctcgggcggcagcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctcccgggcgatctccgccagcgccgccttgcgggcttcgagctccgagatgtggcggcggtgagccttacggcccacctccaccatggctccaccgagcgccgcccctcctcgacgcgcgcccatgcggcctcgagctccgctcgttccgctcgcaaggcctccacctgggcgctaaatccgtctagtaccgcggtgtttgcggcggccaaggcctgcataatgggctcggcgctcaccggggcgatggaagaggaggagaaaagccgccttggagaaaaagcgacgcggcttggccccccggaggatacgctgagctcggggatgtcccccgggcccgtttggtcctgggcgtcgcccggtgaggtaggcccaggcgacgcgcccgcggcctcgtcgcgagccgcctcggaggatgtcgcctgagggccgcccgagggagtgggcccgagtgacgcgccagcagcagctgccgcctcagcctggcgagcccgggcggcctcctcctgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcgaactggccggacttggggtggcgggaggaatgcgacgggacgtctctgaagcagaagaaaaagccagaagacgaacaaagtgagcaagaaaaaacttctttttggagaaagatggttgcaatgagagtaagacgaacctgcgagggggtcggttgaatgaccaccttgggggggaaattaggtttccccgggctggttccgtctcccccatcttgcggagccgcttcttcttgcgctccccctcgggctgagacgtcggcgcggccccctccgggcgccggccgctggtacgcaccgccccgccccctcgggggggagatgggggaggtgttcctcccagcttcctcttccccggggcgtcggcagggcggctgctccccgagcccccgacgcggggcccagaagcacgaccccctcccggggcagattgtttcccccggcggcgctcgcccgcgccgtcgttgcccttaggggctctctcctctgaggccccgacccccagcataatggatagaatggagacacggtcgggatcgatgcagagggggaggatctcctgaggaaggtgagacgcctccgcggagctaaggttcagcaccctttggaccacgatcttgaagtcctcgggagcccaatcccatctggctccctgatgggtccgcatgtagtcttcaggcccagtgtactcccaggcgctccgggcgcgccgttggagcggcgcaatccggcgacggaggtaatcgccgaataccatggccccggtgagcccctgggatcgcaggcccgccaggcggtcgaggacggcgtcgtactcctcccccagatctaccggcgcccgccagctggagacctgcgccgggggctggctcggaagtcggaggcgcgcttcgtcggcaaggggggtgtagaaccagtcgctcttccagtcgtcccacttcttgcggaggacgcaggggatatagcggttcagcaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacgtccatgaagaaatgagaaaatggcggggccagcccagccatcgcgaaggggaggaagaagatggaccgccccgggtagtctggtgccgggcgcccctcgcccagcatcacaatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtagcagagaaagagttagagctcaggcagcgaaggcaagaggaacaatggcgaaaggaagggagcaaatccttttctcgatgcttttatacccttgccatcgctgggcctggctcctcgtttctcgtgcccactacctcgctccctcgtatctcgctatctcgctcccccgtttcccgtgcccacgcttccactaatcccattcgcccgcttacggcgcttgaagtggatatgcggttgtggcaatcgaaacggattgtatcgtgcgcgcgttaattacgctcgccgaccgaagcggcgttaccgtatctccgagcgagacaaatctgctcacccagattcgcgcgctgctcaagtggtgtggcagtctgaatagaccgcccattatggacaaccaaagttatcaataccgatgtgcatggattgagaccgttgggtattttgcccaattacggagaccggtcccacctgtcaccaggctttaggagtggcgtcacacctgaccgcttcccttgggaagggaaattgctctggcacaacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccctttaggaagtctgcgccacgtatatgggataagtgagcacagctgtgctcacctaacagcatttattgcagtctggtcaagcgtgtcgcgctgcatgcagtgcagcacggcgcgtccctttatccggtctgtgaccagtcacagaccggtcagatcacgggttaggtggcgactggcggtctgacgcacgccatgccccatcccgtcaagacgaaagcctctaggcactcgtctcaagccggcgttaagcgtgttatctcttagagatgacacgttagacccggtcgatatatgccaggcttcatcctaaccattacaggcaagatgttgtgtgaagaagggcaaacatgcacgttgccaagattacacgcggtggacaagaatgaccgatttgtgatcggtctgacactgatcatatcgtcagcgcacagccatgttcccacgacgcgctcacccccggcggaagtggaggtaggtgtgggctgtcccatcggagcgtcattcggacagcaaccgtgctgatctccgcccgttcaagagaaaaagaacagtccagtttggaaagagaagggtgcatgtggtatccccttgaagtataaaaggaggaccttgcccatagaggtggggggatttttttggttctttcccagattaggagcttagaacgggggagaagacagctcacacttgtagctcattcatacacagatccaccaaaacacaggagtagggtattacgcttctgagcggcccgaacctgtatagatcgccggtgtctcgtgttttctggctggcagacgatatttccacatacagagagagcgagagcttgagatttcaccctaagcccccggccgaactggcaaaggggggcctgcgcggtctcccggtgaggagccacgagctccgtcacctacctcagcgcaaaactgaataggggcaatcccctatagttggaataatgggaactataggaatcattatatgaatacttatattgtgatacaaaatttgaatcctaaaaatcactatattatgaatatgaggaagtaacactgtatcaagaaattttaaaactaattagtactactcacactcctttttacttgagcaaaatatcatttgttcacagccatgctaataaaacatggcgtgaattaatataccacttagtcattaacccattgtaacatcccgcctctccccaggccgggcccgcttacatttgatagctttcataggtcatagcctgtcccatggcttaaaactaattagtactactcacactcctttttacttgagcaaaatatcatttgttcacagccatgctaataaaacatggcatgaattgatataccacttagtcattaacccattgtaacgtcccgtctctccccaggccgggcccgcttacatctgatagcccattgtaacgtcccgtctctccccaggccgggcccgcttacatctaatagctttcataggtcatagactgtcccatggcgtgaattaatataccacttagtcattaacccattgtaacgtctcgcctcttcccaggccgggcccgcttacatctgatagttttcataggtcatagactgtccctctgtgaactcgtgcgtacccgggaagaattctttgcagatcggcttccggaaaagaagttgcaacttgttgataagaatttctcggtcggtcacccatcccaaattgctccaggccaagcacgcttaaccctggagttctttgcagatcggcttccggaaaagaagttgcaacttgttgataagaatttctcggtcggtcacccatcccaaattgctccaggccaagcatgcttaaccctggagttctttggagatcagcttccggaaaagaagttgcaacttgttctttggagatcggcttccggaaaagaagttgtaacctgttgatatgagtattctattaatcctattaacccctaggtcgggatgtcacacccatgtgttacattggctattgctattttttatatatattttaaattttgatcatacactaaaattgttgttgaatgtttttagaattatagcatattaaattaaaagaaaccgtgtcagttacaactggctaattgttaactttgaattttataattatatttaaaatagctaaattgtgagtccatctacattttatttctaaatttgtttgttaattttagcatattagtttaaaaagaagagtttgtttcagttacaacttgataattattggtttctgtcaaggttatggataccacatacctaataatagttgactaaatctcggcaggacccaccacataccatgtcctatacggaaacaactttcagatatagaaggagttctgcataaggaaggatgaatagagttttacatggaaacgacaaggactactcggattgtatccatattggtttccctagtcctacttggacaaggggacatatgggtataaatacaaggccccctaggaggagaggggacacgaaacaatagatcaagacacaagatccacatacaagccaacatgcgccaagacaagaagccggatatcgacttcagagataggcatggctaatcccctacggtgtctccggatactgtcaggagagacatagcgttgtctctgatctcatcgggcacggattcgaggaggaagactaccctgtcgtcgactacgagtcagaccttcagaccgccatgtcgacaaccgttagataggctaccctaaatattgtactggtgtgattatggtgaataagagcaacgaccggcttcggccaacaggatgtagggctattacctgacaattcaggagcccgaacctgtataaaaatcctcgccctcatctcttttactacaatctcgcatatatcctagtactaacgatccccatactatgcaaataccggaatcgcgacatcaaacgtcgacaatttcaaattcatattaaattaataaagcgatgaaacaactccatatctattaattccaatttttgtaacaactagatatttttaagagagggattttacggtccttggggaggtacaaggaggtactgcattttctactgtaaaatttggcacctcttggtatctctcaaattaagacggtatttttttatttaagacgatggaattcattatggattttatttcagagaagttaaagccaattcttacaaagaaactaataagaaaaaccatcttaaagacaaatctccctctatggttggtcatagtgcccataactattttttttctattttaagatgatggaattcattctggattttatttcagagaagttaaagccaattcttacaaagaaactaataagaaaaaccatcttaaaagacaaatctccctctagggttggtcatagtgccctgtccataactattgtttttatcaactgatattaagttgtacgtagtccttgccttcctcaaaatagaaaaaaaaatctaaaatcaacggtagatcttttgtcgatcgaattccgctcacattactgttggcaaatggcgtcgaaccaaagaaaaacatcggagataaatcaactaaatataaagaatccatggaatatgtttcatttaacacgaaatctgaatgtgtaatttacatattcacttatcaaatggtatatatttttaagttcatgtaagagctcactcgaagtgctcaattaatatagctataaatagataagatcctcgcaaaccaaactttcataaaataaatgtgaaaagttcttttaaaaagtatcattcatatcacaatttctagctacgcccttttgcaattcaagatatttgtgattatgtatttttttcaaatatttttgttctacggcactaaacaaaatcactcctttctgtcgtactccctccatcctataatataagggattttgagtttttgtttgcattgtttgaccactcgtctttgttgaggggtgaccctctctagcgggaggctgtgaggccctcctttgagagttcggccaggggcagcgggtgagattcgaggatttggtgagcgaaactgtgtgtgatcttgatctcggaggcccctccaagacgatgagacaaaagaggtttatataggttcgggccgctatgaagcgtaataccctactcctgtgtgtatgattcttctgtgcttagaaagtccctgaatccctggtatgcaagctagggttagacaagctttggctcagggatcctcagtccgatcccccttcctcgctaggcatggtcctccttttatactctaaggggataccacatgtgctgcgagtgctacctagggagaagggaaaatattctctatattaattacatgtcttgtgccttagcccagaagctatccgcggttgctgcgcggggcccatcaaatcaatgcagagcgcccttgtcattcgccatttaatggatgaggactttcgggttctcgttcacaccagaaaacgggaacccgggtcagttcagagtggttggaccagctctgaccggggtaagaggctgtgaagcccctcatcattatgatgggacgggatggagcacgccgctcgccgcctgacacactgacagggcaggggtacacagtcgccatcccatcggtcattcaaccggtcagatgcgcagcacgccgcattaaatgcggcctggcgcggttgcatagactgctttaaatgcagttaggtgggcattaggcgcgcccacctaaccctgtacacgtgggctgatatgtggagggggtcggggcagctcgaccccaagcgagggtggcctcctccctctagcttggagggggcagccaccgcgccaccccgggctcgacccccctcggggggagccacgtgggtttgggggcggcccaaccccaagctgggagggggcagccgccgcaacaccccgggctcgacccccctcggggagagccacgtgagtttgagggcggcctcctccctctagctgggagggggtagctgccgcgccaccccgggctcgacccccctcggggggagccacgtgggtttgggggcggcccaaccccaagctgggagggggcagccgccacaacaccccgggctcgacctccctcggggagagccacgtgggtttaagggcggcctcctccctctagctgggtgggggtagccaccgctccaccccgggcttgatcccccctcgcggggagccacgtgggtttgagggcgacctcctccctctagacgtgatacccccgggcccatatcaccgacagtcttattcaaaaaatttgtgcaaatataaaaaatgaaaagttgtgcttaaagtactttggataataaagtaagtaaaaatttataaataataatttcaaaaatttttgaataagacgagtggttaaacagtataagtaaaaattcaaaatctcttatattataagacggagggagtattagacaagatcgacacagtctctatttaaggtaatgaaaatattttaacactcccatcctccacccacattaatggtttgtacatgattgattcaaaaatatgggatcgagtgccccgggcggcatctcgcaataacctgagatatttctttctgctgacgacatgctttcagcagcggcaggatgcgcattgccgagtctaatccggccatcagcaatgcaacagcaagaaacgagtgtaatcattgcgtccacaaacaaagatgtccaactaactacacacgatcagtggcaaatctgtattacaaatggacagtgaagagcgcacgctttcacttcgtcgtccctaacctttttctcttcccgcttttccccgcgttagctaagctagctatagctcctttgttgctgctgccatgtccgcggattcgcttcgtgccaggcatgtgcgtgcacaggacacatgtcatatgaccttcacaaattttgccttctcaacaaccaccccccattacctccaccaacacaggcacccatccaccacaataactacgctgcaccgagcaatgagcgcatccctccatctgaccatctccgggcagcaggcagagacatgcagaagcatgaaaaggagcttaatctgggcctgtaccacactagctagctccatcaactcgatcgtagcaggacattaagatggtttagcttagacgtggttttcaactatctataagagatttcgctacaaattaattaacatggagcagtagtcatgcatcatgataaggaagtaattcaaggctttgacagatttttaagtgagtctaaggctgtgttcgtttggacgttttcccagcgcgctacagtgttttgcccccgcgcacgcttttcaaactactacacggtgtacttttttgcaaaaagtttctatacaaaagttgcttaaaaaaatcaaattaatccatttttgacaaaaaaattagctaatacttaattaatcacgtgttaatgaaccgttccgttntccgtgcnanngtagcgcgctgggannacgtccnancgnacacagcctaagctgagcttatgatagatcgctctgtcgatgttgcagtctcaacaatactgccaaccaaccacgcagatcataaatgattttagtagctcaccggctgaaagatcggagacgtacgtacggagctagacggcggagacgcctcttgccggccagggggctagagggagttgatctgttgatggctctgcaagctttcggcgaataaatagcatttgtccatccaagtacacgggggaagatggaactgaactttgcatcgcagtgccatgatgcaacatgtgagtggaccacgagagaccgatggccaccatggatcaacctactctgcccatccttaaatggttacatcttcctcacatgcctgtcagataggagtccatataatcatgcaatgcgtggagtatatatctatgatcatgcaatgcatatgtatatacagagtacttagtacttacatgaaccatggtaaaattcttctatataacactgttcagcttgtgtgtgtggattggacctggatgcatcactgctgttactgtcggacgggatagccggatggttctcaaatgagcgaaagataagtactacttcctccgttccacgatgtgagaatgatttacattgtggaacggagggagtagcagtgatgcatctgaacatatccagaaattaaaggtggccaggatagtgttgaacatttcttcatttgatctttcacacatgtatgggccatagtgtaactttcagttaaacgtctgatgataccgcctgctgagaagaggattaacacggttgtccaactttcaccaggagaggattaaaagtttaaaacgcctacatgctttccctgccttgtcctagacctacggctacgaattgactatatatacggtacgaagagatactaacagaattgttatggacagttattgacgtggatctggtttgacttaatgatcaagcactaggtttggtacctgacaatttcgtctgtaaacgtataaatctatctgcctacgagtgttccatataactgcaactatcaggctacggtggaatgaacagcaagtattcgaaactgttagtactatcatatacctggctttcaattgaataacgtggaactacatgctacagacttcagtggaccactcatgtaaatggcagtagttgcccgtagttgcacacgcataaatgcgaatttccagctccacgtacgtcagtacgtagtactcctcatagtagcactacagtgctatcaaatactactagctaataaatcgaaacccaaaaagaaaaatgaacatgctagtaccagtagcatggccaacttagccaatatgatcaagacctgaattccccttaaccactcgtatatgattgcatatataatatatgcagagaaaacaaggtgatcagcctgcacaatatctactgatcaggctccaaccttttgtctgtatccccccgtgggataatcagtcaagaaaaccaaaggaaagaaagaaagaaagaaaaaggtggtggaaagaaacaaaacctaattaattacatcgcctaatggctgatgctttcgtgtatggtcgttaaattaagaagaggcctcctctgagaggtgtaagaaagttctagcaccctacacaaggttagctaagcgggcgaggcacgacggtatccttacaggtagcctcccggcaaaattgcgggaccgcgcgtagagcgcggcgcagagcagcgtcccgacggcgcacgtcgtgccccagatggcgaacgtctcgcggtagcagccggcgccggagcaggtgagcgtgccgcgggcgccggcctcccgctggtagaggaacgcggcgaagtagccgaagcacagggagccgacggggatgttggccaccacgacgttgtggtgacgccgaagttcttggtgccgaacagctcgcgcgtcgccgacaccgccaccgacgtgatggcgcccgtgcacgtcccgatcaccgccgtggccaggtacagaaagaagtcccgctggttgagcagcaggaagaaggcccccgccatgggcgccatcagcgacgccatggaccccgtcctcgatatggagtagccacttctgcacaaaccaacaaaatttcagttagcaccctaattaatcagcctctggaactggaaaaccagcgagctactgaatcactctgacacaaacagccaagatctaactctacgacttatagtaggcagtagcaacaagtagttagcacgtcgtctttgaaacttgaaaagaaaaacaaacaaagactgcatgaatctttgataacaacaagtgtacgtggtctccaaaatctcaggactcatgtagtagttaaagaatactctgttttgacaaattttgctactctgcttggagtttttttttaatcatggaagtgtgtgaaaggaatgatcgcttacttcgcggagtagtagtccatgaacgccgggagaagacggccgaagaatccaaacgaagacgagagcgagaccagagtggaagtctgcccgattcctcgcgactcggcgatctgaccgaggttgttgaggaagaccaagccgagggtgccactgaacatgtagctgaaaaaatagagccagaagtccgggcttttcagcagccggaggccgccgacctcctcttggggcttcttcaccacggcgtcctcctccttggcaacctcggcgtttgcgtcggcggcgacgtcgatgacgacgacgctctccacggactccgactcgtcggtgccgaggtcatggatcctgttctcccgctgcgtctcccgtatcttggtcagggtctcgcggatcttgagccccaccgggatgaggatcggggtggccagcagcacgccgaggctgatcatgtgctccttggaggacagcccgttcgccgtcgagccgatgctgccgaccaccgcgcaggcgcccgtggcgagcgtgatcgcgaacatgacgaggaatgccgcgtccgagctcgccgccgcgctcttgaggtcgaacaccctgagggacggcgccaccatgacggtgacgaacagcggcacgacggcattgaggaggaggtacgtcttcgtcttggagttggccagccccgggaacgtctcggccaggctggtgtacaccttggcgctgaggccgaggtagctggtggcgaggctcaccgcgacgcggctgttcgacgcgaagttgttgatgcagaggaggtaggagacggtgttgatccagcagatgccattcccggccagcgcggtgagcaggaagagatgccagtaccggaggccggagctgtccaagaacatgtactggatgccatagccgacgagcccgaacgcggcgccgacgaacgcgacgacccaaagtggcaggtacagcgccgccaccccggagaaccatccgaagagcttgcccgcgtcggacgcgaaggcgaggaagttgagctgcacctggctgatgctcttgagctccttgagctgcgacgagtacaccgggaagtcggagttggggccgttgatggtctggagccagatacttcctaccaagctcagccaatgggccgaggaaggggaagacattgttgctggtggtggtgcgcacttgcttgagctgtaatggcctctgtctgctaggtatttatgcaattccggcggttaattaaccggcaataaattgtccgatggagatgactgtggctgcaaagctagcttatgtggtttgttgttagccagtatggactaattagtagatcagcaattaggccataagttttagcctaaacagcaaccagcccaactgagggcacaagtgctatggcccaagacgtaactctcagcaggtgtgaccagaattcagaaacggaggctgagatttcagactgcgggttgcttgcaagatattcagtactggtacatcatgacatctgttgctattgtttgctattaaccggggagcaatgaatggcatcaatggctgtatctaattcctggtccggaattatcggagcttgtcatggccaccttgcagccacgacggatcaattgcagggctcaccggagctggccgttgctgacttgcctgcccctctcgtagacgtcactgtgattttgcccggcattacaagctaattcgaaatcaaacacttggtattcggcaacaaataattagggccagattagctagccctactgttttctgaagtattcggcaacaaatcttacaagctagctccccaactggtaatgctttcgaatgctttgcatatataggccaaggtttcttggcctgatcattccggtgtcctaatccgaatatgcatgaaacacttaaacatgaactgagcagtactcctaatcggatttaacttcagaagagagatcctacaaatagtaatcctaatcggattcaatttctgatgttcagcttgcagcagcactttctgacagtgcagcaagagataccatttcccatacacaattcagatctgatcagctcagctagtcagctgtcgactaaaagctcttcccgccattcggttcaatttccgcgccatgtctttcaatacattgaaccaacggtgtcactgttctctggatctgcacaagcacggttcaccaccactcaccggccgccctccgccctccggcggtcacgatcaggccgctctctcgccatgaattgtcgccacgccaccgctgccatttgccgggagcagtgacgtcacggctagttaactcctccctcgccggctgctcctccgtgtctggccgcgctcgctgctgcggttactttcagctcacctcgacgccattaaaaaccgaagaccagatcaacatggccccgcgggaaaggaaacggtgataatcccggccgcgtagaggcgatccgaggcaatgaaatcgtgtaatgatttctagccatgtctgcagcatctgaatctagcactcgcattcatgctatagaccgccttcagcctgaagctgaattgaattaccgttgtcataaggtcatggtgagatcagacgcacggcacaggagagcgtgagttctgtggctcctgtacggagtggagttcagcctgactgcctgaccatacctgagacctaatttcttctgaattcagagttcagaccaccataagttagaaacttgaatcgccattctcgttcggtaaatggtggcatcatggtggccaggacttgcaaatgtaaacgtatactgacgcccaacatgctttcctggattcctaaagcttcagacgatcaaccgaacttcaggtttcagattaaccaacatcgcctttttccttttagcaggaaaaaccactgatctctaaaatgtctgaccgaatgctgatctcatctgatgcaatatttcatttgtcgtttatagtgataaaaagaaaatggagaggtcaaaagttcaccaggaagctctcgacgagactttgagtcgacacagtcagaacaggatcggagaacatcatcagagcacaaaccacatggtggcactcctaaagcggctacatattctttttccaagtgaaaagcaactgcatattcggttgcggcgtcattacaagcactgttcagcggtcacgttggttgaatcccccaggtaggatccatgtgcaaatccgaagtaggtagtaaccccaacttcagagtttagagcgtgcaactcctaacaactctctctgcccaatctaaccctggaaactacgcaaaatgaggaggaagagatcttgtacaagtgtacctgaacaatgccaagataatctggcaatctctgcctcctctgtggacaaggtgaggagcagtaaacgccgctgccggcaagcagaggataagtggtggaagcccatggacgatcgatcccggcgaccggcggccaacggcagtgggttgttgtggtatgtccgcatcgcccggccaagttcagttggggttggtagtttggttggctttcgccgctaatcgcgccgcacgccgtagggaccgggttgtcagtgagacggaagacaccgtgaacgtctcgttgggcctaatgtcaggccggcggggtgcaaacggctgtatttccgagtgggctcggcccaaaacatgagacatgtttcttggtagtgggcttcgtattctttcaccactcggcctaattgtggacatgggccggcccatagaaatatagaattgtcatctgaacagctggatctagggcttgttaaatttgttgcccatatcaacaataccaactgttggtaatgctaaatttggtacattttggtaataccaaattttattagtgttggctttatttggtttgatacctttaccaaattttggtagatgtttaagagaggaagcttctagaaataccaaattttggtaaggtagcaatggttgaagtgtgtttaatatggtaaggttgaaagcaacaacaaactgaataggctcttggaagtttcgactgattcatctcgttggagaaaaaagttggaattgcaaatctcttctctactatttataaacgtactgtttggcaagagaatggagatggggagtttagaggagggaattgggggagggattggtcatgagagttacaattttactccttgtctcttgtttggtaagtaagatgaaaagtataggaagttcaggtggaattaaattttaagtgatgatatatggtcgacatttatcttgtgtacttagaaaaggaattccatcccaattatctgcccctatctagatattaaaaatgtgggagtttgatcttaaattttcctttccgataatccccatccttcgaactctcattccctcctaacaattcctcacaagtccacaaccaaacaggccaaaagaccattcattccataaaaaccatctacccaaaaagttgatttggcaaaaaaacaaatcatttaatgaacaacccactagacccaaatcatcctactaaactaaataaaagaatcattgcagcgcgtgaaactgtaaccgctagcggtactaaacaaccaaggaataagtctacacagacccctaaactattgcaagtcaactatttaatcccctcactttttaaacaatgtattctaccctcctaaatttttctataccatgtacttaacccttaagacagtgtaatccctatgagggaggaattggagggatttattctacatctattgtgatgtaaaattattttccatcaatccctttcaaaccgtgcaagacctaagatggttttgccacggtggtgtgttgagctggaccgttttgctgtgttggagcgggctaacgtgcgggtctttaaaagacagacaaaccgtctcttcccctttgccaagctagttagttctctgttcctggttcggctctcgctcacttcagtgaaccaagtggcatgtacttcattgcacttcacccaagaaaaagtatatcctctcttttttcttaatttttcatttatcagttcaattctattacaggttcactgttggtaggaggactttgcgacacggcgtctcctcgccgggctgcttcccctccttcatcgtcagcctcctcgtcgtccttgtcgtcgaggaccgggatgtcgcggagatagatgcagtagtacgcacacagccatgtaagtgcgcacaggccaatcacgtcgagcgtgccgaagccgatcaggatcctggtgagcacgcggctcacggcgccgtcgtcgtctccgtgctcgtgctcagagtctctcgttcttggagccttcaccaggtacaggtagttgtgccggtggcccccgccgatcacctcccgggcccccgccgtcatctcgtagcgcgagcacgcgccgccgtggtcggccacggccgccagcacgtagagcgcggcggcgcaggagcagtcgcgcaggcaggagtccgcgcactgccgcatcgtcacgttggccgtcggcggcgaggcgggcctgatcgccgtggtgacgccttccatcaccgccatgtagtgccggtcggcgacggtggtcgcgttgcaggcactgtggcggtgcgccgccggcgccggatggacaccgtaggtggagaagtcgtcgcattcgccggcggcggagcagaccccgcggaggccgcaggcgaggggaagctcgcagaacccgagcgcctcgtacgacggcccgaacttcatgtcatggctgtcgtagaagtacatgcccaggttgccgtcttctccgagcgccaagaagctgacctgcgcctcgatcgccggcgagatctgcgcgaccggtcgccgttgacggtccagcaacctcagccccagcacgtccatctccgcaaatgccacgctccggttatggcgcggagtgagctcccagtatgtgtacctcttaatcccaacgttgaagttggcagtgatcgagcgctctttgagctccaaggagaagaacgcggagccgatcattgtcaccggcgcggtgaggtaggagggcaccccgatgcgctggccgcgtagcagtttgtcggctggtttgtcgaaactttgccatacatattggttcttggcgtccaggagacggaggttgccactccgggtcagacgcagaacctgtgccgaaacataaggggaacgtgagtatctcagctctgacttaaaagggtttgtttgttttgctaccttatcagaatgtcgggtaatgctaaaacctaggaaaattttggtagtaagttaaaaatttctagttgacttatcactaacacataaacgcaaaatagggataacattatagttattagaagtctatacaactaaaacatatagtgtttttttttttgcccgagcacacgtccctgatctgatgtgttgtttggaagaactgacacctataatgcgaaaaaggtgctggttgttaataacaatcaacacatttgagtgttgtcggacatagacgttggttctattaacaatcaatacttttgagtgggcccagtggttatcacgtcaaagtaaccgttggaggtcacattttagcatattttggtagcaaaccaaacattgccaaaagtactaatattcaaagtgacaataacttagtatagcacattttggtttcatttcaaaatgacccaatcactttagaggatagaaaacgtaaaatcggttactctaggttgaaccaacaaagcgtacgtgaaaagaattgctaagaatagaggacctagaaagagagatgatctttctttaacgtatcgtcctctaacgtatatggctgacatataggctcacttgttagagaaccgacatcagccacacgacattaaaaagcaatacgttatagaaagttcctagcaggctataactcaaaggtgatctcccatgaaataggttgacactaataagtaacaaaattgagaggcaattagttgggcaaagagtgcaaaaacataaaaccaccagaaatctatacgcgctttactttcaatagggagtcacactttattgcataaaagataactataataacggtagctttactttgttgctttatttatttttgtcgtttgtacttatttgttgccctctatgacttacgtgtcgttattaattaggttatcgataaaagtcgttattatgacgttgatatccgatccatgcctttcgcgcgcttttttaaaacactcaaggtagcccttaaaataagccctttttttcctaaaaaaatgctcagaaccaaatcctcatagaaatgaacctttatatatagactattttttatggtatataagatctagtaggtagttcttggaaaaatcgaggattgtccacttaacagtcgcatgtcagtatttggcatgtatactagtccagtcctagacataaggttgccaaatcctctatccaattatccaagaacagggaggacaaatcatcaaatcctcggacagataactccatcataattcatatcaaccgacccatatatatatcggcataacgctgatgcactaagtctagcactgttccatcttcaacaacattgtacgattatataccttgattgttggctcgctgggcgtacctcgcatcgcatatctagcttacaatcctatcgagtttgtaataagagcagaaacaatggtaaagattgcaataatcaagcagacagaatggtgaaaagcaaactaggtagatccacaggaggagtcatgcatgcatcacctttgcgcgtcgccctgccgtggcggacgaccacccgacggtcccggcggcgtccgtcagccgcagatcgccgtccaccgtgagctcgagccggcagaagccccgcaccaagaacctcccgccgtcgtggtccgaggcccagaccgtgacgttgcccaggaggacgacgagggagcacatggacagcccttccaggcctcccgtgccggccacgacgctgatggcggcggcgacgccaggccgcagcggcgcgccgtgcgacgcgttgagcaccgtggtcgtcgtcacggcgaggtcggccggctgctggtagtacaaaggcacggtgaagtttttgccgagagggaaatccggcgacgcgatggcggcgcagaggaggagcgcaaccgggagcagcacggacaaggtgcaccggggggccatggccatggccgtcgcggtggttggagaattctaaattcgttttttcttttttggggttgagttggagaaggaaaagagaaaatgggttcaatttggtttgttttctctcgcagatttgctctgtatttagagtgtgaagactcacggtggggaatggtatatgatttaactgttgacattaatcattttggcaggattagcgtttataaatggtcactaggctgtgagaattaatggtattactgacaagaaacagtcaaatagaactacctgaaatgaaccaaagaaacagtgttactatgcaattgctaaaggagccatccgtatgataaaaaactaacttctaaagataaacttggacaagcattggttcaaatttatatctataagttatcctttttgggatagaaggtgtacaagtataaaagtgggagtaatatacacctgttcctctgtaattgataaagcttgatggaagtttaataatttttaaaaatggtttatgttaaaaaagagggtttatttttttacgtggaagtgtgttttttctccttgtttctacataaagattaaactgtactaaagaatatcacattttaatgcacatatcctcctcatcagcatttatgcttgcagagatttgatcattaattgccagttcatggagtggactaattaaagtggagtggcggcattgcagatttgcagttgtcgctttgcgctccgcgcgcgacgagaaagaaacgtgacttttagatcctgcgtaccaacaaacacaagaacgacgaaacaactcaaatgtgtgtcaactcggcgctaaaagattatcatttccatggtacaaatataccttctgttcctgtgcatatcaactgcaaagtttaagtttaagcttattttaactatacatctactaaatgtgtgtcaactcggcgctaagagattatcatttccatggtacaaatataccttctgttcctgtgcatatcaactgcaaagtttaagtttaagcttattttaactatacatctactaaatgtgtgtcaactcggcgctaaaagattatcatttccatggtacaaatataccttctgttcctgtgcatatcaactgcaaagtttaagtttaagcttattttaactatacatctacttgacaatggaggtagttgacagtaaagtaattttttttaggaatagacagtgaagtaatggtaagtagttttgtttgatccatcagtcggagacccagtgtatttgagttctatacttgttacgtgcacaattgtcacgacctggcccttagttcacgggctcatcatagcctacaccccatgctgggcctcatcatgaaccgctggaatgccttcccttcgcaccggaggcaggcgtacaaacccacaattacaacaaagccaaaacgagaccaaatcctgggcattaccaacgcaccgaaattactactccctccgtcctataatataaaagatttttggagagatgtgacactttctaggactacgacctatccaaattcgtagtcctagaaaatatcatcgctctaaaatcccttatattatgggctagaggaagtaataactatataagagaactttccttgagatcaacagaaccataaaatatgctggagaataacaacgcacgaacaggatttaatatcctggacgaacacgatttcatgcgtgtgctcaataatgagaagccaaacatatcaaaatatgagtcgcgaagtaaaaacaaggcaatgcgcaactcatcatttatgtacagtaataatggtataccatctctactcgactgaacagtcagcagccatgaaatgaaccaatgtaaccaaacatgtaaatggggcaagggagatatacatgaaatgtacaccaaactgagtgatcagaattcctaacgttcaccacggcaccaccaaccaattagagaaacctacttctttccaccaatcgtaggttgaccaccatttgcactacccatgctagtgggtacgcccatcttatttccaccactgagacccttcaagtcaatcaaatcactgaataaattgtcaggtatgtaataaggtttgcttgctgccgctgaagaacctggcggttgttgattcccattcatttgagcttgtgttgcacttagtccattacttgtagtagaaccattccatatcggcaatgaggctgaaggtggcacatatgccattgaaggggaagtatatgatgctgagggagctgaataggttgaggaaacagaaccaacaggtgggggttgttcttggtaagtagctgactggaaaggattagaattgacacttggaggtgcagcccatggtggtgctggataatattgaccactttgtgcccaaggtgcaacatagtttctgttctgtcgaatatattcctgatttattggatgcgactggtggtttgaaggatactgtggcacacccgatgggttgtgctgcccatcagtaactgcaggctgctgaggtccattaggaccctgcgttgaagaatctgtagaagcttcatgtgtaggactgcacaaggtgaggcttaaaaggtcgatcatatcctgctcttttgtttgaggactgctactgacaagagctgggtcaacaggaactaaagcattgcttgcaacagaagatgaagattctgaactttccatatcaatgggtacaagggcaaggtctccagtgctagataatgaatcatcactagtcatcacagacttattttttctgcagatgcacaatgaagcataagttaactgtgcatgaaaatgaagctgcatgttacaaggctacttataaatacctttgtgctagtcgagtgaactcatcctcctcctcctcctcctcctcaagagtgctgataggaggtgcagatggcttttctgctggatcctctttaggagcctcaacattgtctgccggaggtgcttcaactgctaaatgagtactggaggccataatgtcatattttgaaataatattttgtagccgatcatttatctccaaaccttgcttcagtaactgttcattcctaaacaacagataaatgaattcagatatcatatcacattttgtgcaaacttctttgctctgcctatgaaatgctatgaagagaaacaaaggagaaccctgaaatcactacattacaaaattcaaaatacaaggggcagcaacaaatattgataacattaccctgttgagctgacaaactgcatgagcttttgttggtttgagcgacattggctcacaagatctgtgataatttcatctttgacagcctgggttaaaaaaaaagggaggttgttcaagtcaagagctagatcaaaatctgctggcatttagtccatatggtcaaaagtaacagtttttaggcaggaacatttttcactaccatgtgatcagatggattcaaagcatgcaccatatcacatagtagttctgtcacatttcgaatgttattcaggtcacccaaactgtaatagaaaaagagaaaaaaatgttacaaacataaattgaagtagttgggtgatagctgaccaaaccaaatgaatccgatatgccaagaaagcaaccttagtgtctcaacatcggaagacattatctcattcagacttcctgcctcatatctgggtgaaccatagctttgagaagtatgtgtcgccgggggtgtaaatatcggtggtgcatctataggacgccttgggaacacggcacctatcctctgaattcaaaattgacaagttgcaaatatggttagatattatagggatgttttcaaagaaaagaaatgaatatttcagcataaacacgtgagccatgcatgttgaacacatgagtacatgacatgcctcttgtaatcatgatcgttccacataccatgacgaaacaaggcttctatacttcttaaggaacaatcatggaatttgttacatacctttacttcaagatacgcaaagtgatattgtgggtatttacttccaggtccaccaaatgcttcttgccaggagtccaaaagtaataatattttatcccttactaacatatcattctgaaagaaaattacaaaagagaaaacattcataattttagtaggggcatgtccagtaattgcctcattgatgtgaattgaacaacatgcaaataccaaatgagaattgatattccaggaaataaatctgatgtgtgtaaacatcaggtgctgagaaaaaagaagataaggtgcactgtcaacgatgattcaacttaaccacaaaattagtataggtgaagaaattggtgttaagctcaaattttcttagtgcacaggtcaggactaatcgaatgcaaagattaattcagtaaaggtaaatatgggttattgtaagtgttaccacataatatcaaactattcagtaaaggtaaatatgggttattgtaagtgctaccacataatatcaaactttaagcagggcattgaacaagtaaccatgatattaatgataggctggtgacatcaagtgcctttgcaggctagttaccctattactctactacaaacaaccaatcagcgtttattatgaaaaatatccttccacccgtgaagaaaatgggtttaaccatttatattatcctgttttaatatattagctctctacagaataaccatccaatcgcattagaagattagtttgattgctaattagacaaaccgtaaaaccagccaaaagaacaggggtttcgtgtaacacacgaaactctaaatgtcttataccaaaaacactagcagtattcagtgtcatctcaaattatgcaatgccattaagaatgcatatgattaaaaaaacaactgagaaaatcaccatgtgcacaaaattaggaattcagaagagcaagtaattagtagtgaggaggggagtaaagggaccttcttctggatgattttcaccatttcttgcagaacatgttgctcagcaacttcaagttgaacatattcaccacaattcttcatcatagtctccaagagctgcaacaaatttcaaactaaatacatcagacaaacaacaacttcagattgttgggtaagagagtattcagggaactttctcctttacttttttgtgaaataaaatttgtattctgttcaaagatgaaaaattatgtagccaagaaaacactgcatccatcattacataacaaaagaacataccgtcaaagcatagaactgaacttttgggtctttgttctgtagtcgcttcttcactgcctttaccacatcctttgtttgcctgataagaattcacaaatattagcttgttaaggagataattacttggagtagaaaaataagctagtttatttcatactatcgacctatctatggccctatatgagttccctcactccaattgctttcttcagattagagtcaaagccatcccctttgcaagtgcaggtaattatcaaaagagctctcaggtagcctgggagttgggagagggcaaaatccacgcacacgttgaaggctaagttgaatggcatcctattcaccacaaaaagcatcgaatcgcgaaaccagggccttgaaaccatctcgactctacttcaaatatgcgtacacggccgtcttacccgaataccaaagtcgaccaaaatttgccccaaacaatgaatcaactaactaatttaacccgtcggaacacccaatagaccctaatcgaataccgaaatttttccactaaacatccaatctcacacgcaggaagccgtacaccgaacagggcaaaatcgggagcaacgacgcggcggagttgaggtgagagagacagcaggtgatcaccagacgtcggcgttgatgatgtcgcagatttcgaggttgacggcccagtcgggccccatgagcaggtggcttgtcgccttctccacccgcggcgccgcccgagcgggcgcgcccgccgccggcgccaccaccgcccccgccgggtgcatcgctggggaggaagagcctagggtttggactcccccgaggagacgagcgaataaactactactcgtaaaccgctgagtttagcgcgggggggggggggggggaggtaggggttaatccgtgctgtccgtttagcgccgcggaagcaggcgtgcgggattaacaatttgtctccgtcacgacgggtggtcccaagcgtgacgtggcgtgtcacgacctcacgggccaaggattgggagagagattaatagtaccactccgtattaggttttggtcaacgagtccaggagtttttcttctttcattggcttgtttttctctgtttttcgtcagattcacagactccagcctgaagaaaactaacagtgctgacaaattttcgtattaataatcgaaaaaggtaaaaggcactgatcgattgagtaattgtataaagaatacaattttatgtatgtgaaatagaggttgagagttatacatgacaaccaactatacttttcaaaactattgtataggaaatacaatcatatatatagggaacaaacaaacagttgtatatcaaatctagttttaattgttgaatatttatgaaattaaaatccgaacttaaaatgcttttatatgttcacaagcaaacgaatttaaaatctgacttaaatacagatttgtatttctaaaagcgaacaaacataaaaaccgactcaaatacggatgacgtactaaaataccggcaaaaacataatttttataatagtagagagaagagatagagatagagatgtatgaaatttgtataccaaatttaattctatttttacctaatcccaagtaaagttacgtgagacaatccgcatttttatttaagtaatttttgatatgtcgtgatacgtgagctacagagagtaccagattctatattaaaaaaaatcttccttccgactataaaatcactcaccaatgatactttgggagcaagtatgtatatttggctggagtataatatatttttatccataaatagtggttagctccgatatgatgcactttgcgaagtacaaattaccctcggtactctgtgggcctgcttggaaggtattttggggctgtggtttttaagcaaagacacgtatcccatctaacgaaaacaattttaaggaaaaacttatatacttctaaagccaaagttagaacgtgaaataaagctaaattaattttaaaataaggttaaaaatatattagatactgttgagcacaaatgagcaggccaatgctactatttgcattataatttcaaaggtccccaagtacttctttgtcctagaatataagaagttttagaattggatatgattattaagaaagtaggtagaagtgagtgatggagatttgttattagatgagttgtgaagataagtgaaaaaagtgaatggtggatatggaagagaatgttggtaagaaaattgttatattttaggataaaatcgtgagactaaaagttgttagtatatttggagtggttggatgggaggtttccacctggagccacttgcttggggtttggtacaccgtacatctcgtcatgggcgtcgtataaactacagatgttgcgtgcgtccaaccacttgttgacagcagcagattcaaaagatcgctaatgataatgaacaattttagcaacgcaacattatcaattgcaatgcgaaagttcttacgaggcaggactcggaatagatgtatggagtctgacctttcaagtcggagttgttgcttttggaggacactgatagagctgtgacagctatttgtcggtctataaaagtgcttgctgaatctgatggctgagctttaggccttatgggccgtaatgccgtagcaggccaagactgcttgaaaagttgagatgggcctttctatactttcagcctcagaacatggacataagtccggccttgcattcgcctaaaatgcaatactgtcagcatgtctcaaaaaaaaaaaaaacagtcagcatgtggaacgtactgccgagattcaaacacgtgaatgagttgcattaagcagatttcacactccataattcaagcaggcaactctactttgatccattattcatgttctttcttcttgccgatctccaactctcaattcaatggatcatataggtttaccttttaactgatgagggccaaccgttttctctgaaggcactattccttattctatatcacattatacacgataatgcatctcctgtaaaagtatacaacaatgactcgccgctaaatccttacaacacacaagtatacattgttacgagtcaatccctgcaagttttttttccttttttttaaaaaaaatgtaaaacagaggaacgctacaggggcagtagccttgaatcttgatgctgtcggacagcaaaccaatataccacatgctacctacctgcggcatggcctccttccaccttgccgctgatggagctcatgacgttggaggcgatggcgatgctgctcgtgatcacggccagagcgatcatcgtcgctgccaatgccttgtccttcgtctttgctatcccatgagcatccctgcaaaaaaattgtagcattacatgacaactgtaaccaagcgttaagcgatgagaattgtatgatgccatggtggtgatctgatggcgtgcctgagaacgatggcgccggggaagatcaacgagatgcagacggcgaatgttgacccggagtactcgaagagcgtccagatgctggggatggcgatggcgagcgcgtagagcaccgccatgagcacggccgtgagcgccacgaaccggcgcgtgtccgtggccagcggccgccgccccgggaacaggagctcgtcgacgttgacgcggagcgagaagtggagcagcgggaagacgagcacgaggtgcagcgcgtagctgaggcgcgccgcgtcgttcagcgcctgcgggaccccggcgccggagctgcggtcgaagttggcgagcacgtccgccatggtggcgtcgccgaagaggaggaagccgaagaaccccaccgccgcgtagatggccgcgcagagcacgagggagatgcgcacggccgccttcatgtccgacgtcttgcttagctccgttcggatcgggtgcactgccagatgcaaggcagataattcagtctcgagaaaaagatggtgtagtgttaacaatggcgcgatcgatgtgataccgttgaagtggaaggtgaaggcgacgacgactatggggacggcggtgaagagctcgaacggagaggagaggcgcgagaaatccggcagcatccgcggcatcttcgctgtgccggtgaagagggcgtacaccgcgatgcccaggctgatgaacatgaacaccactgccagtaggatggacacggctgatgtgaacttcagtgaatctgcaattagtcacaggtcacagcaaattaaagggtatgacttcagggactacggtattcaggtatttttcaaatgtcgtagctcctcccaaattcataaggcattctaaccttgcaaaattcatatactactatacgacaccgtccagttttgccaaatcgtagtggaaattggtccggaaatgggaatttagaattcgaccaaatgactgaaaatgcggtttagtttggggcactggatctagagtctgctcgtcggtcctaatgagaaacaacaatcatcgcgggctcccttacgtaccgacacgcttccggagcacaagagggaggaggagcaccgcggctgccaccagcaccgcctcccgccctgtccaccattgctgcccgaaccactccgtcagcaccccgtcgtgcaccttcccgtcgctcgtcgtgccggacatcacgtcgcctgcaggaacactcacaccaaaatccccggaaatatcactcgtctgcacgcggcgaccagcgctgcaggttcgctgggtgtacggctcggggggagatatgctgtggtgcgttaccgatgatgatgaggtacacggtgagggtcccgatggcgttgaaggcgacgaagacgttgagcagcgcggccccggcgcggccgaacgcgtcgcccatcagcgcggcgtacgacgacggcccgcgggtgtaccggagcatgaagtccacggcggcgttggccaggagcgcgacgccgaccacgagcgccaccgtcggcgccacgccgagcacccgcatggccgccgggatcgacatgatcccggcgcccacgacgctcgtcgacacgttgaacaccgcgccgagcaccgacgcggctgcggctggcgtccccgctccggcgtaacgctctggcagcagggacgtttctgctgccccgctgtcgccggcggcggcggcggcggcggcgatggaggtcttcttggacaccatggtgttgatacgttaagcggggagctagacgagagtttggtgcgcgtttctttggaatcggcggctcgagagcgtggaaacgtggcgcgggaaaacgacaggaggggcgatgagtgtgcttgtgataagagcctagtcagatgggtgaacggagctcagcgaccaaattattgtggcgtggcgctgcgaacttcgaaggacgatagggtttttaatttagtccggactggtgggcgagtggctgacaactgggccagcctcgtggtccgcgtgcaacaatccgacgaggcaatgatatccttgtttatgggcactatggcaatattgcacatttggtgcacatggttgaaagggatgtgtaaatgggtctcagggtccacatgagatcgaggcccaagataacgctctttcggccttccggactcaacggcagatggatgaaatagaaactatctagctatcttattaaggaggtgtttgatccacgaactaaactttaagagggtgtttagatctgggaactaaaaatctctgtcacatcagatatttgatactaatttagtctattaaacatatactacttacaaaactaattacataaatgagtgctaattcgcgagataattttttaagcctaattaatctataattagcacattatggattaattaggctcaatagattcatctcgctaattaatctagggttatggaatgtattttgtcattagtctacgtttaatatttctaattagtatctaaacatcgtatgtgacagggactaaaaatattttagctccatccaaacagccccaagctgatggtttttaccactagctgctcgcgccacacgtggcacagtagcttttaaaataaatctccaagttatttataaaaaatttgagaaaaatatattatcctatctatctatcttactaaagctgatggtttttactgctagtcgctcgtgccacaaccatgtggcatagtaattttttaaataaatctccaagttattcataaaagggattagctaaaaaaaactgtcgagtgtttttttaggggaaaattttcaaatctagctacagtatataatttcactagaactatatactataataataataacttgtatatatgtattaaaataatatataataataataacttgtatatatgtattcaaataatatatgcaactttatatataatttatatagagataacaatatagttacaatgtaactagggtgtaactggagtataactaactataacttgcaaactttttagaaaactttaatgagatgaagtggctaccacgcatagctagtgggattgaggtcctaggttcgaaccccatgcagcacacaaatttagttatcgcatggattttttacacgaacgtgccagcactaatcttgaggcgaatccgacagacaaaaacagtcaaaaattcgacattttttcccctcgtttactgtcgacagtaaactagcaaatccgttcataaaaaatctagaaaaaagagattatcctattagaccaaatccagaaccttccaaaccattcttctcctcctttcaattaatctttccatcagaaaaatagtaaaagaggatatcgattggtggatgttgtgttcatccagcaagaacatcatcataagtatattccttcatgacctaactaatactctctccgtttttttaatagatgacaccgttgactttttttttcacatgtttgactattcgtcttattcaaaaaatttacataattataatttattttatcatgagttgttttatcaatcatagtattttaagtgtgatttaattacgtaattttttgaataagacgaatggtcaaacatgtgagaaaaagtcaacggcgtcatctattaaaaaacggaggtagtacgatgataagtatattccttcatgacctaactaatacgtatatcttctgaatttcatgaatttgatgaaaaactatgaattttttttaaaaaagacgttgatggaaaatatgatgtttttcattttcataagtgcaagactctgctacaacgattgttgatagaagaatatcctttcaaatatagggctaaactttcaaacgcggttgtagtataattgtagtgtatctataatatagttatttatatgtaactcacatttgctattcgtgacgtgaatctgatggctgacaaatcgatcgttaaaaaaaacacgtcaacaatttttggctaatactacctccgtcccagaatacttgtctctttaggatttaaattttgtcccaaaatactggtcactatggagtactaagttgtcccatcaatcactttctattcaaaagttttccctttttaccctcaataatcatttcacttaccaccatacattatttaataaggggtattatagttttttattaaatcttaatctatcctaaacaacctagaatgacaactattgtaggacggagggagtaatatattatgtctttcatgcattctaaaagtaactctaactagcgcacactggctaaatagttgacacgtcaacgtgggtgtcatattttctactataaagataaagttagagcatgtaaaatgagagagccattagcacatagttacttgacttttaattattataaatttaaaaataggtttatttaatttttttaattaaataacttctacataaatttttttcacaaaatataccatttggtcaatttttttaaataaaatataccgtttagtcatggtaatggaaatcgaggaaaaatcaccaccattatgtgctgtttccgtagttcgacaaattggatttttgttaaagcgtttagaggactcaatcggtagctgagataaaccctgtgcacgagcgcaatccgacgtccacaatgagccactccatctccatgtcccaaataattcgggtggctcaactactcgtgtcgaacaccgctcgagaactcaaatttacaactcagcactagcttaattactttctatgtcataagtttttggctttataaaaaaatatatagtagcatctttaacattaaacaaatatattatcaaaatatattcaataacactaatttgatgttttagatattgtcaaatttgttctatagattttattaaacttaataaagtttgaataaaaatattcttagtttagtatgaaacggatgaagtacgtttagagtagcaattaaactaatcaagctattttagagtagcaattaataaatactaattaagtgcatcaggttgtattcgagagcaactcaccgacgcggcggcggagcacgagcgggagcagaacgacgatggccgtgaccagtatgacgagctccctcgccgtccaccactgcgctccgaacagctcctgcagaacaccggcgtgctcgtctcctgctcctgcgctcccagacagcacatcccctgcgacggcgaccaagatgctcgacgcggttaattcaatattttctccccgcatgcaattcggatgtatcccagagctgcagagcagcgcgtcctcgacggcgtgggctcaccgatgatgatgaggtagacgacgagggtgcccgtggtggtgaaggcgatgcagacattgagcgccttggcgccggcgcggccgaacgcgtcgcccatgatcccggcgtacgacggcgggccgctgtcccagcccgtgtaccgcagcatgaattccacggaggcgtcggacagcgcggcgacggtggcgatgaggaggagcgcggggagcacaccgagcacccgcattgccgccgggattgacatgattccggcgccgatgatgctcgtcgacacgttgaacaccgcgccggagaccgacgccccatgcccgccgccagagaactccggcagcagcggctcctccacctcgccggcggcggcgccggtgcacttgcccgtgctcgccggcggcgtcattttcggtggggatttcaggcgtgtggatggcgctcgttggcaccacctaaattagtaccacttgaacctatgcttccttaatccggtgaaaattacgcccatatccttacgcgctaatgatgatcgctgtagaagcagcagctggtaacggggcctaatatggtaattccgcgtgggaggcgtactacgcgacagaaaggactgatgtgattacagagcggagagaggaagctagtgtttcaggtgctgtacttggacgggaacacggccccgattcctgattttgcgatgatacaatgaagcgggaccctttttagcagcggcgtgctgatttgctatgcccaacgattggccagtcggccagcctaacggatccataccactggcttgcttgctggaatctagcaacatgacaggcgccggacacaatatccgccgttgaatccatggatccatggggtcgacgtagatgtttgcttttcctttctaaactctccaaagtgagaagacaaacttattttttttacaccgagatgacaaacctggtaaatctaccgcatccctttctccacaaactacgcaccccctttctccacaaactacagcatggacgaacaatttgcctactgagggcccctttgatttggaaaaaaaaatatagcaattttagaggattttaatcctatagaaaaattttctatgaagtcctttgaaacaaatgattgaattctatccaatcctttgaaattcctatggaatggataatcctatagagattttagaggaaatttagcaagagttttaacctcttgctaactttcctttgagtctatctctctcatccaattcctgtgtttttcctgtggttcaatcaaacggtaattcctgtgtttgcaatcctctgttttatacttacattcctatcaaaatcatacgtttttcttattcctacgttttctcaatcctatgattaaaggggccctaagtgggtcaattaagaccaattgggctttacaattcggcaagagaacaagcctgagagttcgcctgcttgggcctttatttaggctgagtggtttacatggagttgggcctacttctagacccatggtaaactaatctacccctggaaagtagtactactactagtgaaaacctttccgtcttcctcccgttcgcctctcctttgcggtttggctctccactggggaaaccctcgaggccgcaagtccgacgccacgtcgcctcgtcggccgacgagatccgcggccggcggagtatattgttggagagcagagctgcggggctgcgcgtgccttcaggccaaaccctctctagtctttctccgtttcttccatctccgtcaacctaccggcgtattcggaaggtttcttttttctcctttttttttgttgaaaaaatccacggaacctatcgtcatggagagacactgccggctgccctctccccaccgtggtcaatcccgttgtgctgcactgctgcttgcccgcctctcgcggaggcttcaaagagacccagcgaggacgacgacctggtttgagaattcaacgctcgccgccttcatctgaccaaggaaaaccgcttgatttatgatttattgatggcatcgcgtatacacgagtacactgacatgcctccaagcttgactgctttggtactctatggatcccggggcacaggcgcacagcataacatcaattcagatttctgatgtgtgaactgtgatccctgcttgctttgttcgtgcacacgacttcgatgcagctcaacttcgtgcacacgacttcgatgcagctctgctacaacttgggaagatgacaaggctgtatttagttggcgcccaagtcaaatgtcctggcaagcgaaagtcgtgagattttaaagaatcgaagtgcagtttagcagactgctactttcccctacctcaagagttctccacatctccagttcttcagaagtttgagcctgtttggaggaattgagctgcttttcgcccgattgacttgtcctgtacatctgtgaggtatgttcacttgtgacttattatgtcttcggtcccagttcatgcataaccctgttctttggctttgggggataaatttgtgactgttggatttggcgatttgggggcgaattcttaagttatgtgtgccttctgctttttaggctgaagaagaaatacctgtttgttcagagtttcagttaaacagagaaaaatggttcagaattttcctgaagacgacatggcaggcacaccttactctgatcaaacctcaccaattttgactgaatatcatatcacagttcctgctcttcatgatggatcaatgcaaggatctgttcatcacgagaggagactcctggattgcctcagagccactccctcggtggagtggctaaagaatatcaacctctgttctccactgacgaatttccggctgccatctaccggcgtccgccggtacctccatgtcgaggttcacttcgtcagaagaatcaactggagctcggtgttcagcttctgcaagaactggctcaagcaccctctgaacattgctctcctggcatggctgctctgcgtcgctgcagctggtggcatgttgatcctgctcctgctaggattgctgaacagggccttcccttccaagccattgaggcatcactggatagagatcgacaaccagatccttaacgcgctcttcacgctcatgagcatataccagcatcccagcctgatccaccacctcgttcttctctgccgatggcggccggaggacgccgcggagctccggaaggtgtactgcaagaatggcgaccgccgtcccggcgaacgggcgcacatgtccgtcgtggtggctctcctccatgtcacttgcatttctcagtacgtggtttgcaacctctactgggcttaccgcagcagatcgcgatccgaattcgccgacaatttcttcttcgtcctcggcgtcgtcgcgcccgtcgtcgccggagcgtacacggtgtacagccctctaggcagggacacagacgacgatgcctccggcgaggaagccaagcagcagcagcagcacatgatcgaagccgagctgcccggaacgagaacggtggtcgtcgaccccgtgtgggcgggcggcctcctcgactgcggcgaggaccccgcggcgtgctgcctctcgtcgctgtgcaccttctgcgtgttcggctggaacatggagcggctcgggttcggcaacatgtacgtccacaccgccatgttcctgctgctctgcgtcgcgcccttctgggtattcaacatcacggcgctccacatccacgactacgacctgagcgacgccgtgggcgccgcggggatcgcgctgtgcttcctcggcctgctgtacggcgggttctggagggtccagatgcggaagaggttcgcgctgccggggagccggtggtgctgcggctcggcgtcgctgacggactacgcgcggtggctcttctgctggccgtgcgcgctcgcgcaggaggtgcgcacggggaacctgtacgacgtcgaggacggcggcggcgtcttctacgagaaggcgatggacggcggcgatgtggagggcggcgcggcatcgacggctgcgacgggagtagtgccggtatcggtgggtggaggagagggggatggcgttgtcggtgacataaaactcggtatggacggtgagatgatcccacccgcgcaggcagtgatggagaccagtggcgatacgcaaggcagtggtgcagacgttgcggcaaatggtgacaacgagctcagtagctaaacccaagggtgattatctgattgatgttatggtgtgcagaagctgcgggggaatcaatcttgttttttggggattggcaccatctttccagcattgtgctcttgctttgtcatgttctgctcagctactgttttcgtgtggcaaggtttagggcaggtaccatagcagaatataaaccaactataaatatattttaaagagataaaagaggaaataaaagagcagcaggctacagatctgtagccagttacagcacgaagatattaatacttcctccgtcccataatataagggattttgagttttttcttacactgtttgaccactcatcttattaattttttttggaattattatttatttattttacttattttattatccaaagtactttaaacacaactttttgttttttatatttgcacaaatttttttttgaataagacgagtgatcaaacaatgcaaataaaaattcaaaatcccatatattatgggatggagggagtagtatagtaagaccattcctaacccaagacattagacatagtttccataaactccacatcatcaagaaactagtattaggcaccactcttccaatataaacaccactattacatacttaaatttaatgtgacttatctcacatgatgtcttgaatgtggggccggctaatgggcgggtgaccgccataggcgatcacccccctatctcccctatacacttctctacttacttcatcctctccttctcttcctactacaccataaattttaaaaaaataaa

SEQ ID NO: 44019 - DNA, 4779 bp, Oryza sativa
  unsure (1)..(4779): unsure at all n locations
nnnnnnnnnnnnnnnnnnnnnnnnnnnnnnnnnnnnnnnnnnnnnnnnnnnnnnnnnnnnnnacttaaatttaatgtgacttatctcacatgatgtcttgaatgtggggccggctaatgggcgggtgaccgccctaggcgatcacccccctatctcccctatacacttctctcttccttcatcctctccttctcttcctactacaccataaattttaaaaaaataaaaaacacaaagttaaaaaaattatgtatagaaatactatatataaaaattttgaattcaaattcaaatttaaaacaggtatgtaaacttttgacttataaactttgggtctataaactaatatttgaattcaaattcaaatttgaatcaggtatgtaaacttttgacttataaactttgggtccataaactttaggtgtataaaatttagatgtatagaaatactatatataaaaaatattttgaattcagaatcagatatataatcttttgatttataaacttttgatctctaaactttatatgtgtaaactttaagtgtataaatttactataatatgaaagtaatgcggtgccaaaaaaagaaaccacgtggagaagagggggcgtgctaggagcgatcgatcgccccttagcaatcccgtttggatgttgggtagaaaccatgtcgagacatggtttccttctttttcctcatttattcacttgccacattatttttcattttaggttgcagcttatttgatgctatggacaccatcctagttattgggttgggaatgacctaagtaactattgtatgaattagctattaaattagctatagataatttggagttagtagttatggttggctatactaaacttgctagtagggaataatctgtgcacaccagactctcgtgacaaggttcagtaaattcagagggaattagttggagccagttcaaaaggagattcttatgtggaccatagtggccttcggcaatatggattagtagtttagtactgtactactccttttcgagtgtgaaatgtataggtaaaggagaatgaatagatgctgtagttgtatgtgctttaattttcacggtggagaacaaaagttgcgcttgcttgcagaaaagagaaaggcacggtcgtagattatttaagcttcagaacagagagacaaacagacatctacacttcgaagctgtgtaaacctgtgagagtcaatctctctctactttccaaacatggctgtaagctctactctgttcttctgtttatgcaacagtactgtataattttaagctctactctgttcttctgtttatgcaacagtactgtataattttatctgtagtactgtacatctactaattgatcacgcatatgcttctcaacaacgggtctgaattttttttgttttgttgcgacaggtggtggagttgaaggttgggatgcactgcgacaggtgcatcaaggcgatcaagaaggcaataaaaacgatcgatggtaagcattcgttccactgaatctgtcatttttatacgctacaaaacatgtacttgtatggttgcatgatcaaccgtgcttcttctgtaaaaattaacagatatggagagttatcagctagagacagagataaacaaggtcaccgtgacaggaaatgttaccccagatgaagtcgtcaaggctctgcagaagattgggaagacggcaactaactggggtgaagactgaagtgttcatctttagctagtagtatatatcagctgatgacttgatgtccttagtccttagtcctttctatggttactttgagctgtttatactgcagatatacagtagtactaaggaacataaagtgggtaaactcggcattgcttactctccctcagtagttgattaatgcaatggattatgcgttgccctgttggattaccttacctcctttgatgtgtacctgatttgtttgcaaaatcttccggatgatgagacaaacttttctacgttttcatggaggatatgcatgatatgtctttattcagaacaaaattatccatcctttccttcaaaatctgaatcagctttcgcttgcactcctatagaccatcttctcgaaaaaagaaaaagaaaaaccctgtcaatggttggattttgttcttccaaaaggataaaaaatgttggagcttgggggcctgaaatcatgtttttctcttctgctgctgcttgcagttcataaaggctgcaaaattggttcttcttttgcttccaaccaattcgtacctgtgaatgttacagtgtttaggcattgtttatggaacagacagaaatccgatgcaacacacgaagttatgtgagatttgtttaactccaatacatatcctaaattgggattcaaagcgtgtcagttagtttgatcctgcaactaacaagaatgatagaaataatcaaactaatcaaccgatattgctatagtgtggtagatgtaggtccaatggttaaagtatacatcggctggatatccgatgcaggtagattcgcatgtatatcggctaaccaactgatacatctaatacctgaagctcataataatgataacttatcggttaaaaccctgatgaaacgttgcatcatattgacttagtagatcaaacttattagcagcaatttaatagatcaaacctaaccgagacaatataagattgaagataaaaagaaaaacatatttagctgatagatctacacaaccgtgatggatatattggatcaatctaaaacaacaatatgattagagaaataccaactgtcgacgtttgaggtcacaactacagtatttgcatggtatggggatcattgataccaggtaaaagatacagagacaatgatttttatacaggtttaggccccttcgtaggaaggtaataaccctactcctattggccgaagccggtgttgctctatatttatctaaatcacacaagtacaatatttgggataatctatctagatgttgtcgacttggcggcatggataaccaacacgtagttgacgacaagatagtcttccttttcgagtacaaactcattgatataagagatggcgctagatctctcttgtcggcctctgcaggcaccatattgggtatgtctaggcttatctctgatgtcaatgtctggcggcatgtgttggtctctattctgatttgtgtgtcgatctgtctcgttgtgtcttctctcctcctaaggggtattgtatttatacccatagatgttcccttgcccaagtagaactacggagtcaagtatggatacaatccgattagttcttatagttttcaaataaaactctatttttctttccttatccgaaactccttctatatgcgaggtatgatttcgtataagacttggtatatggtgggccccactgagcttagtcgattactatgggtatgtggtatccataaccctgacaccaacctagttagaatatcagacttaaccaagaaaatcctaactaagccgatacaactctaaacagctatgcgattaaagatagagttgatatatctgataggcaaagcatgtaacagtctagttagaatatcggacttagctgaaaatgttctaaccaagccaatacaaacaaagttgatagaacttacatcctctccagtgaacgaacttaaccgatgtagtccaactcgagagcatggcctcgaacttgatttctcgccagagatcgaacttaactcatgcagcccatcctaagacaaaagatgtaaaaagacattgggtgtacatatttataccctggagtttgtgcaagtctaaatcgaacacgagataagatttcataactagaaaaaaaaactaatcctacttatttaagagagatactaagaaaatatgagaccatcctgatgtggtcttcccgactcctccttgaattcagccttatttatataaattttcagctaccgagcagtttatttccttactcgaatccactaaaaagagctttgttccggtgcattaggttataccttcaggtactggtatcaccaggtatcaaattaaatcaaaccgttattcaatcaacagggacatgataggtaatgaactaaaacatcggtggaaagggaatgtgcaagtgcaaccatcctctgcgtcaagcatgtgccgctgccgccgctagcctagagatgtcaaaatgatgggctgcaagcttggatccatgaccgacgagcactaggaggtgagggaacaagatcctctaacgtagaagattctacgtcagaaggatgtagaaggcttgagcgccgtttatttcgcatctgacggcagcgccggttttctctagcctccgccctctttcgaccagtccagaagcgcgatggttcggcccatatgcggtcaaagcgaaggggaaaaaccacgcatggaaagaaaacgaagccgcccctagtcggccatggccattggctacttgctgccgttcgtcgatcatcgcctcccactacgcgggtacaggtcaagcaaatccccgaggaagcaccttcttccgccgccctctgtagcgcccgttccgtcgtggcgcctagcgggaaaatcatctcttaaaaaccctaattgcgaaatttgtttctttgcttgttgtctagtgtccgtgccatctcaagatctcaatccccgatctatcgtcaagtccaattccgaatccaatccttccaaatcaaattcctccgcaaaagtctattttgcctcccccgggggtcgatgg

SEQ ID NO: 44020 - DNA, 16315 bp, Oryza sativa
  unsure (1)..(16315): unsure at all n locations
tcgctccccttctccccatccctggcgagcttcccgctcgcaaagccggcccccgcgcgccgtggttcgcgcgcgcgcccgcgtggtcgtcttgcgccgtccgcgtggtgccgtccggccccgctgccctgcccgcctgcagccgctcggccccgcagccagcgcgcgtgccgagccgcgccgctccatccgccgctcgttgcaagccgcgcgcgcgtgccgagtggccgaccgcctggtcgccgccgtcgtcagcgcctgccgcgcctgccgtccgtgtcgccgctccgctccacaccgcccgccgtcatcgccgtcgtcaccgcccggcccccgccactccgcgcgcaagccgccaagggacggaggcagcgcccctcctccctctgccgcgtcgcccccgctcccctcctcctttttcccgaatcagcaaaagggcaagcccctttctccccctcctttttcccctttccccccgccggcgtcatcctccctgtcgccgctttggccgcgaccgccgagcgccagctcgcgcccttgaccgcgcaagtcggttcccaaaccgacattgccgcccatttaaaccccagcctccctcccttcctttcctctcccttttgtctccgcgccattgccgccgcccccgtgctctgttcgccgtcgccgttcgttgttgcgcgtgtcggaggagccggcacgagcaaggacgcggaagaggacttcggccgcgccctctccttcctcttccccggcccgaggccggagagattactcccgcgccgtcggcctctcgtcacagcgccccgacccgcacggtagtgcctccctccgttcttcctcctcgctccatctcctccccctagctttcggtagtagctcgagtagactccccgtagttagccggcgccgccccgaccgttgccgtcgctcgccgcgtgctcgccgccgtcaccgctcgagctccgtagcacccgcacgtcgccagcctcgctcggcgtagctccgtccaatccgacgcaagcatcgagttcccgaaaccgcgtagatgctctcaccgccgggaatcgacccctcgtggcctcgccgccgtttccctcttccctccccgccggttgtcgccgccgtgattcgccgccgtcaagcttcctccggcaaatccgagccgttggctcgtctcccctcatcacgaccaaccgcccggtgtgctagcttttgcccgtatcgccgtggtttgctccgccgctcgccgccgccacccgccgtccattcgcggccaggtcgtcgtctacctcccgccggcccgcgtggcagccacgtaggcgccacgtcggcgccagaccgggtcgagccgaccccggtcagtccctccccgtgcgcgcgttccaccgcgagccgtgaggctgcgcgtgggcccgccgcatccgcgtccaccgcgaaccgcgcgcgtgcaccacgtccctcccccgcccgtgcgcatgagccacgtactccctccgcacggtgagccgagccgctgacaagcgggtcccacccgggaccgcgcatggtgagcccggtccaccggctctctctctcctccctcccgcgcgcgcgtcttgggccgctgtgggccgccttcttgggccggccagcccgttaagctcggccgagccgccctttctctcgggccgcgccctatccgcccgagggaagtatatattccctccctctccccttttcttttctttttcttttccaaaaaaaaaggatttaattaaatcattttcctttagaccaaaaatccaataatcttagaaattcaatatcttcccaaccgtaaatccgtttgactccgttcaaattcctaaatttctcaaatctcgagatctatctaatggcacgcttagaggtcattaatagggctttattttcgccgtttgttgagttgtcccgttttgcgtatagtttcggagcccgaagacccgctgtgcgaggatttcgaggatcaagctccagatctcgagcaaggcaagccacctttgaacatcttgagcctataattgaaatctaattatattgcttacaaaatattatgcattgataggattgcacttaatctgttgttccgtctgcaaggcaaattggcagacctacctaacttgttgcatttgatccttccattgttaattgctataccatgtccccttgtaaccatccagttgcgcctcgatattcgtgcaccctgtgccagtatcgacggtcgcccttaaacttaaaatctgagtaacaacttgggtaaaactggagttttacaaaagacttggaaaacccgacacctgggtcggtgcttgcgaactaaatgaatttccaaaaccgcggaccgggaaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggatctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagtttggtttgactactgcttgtgaaattgctgtgtgaaaaggggttcggtgtttgaaaaatctgcagctgatgggatcagctaggcccgggtggccgtttgaaaagttgttggcccgggtggccgtttgaaaagttgttggcccgggtggccgttgaaaaagctgttggccgggtgccaaccttgttaaattctaaagactgatacattgcacatactccgaccggacgagacgcactgtctcatccgtgtcgtttgagaagcactcacttagttgtttcagaaaagagttcaattaaaattaattgcaaaaacaccagcctttccttgaagcctgcattaaacacttatttcccatggcttgctgagtactcccgtactcacccttgctctatataaataatcccccccagttgctgaagaagatgaagcggatcctgctgatgaggagttcttccaggagcaagccggctacgatgagttttagggtttcggcctagttcccaagtcgcgcctgtgttgattggtccaagtcctggcttccgctttccttttgtaatgcagttgtgagctcgggatttgtccgcagcccagcatgactgtacatctactctataataaagagacctctgttgctgtgatattctgtctcactgtgatactagcactgtttcctgggactggtatcgattaacaggttaatttggagcgtcacggactagttccggtcgggactagttcggggcgtgacaccctcctccccatcccttgctcctaggtcctcccccgcgcggttttgctgccctggcatggaggttgaggtccacgtcgatgggcttcagaaatttgcggaccaaccgcccccgcgccatgctcaatgcctcaataccagcaactctttggaacctcagcaagtaatctcacgttcctcaactcgtgcgcatgctcgccttttctttttcttatggcacattctgctagttgtttcgttgcaacagacgtaaatcaaggaggaggattggaggaaacgaacagtagcagctcaatcgatcggagtaatgcaactctgctgattatttactcatatctcatcttctcttccgttcccacgctagcttgcacacatgttagtatgttacgcgttcaagggagacgacgagcgacagcgagtggccggtggccatggccgactagtggcagcttcgttttctttctccgatcgtcgtttctccccttcattttgttcgcaactgggccgcgaagcactgcgcttctgggctgatcgaaggaaaacgagcacggtcgtcggatgcgaaataaacggcgctgctgctttctacgtccctctaacgtagaatcctctacattagaggatctggtttcggaggggagcggggcggagatatccggcaagctcaccaagggacgtagtgggaggcggacgtggccagcgagctcgaatctgactagcaaaattgagaaataaccgtcacaggaggcgaaggtggctagggagctggttgctgatggcgagctcagggagtgccgtagctagagaaggaggtcaccatgaccagctagcttggatctagcacaatcaactgtgagcattttcctcgccgaaagaacataaaggaggagaaagaaaagaaagatatatagcgcgtgaaaatttggaaggggaaggttccacatgaagtgccttctagctcgccggctccctccgcctccattccgtttggccactccatcaccggcgagagccctaaagaagacactcctgcttgacatcttcatgagcgagaaaagataagaggtgaagaagatacaattggcacacggaattacccttttcagtacctcttcatcatctacagtataaaatcatgtgggttgtaccaccaggtaatagtttttcttgcccattcaaatcaaacccttgaatcaaataaatcaatggctcggattatatgtaccggtacaacttgctggatgataaaatggctccactaaagaaccgtagtaaattgagggcagctacacaacgggatactgttgcaacgggatattttaagtgactctcccttttcctttcctctgtccacgtgtgctccctggtacctgatacctggtaccttaggtaccggttggtacttgttacctggtacctttggtaccgactaggtatcaaccgatacctgatacctggtaccttaggtaccggttggtacctggtacctggtaccgactaggtatcgactgatacctgatacccggtgccaaggtaccgggtggtacctaggtatcagcctgatacttgtggggtatcagagggtactgtcaaaaagaggaggagatgtgggggaaggagggccgcaacggaggaggatagcgtcgaggaggcacggcgagttgagggtcgaggcccgagccagagagcgtgagaagtctcgaggaggagccgaggaggaggttgacggccatacctgttgcaagtcgacgcaggctgccggcgtccatcccggaggcgcaaagcggcaggccgtagcggggatgacggtgacaccgaggccgagggcgagggcgaggatgaggggagctcccgcttctgccctccccgaggcgacgactccccggcgcacacccgaccgacgagggcggcaagccagagcggcgcagcaaggggaggcgagctcgagggcgaccctgctgagggttggccgacctcgccgacgcagtgccgtcgtcgtcctcctcggccgccggagacgacgacgacgaccccttcctcccggccagctttgtctctgctcggccttcttcagagagagagagggaggaggggagtgaggtgagagtgatggggattgcgtcgtgtggataaggatgcgggtggtcggatggataaggttgaagagctatctcgacaccacgggataccggagagtagattttctctagtaaattttggtgttaacaagagcacactaagtcaagcaaaacaccgggcaatgtactcttggtggcaatgtttcaagtaaacaccgagtaacaatataaattgactgagactattcttggtagctactccctccgtcccaaaaaagacaaaccctggttttcgtgtccaacgtttgaccgtccatcttatttgaaaaaaattaaaaagataagtcacgcataaagtattaatcttgttttatcatctaacaacaatgaaaatactaattacaaaaaaaatttcatataagacagacagtcaaatattggcacggaaacccagtgtttgcctttttttgagacggagcgagtacggagtactggttacctagaaccatgcaacttaatggtccaaaaccggcgccctcaacaagacaacgacccaattcaagaaagttacccgtttctctgaaaaatcttgagatcagctgggtctttgtagttaactactaggtgcaatccaaccacaagccgatgtatgagcagaggagatactgcaggtacctcgtcggtgcattcatatgatggagattaaaagggacaggagatcgattgtaccgtctcatactgatccatcaaccatgaccatgaggagtggaaggagactgctaatttcaaccatccgttttgacaagaaagacaccgctcgttcgtttcattctgaagtttccttcttcgtaggaagcaaagaacatgcgcgtgtgtactgccatgtcacatgtgcaacagagtaatggccatgctcgtggcagctgtctccgatcgggaggcatcttcccagaaagttttctaccacaagcccatatgcatctgtcacagaatggtccgcatcactggttaatttgcacacgcgtttagcagagtagaactgactactgagctgaatcttcattcgtcgtacgaacaaaatgcagcagtgcgatgacatccgtgcccgagccccgcgatatatcctcgttaccgcttgaaccgcatgcatgtcagcacttacggcttatagatcttctcttccgttttggcgaacggtagtaaggcatgcggtgacgtcttggtttggaaacttttgcagcacacatggtaagaacaacacgtacgtagtagtacgttgggaattcgcgcagcatacacacgggtcaagcctttgtcgccgtgcgcgcgtgcgtgcgtatgtacgtacacggcggttcagaagctacgagacacggcgttgcttcgttcttgcacgtacgcacctgcaccggcaccggcaccggcgtgtaccgtgccagtgtctagtggactgaagacagctagtaccacgccaaatgctagtagtagtaattaagtgccacttgttgaaatctggtgtgaaatttccaatttttgatgttctaacacaacggtctccattttcccgacgagtagagatcgagcaagtgattaaaaacgcgcatacatgtatgatcatgagtcgtcaaaaggaagtttctcttggtgtaaaaaaaagtttttcttctgttttcaaaattacgagtcaaagaaagcttagcaaacatgagtggcaggagcagtagtgtgattataagatcaagccatcttataattaatcaggagtgggccgtgggcgagtggcacatgcttcgaagaaagacgtgaggatcacaaagaaaaggtcttccattttccaggaatgagaatatatatgagatgaacggagaactttgatgagttcaaacagaagcagcatggagaaaggagcgtccaaaatctgaatggcccatggcaagatctagcgaacaaattaaaacagatggaagtgctcaccaaacaccgtagagaaacgtcagcacgtagacccatccgtccacgtctccagcctccaagtcacaaacacgaaaaaggaacactggatgccaccaggatggatcctttttcgcatcttgacgccaacgagtagctagttaagagtaatcgttcatatagcacctcaacgtgttcatgtgtcctttatttttggataattttatttttctgctcgatcaaaccatattctcttttctgccatcaaaattttgctcttatctctttcgccactattcatttatgctcatgtctctcttttacaattgtcattggtcaatgccaattgaccacaagatttgtccataaaagaccattatacccttataaaacgagattgctaaggggcgatcaatcgcccctagcgattagattcggaccccccctccctccacctggttttctttcctattttagtaaatttatgcacttaaagtttgtacacctcaagtttacacatctaaagtttagagacccaaagtttataaatcaaaagtttatatatccgattcaaatttgaatttgaatttaaatatttttatatatagtatttctatacatctaaagtttatacacaaagtttatagacccaaagtttataagtcaaaagtttatatacccgattcaaatttaaatttgaattcaaatattttttatatatagtatttctatacatctaaagtttatacacctaaagtttatagacccaaagtttataagtcaaaagtttacatacccagttcaaatttgaatttgaattatatccgattcaaatttgaatttgaattcaaatatttttatatatagtatttctatacatcttaaagtttatacaacccaaagtttataagtcaaaagtttacatacccgatttaaatttgaatttgaattcaaatattagtttatagacccaaagtttatatcaaaagtttacatacccgtttcaaatttaaatttaaattcaaatatttttttatatatagtatttctatacataaattttttcaagtttgtttttttatttttttaaaaaatatggtgtagtaggaagagaagaaggggaggagaaagggggggagaggagtgtataggggtggatggggatcgatcgcccatttgccagcccccttataaaacactaaaaaaagagagatattcaaaaattcaaggaaatatagtttttcattttaagtttccaaaggttgtgtacaatgtatagtaagatatttaaattagttaggatggttttacatgtaactttaaaatgagatattttaagaaaaactttgtttcttggtatttcttggtgcctgttaaaatttcaattgttatttgattttgaaacatccgcaagggctacataggggtgtaatggccttttatagcaaagttaatggtcaattaccattgacttgacggccatgataaaatacaacccacactaacagaagaatggtaaaagagaaaaatgcaatctttttaagagtaaattttatagaacccacctattatgatccaggttgtacaaatcacatggattttagcacgtgaaatgtaaccctgagtcttatagtcctaaaatttcacaaaaccacacagttaacgatttctacatactcctatatcaaaataaaaaaaacggatgtaacactcatataatagacaaaaactcaaaatattgtgatacgattgtagaacttaaaaaaatatggtagatcaaagtcaaagtggttaacggtgtgattttgtgaaactttaagaccataatatctggggttatatatcatgtgtcaaaattgctatggtattgtacaacttggactataaataggtggggttttgtgaaatttactattttctaatgatagaagggataatacaattacatcgagtggcaaaaggaaaatttcctgtttctttattttgataggtatagcacctcaattcagtttggcgctcttgtcatgtgagcttttctttctgtggtgacatgcatctttagaaaacgggatttccaataagattatcggaaaaaaaagaaacatttccaacaaggtgggatcctgcaggatcccctgaaaaaaaaaaatactgagatcttgaaagtacagtaatacacagtatatcagggttgtatctgcaaagttcttcagagaacaccaacaatctgtcctggtgactgggtcatgttgaatggtctgctaagaacagcgtggcagtaatgatcaacggacaacatctctgctccaaacccaaactgaaaaaagggtaataaaacgctccaagtagcagggacataattgcgatttaggacacacgcctcctgtagtaaacttgctccatggatttccttccaaccatctgacccacgagctaatcttgaactagaaaaccttaacagacgcgttgaattcatgcagaaggtaaagattcagtaaaatccgtgaggtagaactaggaaaaccagccaatccgaatcccaggaacacacggctagctcgaagaagattgcccaaacaaaatgcctattctacatctcgaccacatggtctcatttctgctctcaagaatcacatgcctattgaattccgtaatcattttcaagaagcaagcaatccggagatgtatattttctgatttcctcgtatgaacattttgtttcccgtgacctccctcctgaaataaaaaggggttgcattcagagtttgtgaacccaggaatgttcagaaaatcggagagctcttgttcattttttcagcaaaaactagccggtcttttcgtttcctgacgtcagtaaggctttgttcggttaattcttgtgagggagggatttaaggggatttattttacacctattatgatgtggaattactccttctcaatcccctccaattctcttcaattccctgtaaaccgaacaaggcctaagggaggtcctgtgaacccaatagtttataatgagcttaattaacttaatttaagcataaacagagcacggggcttcatttatcaggtaatcaggtttccctgaggcatttatgtttgacttgttactgtataaattgtagaatttcgtcgcacgtcaatatgcatgattaaatataatcttgtcttagtgaacaatgaccatacgtatactcggctgactgcagttctgccgtaagtaaaatggtgatcaaacagaaaagaggtcaaaaccacttattccccacttcaaaatttaacaagcagtagccttgcatctagaaagatgacctacctgaggtgtaattttacactcctttatgatccacaaaattatgatcaaataagaacgaaaaacacaacggatccaatttaagaacgaaccagtaaaaacaggcaagcagccaagatagcatcagaaatagataaacctgtgtgtggtgtaacataactccaattaataaacaaacaaaatttgatctaaaaatattgtctcttgtcctgtagtttgaatcattttttacccctggacattacctttaaaccgaatttatttaccgcaattcaaatccaccagatttacccataatcccattgaaagttttgagcaggtcaaagaaaccattcctggccaccaacctctctatccgccaaaaaccctacccgctccacacgaaacaagccgcacggccccacgcagctgcgaatcccgtccccttagtggtgggtataatatctcgtcagcttcgcgcaagcgctcgcacaatgcgccgccagtcaaacgccacgagctttgaccagtcaacggtcaaagtttcaaacctctatatagtttctcctcctgtccgtccaagcaatccaaactctctcttccctccacccccgcttcctccttcttcccgtacgtacacgccggaggccggacagagacacgaaccgcacggcgacgagctgtgagacgcggcggttttggtcgcgacctgagggattccgatgacaacctcgtcgtccgggagcgtcgagacgtcggccaattcgcggctggggacgttctcgttcgccagcgcgagcttcacggacctcctcgggggaaacgcgggagccggcggcggaggtgtgtccaggtacaaggccatgaccccgccttcgctgccgctctcgccgccgccggtgtcgccgtcgtccttcttcaacagcccgatcggcatgaaccaggccgacttcctcggctcgccggtgctcctgacctccagtgtaagcacgcacgcgaatgggccgagctccattaatggcctaatgccatgtcatttctgtacggtttttcagatgataatgagaaattgagaattgaaccttgccggttttcagatcttcccgtcgccgacgacgggcgcattcgcgtcgcagcactttgactggaggccggaggtggcggcggcgcagagcgccgatcaaggcggcaaggacgagcagaggaattcctactccgacttctcgtttcagacggcgcctgcgagcgaggaggccgtgcgaacgacgactttccagccaccggtcccaccggccccactggtgagtgagagcaaccataacgtcagctgttaccctttttggaggggtccttcgctgactttgtccaaaagaaactactcctagcatctttctttcttactcctagctaaggcattttcactatttcagtttgcaaattgcaatagtcaaaacccaaactatagaagtagcctctaaacaataaccttttctgacagggggacgaggcatacagaagtcagcagcagcagcagccatggggctaccagcagcagcctgcaggcatggacgcgggtgccaacgcggcgagcttcggtgcggcgccgttccaggcgacctcgtcggagatggcgccacaggtgcagggtggcggcgggtacagccagccgcagtcgcagaggcggtcgtcggacgacggctacaactggcgcaagtacgggcagaagcaggtgaaggggagcgagaacccccgcagctactacaagtgcaccttcccgaactgcccgaccaagaagaaggtggagcggtcgctcgacggccagatcaccgagatcgtgtacaagggcacgcacaaccacgccaagccgcagaacacgcgcaggaactccggctcgtcggcggcgcaggtcctgcagagcggcggcgacatgtcggagcattccttcgggggcatgtccggcacagcggcgacgcccgagaactcgtcggcgtcgttcggtgacgacgagatcagagttggctcccctcgggccgggaacggcggcggcgacgagttcgacgacgacgagccggattccaagagatggtgagtgccctgttcccaaacctcttcgcgccaaattatgtttgttgagataaaacagtgaactgaacatgttcaccataatatcaggaggaaagacggtgacggcgaggggatctccatggctggcaaccggacggtgcgggaaccgagggtggtcgtccaaaccatgagcgacatcgacatcctcgacgacggctaccgctggagaaagtacggccagaaggtggtgaagggcaacccgaacccaaggtaaataaagaacccaaaaagtccatttttcagttcgtctactggtgtgatcgcgcgtgtgtatctctcgtacttgtacttatcgtgcgtgctgctttcgtgtctgcaggagctactacaagtgcaccacggccggttgccccgtgcggaagcacgtggagcgcgcgtcccacgacctgcgcgccgtgatcaccacctacgaggggaaacacaaccacgacgtgcccgccgcgcgggggagcgccgcgctctaccgccccgcgccgccggcggcggccgccaccagcagccacccgtacctgccgaaccagccgccgcccatgtcctaccagcccacggggccacagccgtacgcgctgaggcccgacgggttcggcggccagggaccgttcggcggcgtggtcggcgggagcagcttcggcggcttctccgggttcgacgacgccaggggctcgtacatgagccagcaccagcagcagcagaggcagaacgacgcgatgcacgcctcgagagccaaggaagagcccggagacgacatgttcttccagaactcgctctactgactgaaagaatcgtcgtcgtaggaatctcaaagacatgacacgacggaaattgtagtttaggggggttttgtacttgtacgtacctaggatatactgtagtctttgatacatttgtttatttgtttggagggcccaggaatgcagatggctgcagaaaagggtaccgtcccttaacactggagatgggaggaaaggatgtactcctgtaggatacacagcaaattttgctctgtaatttttttcacatagaaaaatgttgtatacaattttaattttttacatcatcaaagattcatatcctctaaatgtaatttactagggggaaataaatatatatgtgtgtatttaagcaataccagaccgatcagtgctgcaactgtacatactgattgaatcaaatcggtttccggcagcccttcctaaaaaggactgagtaagcacaatcaaatttcttcctgtcgggctctgacgtgttcagtttcatcagcatagcctggaaaactttcaagcctccttgcgtggctacacgccaacagttcaaaacacctcatcagatactcgcgttgccgagagacgacagatgtgcacgactactactaatggacagggaacagcaaaactgagttagaactagtcagcaaagaaaagcaatcgagtttagcagccacacagcgcaagtatttggccgtggatcttgaccatggttctcacatacctaacgagctgaacgtcatttgaccgtgtccccgaaaccaaatgaaacggcagaggtccaaagtccaaaccacgcagagcaagtcagctcccgcgccatcgggtacagcagtaataaaccaagcgcgaattaccccgttcgtgttacgtaaccgaggccaaacacatgcccgcccgccaccacacgagctgagcacgtaaaacccaggccaatctaccagacgtccacgagcccgaacgcggtaaaagacacacaattgtgtgcgtgtttgcccgcatcgctcgtgttacgcgggatggctcgcgtcagcgagagcgagctcgcggaaggatcgcggacgagatggttttggccgagcaagagagaaggccgggccgcgctcttgtggatgagatggcagcagcagcgggacggcacggcgcgcgggaccgaatcaaacggaggcaggggtcgctgcacctctccccatcgggcatcggcgcggcgtcttttgcactttttttgtctttgcgcctccagatggacgcggaccacttccgggcgacgttgatgcgttcaggttcggggccgggcgaggcggatggatatggtcatatggatatggatgcaccggcacgaagatggctacttgccaaattggtgtcgggtgttcgcgttggagctcagctgctgagatagagcaaatgagcgatggacgtgtcttacagtggactttactggtgggcaatctaaattaaggcgcagttcacggtggaggctatgccaactttatggagaattggagatcatgaatattacataatcacgcttgcttatttgactagagatagataatgggtcggatctgcctacacaacatttgacagattttctagggtcctatcatgcagatttttggtcctttagatctacatctaacagcagacaaaaatatacagaaacaacactaaaaaatctggaatttttttttttaattttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgaatttatactgtgctttatattttttataaatatcaatagttatcaaatttttttatattgaaaactatacaagattaaaatctccaagactggtaaaatacaattttattattttttagggtctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatcttaaatctagattacgtattaccaatgaataggcttcaatcgaaatcaaacacaagtgctattcaaattaccaaaatattggtagggcatgtttttggtagcaatccaaataggcccttagtcttacgcatacaaaaaatcaccgccataattaaacattgtaatgataagatagataagaagggccatcgatacannnnnnnnnnnnnnnnnnnnnnnnnnnnnnnnnnnnnnnnnnnnnnnnnnnnnnnnnnnnnnnnnnnnnn

SEQ ID NO: 44021 - DNA, 719 bp, Oryza sativa
actatagggcgaattcgagctcggtaccctcctatctgacaggcatgtgaggaagatgtaaccatttaaggatgggcagagtaggttgatccatggtggccatcggtctctcgtggtccactcacatgttgcatcatggcactgcgatgcaaagttcagttccatcttcccccgtgtacttggatggacaaatgctatttattcgccgaaagcttgcagagccatcaacagatcaactccctctagccccctggccggcaagaggcgtctccgccgtctagctccgtacgtacgtctccgatctttcagccggtgagctactaaaatcatttatgatctgcgtggttggttggcagtattgttgagactgcaacatcgacagagcgatctatcataagctcagcttaggctgtgttaaagagctccataagatgcttgttcttgaattgcttgtaaaaatttgcacccatgtgacgcatgcaccaccgacttcgaacatcgggccacttaactggaagtcccttctcatcccaaccgttctgcaagtagtcaatagcccgcaacatacccccatgaagaacatgtataaagcaaacgttgggcctcatacccaccactgcaatgtgcactctctctaggaaccagtaccagctttcaggggtctcactctctacaatgcaaaagccataagtagaaactggtttgttcccattacaccc

SEQ ID NO: 44022 - DNA, 7928 bp, Oryza sativa
  unsure (1)..(7928): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttccaacattttaagactacgtcaagctccaagaacagagtcgtaatcgagataattggatgttaagggcagctccagctctagttcgaagccacaattcactgttaacatcgatttgtagaaccgttagccgtctccgttaccgttagccattgacgtgtttaaaaagacatctagtgtggccactagatgtcgcgatgtccacacgcggccacactcagagctttttgcgttcagcgaccctgtcgagtagtcctgatttccgtgtccaacgtttaactgtccgtcttatgtgaatttttttttataattagtatttttattattgttagatgataaaacataattaatactttatgtgtgacttgtctttttaattttttttataatttttttaaataagacgaacggtcaaacgttggacacgaaaatatagagtttgtcttttttttttcttcgaacggagggagtaggtgtcgtgcagcgcgggtacgagggatgctcctcaagctcaagcaacctgtgtacatggatatgacgacgtcgctgggagcgagagagaaaatggattctcgggaatataaagttgatatatgtagcacagtgataatcaacaacaactactcgtatttaaaaacagatgccccttcgtagctgcattctggaattccttgcaaatcaacctgaacatcacctctatgcaggagcttcacaatctgcccagaccaagccggattccgaccaaacacttcgaaatcttctagtacctccgcttctgggggctgttgaatcatcggcagacgtcgtcttcagaaagcagaacccctccggcctccaccgcccggctaatttcaaaatgtctagaagatgcaaacctcaggacggaaaggttaaaatgcgccgacaggattgcagtagaatctggaaagaaattctttcctccttgctgcaccccaatgtaacaaactaatcatatgtattgtttctccctttaatgaaattcaggtgggaaagctcttcccccgataaccagttaaaaaaacaatggtgaagaaatgctctttactctcggtttagaaccctctgtagttcggtttttctatgaattcgggattaaaaatcgctatgtttagttctggttcaaatacccatgactaaatatcgatctttaatcctgattagtaacaccaaccgggagtaaagaggggaatcttttagtcccggttggtgagggtagcgccacgtctctggtcccattcttctctttttttttccatattgatttcacaccaatctcaccaaaatcatcacaattccaaatagagatgctccctacatctccagatcaaagtaacaataacacaaatcataatattcacatcacaacttgtcgaaaagaaacatcacaaattctaaaaaaaaattacatcacaaatacatcatagatcaaataacacagatccaataaatcataaattcttaaaaaaaagaaaaaaaaagaaatccggccgcagcgagctcctgtcgcgccgccgcctcctcctgcttcccgccgcgggccgccgcccccatccggccgccgccaaccataccccgccgccagcctcgctggccaccgctcgctcctcgtcggtagcaactgtgagaggatgaggaatagaaagagaaggatagaggacaagagtgagagagaggatgaataggagatagaaaattttgaggataagagagcaagagattatacacggtatattgatttttggtcctgattgggaacaactactaggactaaagttaggattttagtcccggttaatgttaccaaccgggactaaaaatatctgggacctgacagcctctgacacgaggtgaaccgggactaaagatcatcttaattttactcccggttggtgttactaaccgggactaaagatcacacagtccctttatatttataaactgctttttagtcccggtttttaatggaattgtaactattgtggatttggattgaccgactaaagatggtttctcttactggcgtccaaacacaaacaacaaattaagcttgatacatgcatgttgatgtaaaaagttttgaattggtttcgagtgtccacaaaaaacaaataagatgccccatggatgcctgcctgcaaacttatactgtctgcttggatgatttccttggtgcgatcctgttcttgttgtgatccaattaatttggcagacaccaattttctgcacgcgtacatatatatcgatccattgttactagtcaaagaaacccaaatgcatatgtatacgagtatccaaaatgcacgaaactgaggatagatccatgtctctttcttcttcatccattcttcctccgttttgctagagaagaagaacagctctggcactagtactactactactacgacaaagcctgaatttgttttttggtacgaaaggagtatacacgaaatgcatggcctgctttctgacatctcgtctataaataccctgatgtgcatcctttccctacaccaccacatcgataacattcgatcacattcggctagtaaccaagcagttcttacgctagagctagctcgagcaatggtgaagtgggcagctgtgatggagatgcttctgctgacggcagcagcgacggcggtagcggtggtggcggcgcagtgtgaccctgagcagctatcggcgtgcgtgagcccgatcttctacgggacggcgccatcagagtcgtgctgctccaacctacgcgcacagcagaaggaggggtgcctctgccagtacgcgaaagacccgacgtacgcgtcctacgtcaacaacaccaacgcacgcaagaccatcgccgcctgcggcatccccattcccagctgctaggctcgatctcccgccgccgccggccatgatgcgtacgtggcatatatacgcgtggtgtgtacgtgcgcttgaagaaaagggcgtgagtttgaattaataattatccagtacgcgatgtttgatcgatcgatgatgtgccttttttttttggtatttgaagtttgaactctgaatttcatcttgtgttaattggagtatgatagctgtgtgtacattcgttttggaggtagaggccggtttaattcattatctgttctaggcttgatcgccgcctcccgttggtgcggccatgatacgtgcactagtggagaagtgatctttactgggacatgcaaaaatcatattagtccctgttcaagtaggaacggttcaaaagtccataggttctttttatctttagtcccaccaaaattaaaaaaaaatcgtgaattgctgccttgaaccgtgcgcctcgtccttatctcctcctcccctctcattttctcaccctctccttcccctctcctccccctccccctccccctcccccctcctccgacgacggcgacgccgggcggcggcctcccctccgccagatcctacggaaggggagggcaagcgacagcctggcggaagcggccgcggcggctggtggtggcctccccttcgccagatccgacgagagaggaggctgggaggcggcgcacggttgggcagccggcggcgactgtggctgtggatttattttttagattttgtgaatgattcgtaaatattgttgtagatttttttagatttggtgacgattttgtggatgattttataaatggtttgtggattgtggatgattttgtggatgggcctatgaattgtgaatgattcgttgtgcatgatttgtggggatttagggatgacgacgttggtgcttgaaatcaatatatgactttagtgaactaatgaatgaaaaaaacaatgaaaaaaaaagaaaaaaaaactctagtggactggctagcgttaccatatttattttaaccacatctttagtccctaattggacgttccagtttgcaaaccagaactaaattaaaaaagattgtaaaccgggacttaaagagccctcgccgagcggtgttggcatagatactgtgtgcacttgaataaaacgatgtgggtttggattaataattaacgatcgattataactttattataggtgggtgtccagctaacgaataggaaaaagaagaaaaactcatatcatgagagagattaatgattgtgtgaaaacttaaaaatatgtaagattttttttccaaacggctgtttttagggtatttttccatgtcataaaagaattataactgagaagaattcttacatgcttccaaacttcaatcactactataacaacaaatacccctaaacggctgttgactggaatccagctaaaatggagagagaaaaatcctacttcaaaactcagaaattttacatggatttcaattcctgtgaaattacttcattctaaaaacgacctcatgccctaagagcgaagtcctgagatagatcaatcactatttcattactccctcagtttcagattatagtcgttttgactttgatgaaagtcaaattactccaaatatttgactaattttatagataaatatattaatttttacagcaacaaattagttttattttaacatattttcataatatatttgtcttggattgaaaatgttacaatttttttacaaatttgaagcagtttattttgatcaaaattaaaacgacttataatttaaaacaaagatagtactatagatttgattttttggaggagactctcggtaagttacggacagatataaattctctcgcctgcaacaatcgctctctaagggaccatttaaggagccacattaatgctagtagtaatagatgattcgacccaatattttgaccacaaagcaacaggccaaacataagaatgataacttgacaagcttgagttttttcaagtgaaaacacttactcctctatttaaaataagttaacttttagctataaatttgtagctataaagttagttttaattgggacggaggatgtacgcgagatgttgatgatgtgtattgttatgtccaaacgccttcagttcttttctgtagagcattgagagtgcaatgaaggccaaacagattaccacaagattgatgagtgatgacccatttattggtgctcatctgcccgaatttatttgctagtactacatccgctgtttccgttcaacgttcgggcttggtattgaaagctgcagtgcaaaatgtccgaaacggcacgcacaagtggaagtggtagctgccactatcaaattctactaaaggctgagtttagttttaaatttttttttcaaacttccaattttttcatcatatcagaactttcctatacacaaactttcaacttcaaccaaacttctaattttggcgtgaactaaacatatccaaaataggacggtactgcagggtacagatactgattcgtcctaatctgatcctaggtcgctatatagtgaaacgaaaggggtattttataacggtcaccagcctaccaccttataactactcacaacagaatactagttttctagtgatatagtataataactcatataaatcaactgttaaaatcatctttaatgaatgataatgttgataatactgagagcatcgtcgtaaagttaccataaaagtgtttttacggttcgtaccgtggtaacagagcagaagtgtaagttacttcctccgttttatattataagactttttagcattgtccacattcatatatatgttaataaatctagatatatatgtgtgcttagattcattaacatctatataaatgtggataatgctagaaagtcttataatctaaaatagaggtagtaaacattatagggcctatttggagagcttctagctgctgcaccttttcatagaattataaactctcccaaactctagtttctttatcaagattctaaagttgtagaattcaaaaaataaactaaaagctagatgctgggaaactcatagttccgatttccgatcttgtgggagcgtgaaatgctactacttcagagttcactattctgagatgatttatggtgtcaagtttgcgatatctcaactcaacaaaatcgtccaaaaatttcgcattgttggacatgttggttatgaaaacagcaccttcaatcgataacaacagatacttcggttgtgttcttttggagggtaaccctcccctcaacaaacggagcaacaaattcacacataattaattatgtgttatttaaaaactttgaaaaataaattaatatgatatttcacgtctacttttctatatatatagggggtgtttagattcaggggtgtaaagttttaacgtgtcacatcgggtattatatatggtgccgcatggggtgttcgagcactaataaaaaaataattacagaatccgtcagtaaaccatgagacgaatttattaagcccaattaatccgttattatcaaatatttactgtagcaccatattatcaaatcatggagcaagtaggcttaaaagattcgtctcgcaaattagtcgcaatctgtgcaattagttattttttagcctatatttaatacttcatgtaggtgttcaaacgttcgatatgacatggtgaaaaattttagggtgggacctaaacagggccatatttcttaaaagcacactatttagtattttggaaagcgtgcgtgcgaaaaacgagaaagtgaagattggaaaccttaagttaagaaaggggttctgaatatttttgccccttccatagataaaaaagaataagagtttcatatttaatattcctatttaatttttttaataatggattaaaccccggaataattaactatatgctactattacgagtggtgctaaattatttaccactggatctacatgttatggacacatgaggactcacatgtcatatacagcctctacatcccgtaggatgtacgtagccccaaagagacatagtctgagcatttaagcttgcaatacaggttacaaacaacatagatacttcctccgtttcataatgtaagtcattctagtatttctcacattcatattgatgttaatgaatctagacaaatatgaatgtgagaaatgctagaatgacttacattatgaaatggagggagtagaatacaaaatacaaatcaactgtctgtgattgaaatacgagtgtaattttgtgttacccataattaccagtgaaataaatttcccttggtagacaaaccgtttgttgggtgatggatgttacctagcatatggaaatattgaagagtgctaagctaggatccaaaatcaattcatgaaatagtagagcaatgaacattggcaacgaagcaaactagaatcaaacaccgcagatgtaaaaatcatcaacaaaaactccaatccaaattcaactggccataactgcttccatgccttgcattggtcgagagacgagaggatatgtccccagtggcaattgatgttgttgctgttgtcgccttggaccatatccctctcctctgatctctcctctgcagccagccagaacgtacggtgtctccggccgtcgtcacagattaggaaggggagatgcaggcggcggcggcggcggcacggacggcgagagggcaaggcgagactcctgggcagtttttttccctggtagtaatgggccttttccgacggattgtaatccgatcacagcccatccaaacgcacattttcagcccaaatggaaaaaattacggggcggtattatacacctgttttaggcccagaatcagtcataagttgggcatagaccgtgtcgacatggaatccagctaaaatggatgaaaaaatgta
